US008809059B2

(12) United States Patent
Bläsing et al.

(10) Patent No.: US 8,809,059 B2
(45) Date of Patent: Aug. 19, 2014

(54) PLANTS WITH INCREASED YIELD

(75) Inventors: Oliver Bläsing, Potsdam (DE); Piotr Puzio, Mariakerke (BE); Oliver Thimm, Berlin (DE); Gerhard Ritte, Potzdam (DE); Hardy Schön, Berlin (DE)

(73) Assignee: BASF Plant Science GmbH, Ludwigshafen (DE)

( * ) Notice: Subject to any disclaimer, the term of this patent is extended or adjusted under 35 U.S.C. 154(b) by 748 days.

(21) Appl. No.: 12/678,892

(22) PCT Filed: Sep. 19, 2008

(86) PCT No.: PCT/EP2008/062494
§ 371 (c)(1),
(2), (4) Date: Mar. 18, 2010

(87) PCT Pub. No.: WO2009/037329
PCT Pub. Date: Mar. 26, 2009

(65) Prior Publication Data
US 2010/0205690 A1    Aug. 12, 2010

(30) Foreign Application Priority Data

Sep. 21, 2007 (EP) .................................. 07116983
Oct. 30, 2007 (EP) .................................. 07119635
Mar. 20, 2008 (EP) .................................. 08153046
May 30, 2008 (EP) .................................. 08157331
Aug. 13, 2008 (EP) .................................. 08162290

(51) Int. Cl.
C12N 15/82 (2006.01)
C12N 5/04 (2006.01)
A01H 5/00 (2006.01)
C12N 15/87 (2006.01)

(52) U.S. Cl.
USPC ............ 435/468; 800/298; 800/278; 435/419

(58) Field of Classification Search
None
See application file for complete search history.

(56) References Cited

U.S. PATENT DOCUMENTS

| | | | |
|---|---|---|---|
| 6,620,610 | B2 | 9/2003 | Frommer et al. |
| 6,911,576 | B1 | 6/2005 | Kirby et al. |
| 7,026,163 | B1 | 4/2006 | Freimuth et al. |
| 2001/0003848 | A1 | 6/2001 | Frommer et al. |
| 2003/0204867 | A1 | 10/2003 | Frommer et al. |
| 2003/0233675 | A1* | 12/2003 | Cao et al. ................... 800/279 |
| 2004/0128720 | A1 | 7/2004 | Kaplan et al. |
| 2005/0097640 | A1 | 5/2005 | Fernandes |
| 2005/0108791 | A1 | 5/2005 | Edgerton |
| 2005/0202437 | A1* | 9/2005 | Glenn et al. ................... 435/6 |
| 2006/0037108 | A1 | 2/2006 | McCourt et al. |
| 2007/0124833 | A1 | 5/2007 | Abad et al. |
| 2008/0148432 | A1 | 6/2008 | Abad |
| 2008/0229451 | A1 | 9/2008 | Cao et al. |
| 2009/0089899 | A1 | 4/2009 | Shinozaki et al. |
| 2009/0300794 | A1 | 12/2009 | Plesch et al. |
| 2010/0031380 | A1 | 2/2010 | Kamlage et al. |
| 2010/0162432 | A1 | 6/2010 | Puzio et al. |
| 2010/0170003 | A1 | 7/2010 | Shirley et al. |
| 2010/0251416 | A1 | 9/2010 | Puzio et al. |
| 2010/0293665 | A1 | 11/2010 | Puzio et al. |
| 2010/0333234 | A1 | 12/2010 | Shirley et al. |
| 2011/0010800 | A1 | 1/2011 | Ritte et al. |
| 2011/0035841 | A1 | 2/2011 | Plesch et al. |
| 2011/0098183 | A1 | 4/2011 | Bläsing et al. |
| 2011/0107457 | A1 | 5/2011 | Frank et al. |
| 2011/0154530 | A1 | 6/2011 | Bläsing et al. |
| 2011/0258736 | A1 | 10/2011 | Puzio et al. |
| 2011/0277179 | A1 | 11/2011 | Puzio et al. |

FOREIGN PATENT DOCUMENTS

| | | |
|---|---|---|
| CA | 2007091 A1 | 6/1990 |
| DE | 43 37 597 A1 | 5/1995 |
| EP | 0 375 091 A1 | 6/1990 |
| EP | 1 262 562 A2 | 12/2002 |
| EP | 1 586 652 A1 | 10/2005 |
| EP | 1 621 632 A1 | 2/2006 |
| EP | 1 914 308 A1 | 4/2008 |
| WO | WO-92/13082 A1 | 8/1992 |
| WO | WO-95/09911 A1 | 4/1995 |
| WO | WO-98/21339 A1 | 5/1998 |
| WO | WO-98/21340 A1 | 5/1998 |
| WO | WO-98/21341 A2 | 5/1998 |
| WO | WO-99/28480 A1 | 6/1999 |
| WO | WO-00/09726 A1 | 2/2000 |
| WO | WO-01/12833 A2 | 2/2001 |

(Continued)

OTHER PUBLICATIONS

Accession_No. B65078.*
SEQIDNO-148_v_B65078.*
Lazar in MCB 8:1247 (1988).*
Oxidoreductase EC entries 10312012.*
Springer in 2006.*
Hannah et al., PLoS Genetics, 1(2):179-196 (2005).*
Accession No. U00096 (full-length *E. coli* sequence is publically available and is provided in pertinent part within the Offic Action).*
Van Camp, Curr Opin Biotech 16:147-53 (2005).*
Ahn, J. H., et al., "A Novel Extensin Gene Encoding a Hydroxyproline-Rich Glycoprotein Requires Sucrose for Its Wound-Inducible Expression in Transgenic Plants", The Plant Cell, 1996, vol. 8, pp. 1477-1490.

(Continued)

*Primary Examiner* — Medina A Ibrahim
*Assistant Examiner* — Russell Boggs
(74) *Attorney, Agent, or Firm* — Drinker Biddle & Reath LLP

(57) ABSTRACT

The present invention disclosed herein provides a method for producing a plant with increased yield as compared to a corresponding wild type plant comprising increasing or generating one or more activities in a plant or a part thereof. The present invention further relates to nucleic acids enhancing or improving one or more traits of a transgenic plant, and cells, progenies, seeds and pollen derived from such plants or parts, as well as methods of making and methods of using such plant cell(s) or plant(s), progenies, seed(s) or pollen. Particularly, said improved trait(s) are manifested in an increased yield, preferably by improving one or more yield-related trait(s), e.g. low temperature tolerance.

26 Claims, 11 Drawing Sheets

(56) References Cited

FOREIGN PATENT DOCUMENTS

| WO | WO-2004/065606 A2 | 8/2004 |
| WO | WO-2005/083094 A2 | 9/2005 |
| WO | WO-2006/032708 A2 | 3/2006 |
| WO | WO-2006/137574 A1 | 12/2006 |
| WO | WO-2007/031581 A2 | 3/2007 |
| WO | WO-2007/044988 A2 | 4/2007 |
| WO | WO-2007/052376 A1 | 5/2007 |
| WO | WO-2007/054522 A1 | 5/2007 |
| WO | WO-2007/078280 A2 | 7/2007 |
| WO | WO-2007/079353 A2 | 7/2007 |
| WO | WO-2007/099096 A1 | 9/2007 |
| WO | WO-2007/106524 A2 | 9/2007 |
| WO | WO-2007/110314 A2 | 10/2007 |
| WO | WO-2009/056984 A1 | 5/2009 |
| WO | WO-2009/078712 A2 | 6/2009 |

OTHER PUBLICATIONS

Altschul, S. F., et al., "Gapped BLAST and PSI-BLAST: A New Generation of Protein Database Search Programs", Nucleic Acids Research, 1997, vol. 25, No. 17, pp. 3389-3402.

Amann, E., et al., "Tightly Regulated *tac* Promoter Vectors Useful for the Expression of Unfused and Fused Proteins in *Escherichia coli*", Gene, 1988, vol. 69, pp. 301-315.

An, G., "Binary Ti Plasmid Vectors", Methods in Molecular Biology, vol. 44: Agrobacterium Protocols, pp. 47-58.

Babic, V., et al., "Development of an Efficient *Agrobacterium*-mediated Transformation Systems for *Brassica carinata*", Plant Cell Reports, 1998, vol. 17, pp. 183-188.

Bäumlein, H., et al., "*Cis*-Analysis of a Seed Protein Gene Promoter: The Conservative RY Repeat CATGCATG within the Legumin Box is Essential for Tissue-Specific Expression of a Legumin Gene", The Plant Journal, 1992, vol. 2, No. 2, pp. 233-239.

Baker, S. S., et al., "The 5'-Region of *Arabidopsis thaliana cor15a* Has *cis*-Acting Elements that Confer Cold-, Drought- and ABA-Regulated Gene Expression", Plant Molecular Biology, 1994, vol. 24, pp. 701-713.

Bartel, D. P., et al., "Isolation of New Ribozymes from a Large Pool of Random Sequences", Science, 1993, vol. 261, pp. 1411-1418.

Bebbington, C. R., et al., "High-Level Expression of a Recombinant Antibody from Myeloma Cells Using a Glutamine Synthetase Gene as an Amplifiable Selectable Marker", Bio/Technology, 1992, vol. 10, pp. 169-175.

Hirsch, R. E., et al., "Improving Nutrient Capture from Soil by the Genetic Manipulation of Crop Plants", Trends in Biotechnol., 1999, vol. 17, pp. 356-361.

Becker, D., et al., "New Plant Binary Vectors with Selectable Markers Located Proximal to the Left T-DNA Border", Plant Molecular Biology, 1992, vol. 20, pp. 1195-1197.

Benfey, P. N., et al., "The CaMV 35S Enhancer Contains at Least Two Domains Which can Confer Different Developmental and Tissue-Specific Expression Patterns", The EMBO Journal, 1989, vol. 8, No. 8, pp. 2195-2202.

Bevan, M., "Binary *Agrobacterium* Vectors for Plant Transformation", Nucleic Acids Research, 1984, vol. 12, No. 22, pp. 8711-8721.

Blattner, F. R., et al., "The Complete Genome Sequence of *Escherichia coli* K-12", Science, 1997, vol. 277, pp. 1453-1462.

Bloom, A. J., et al., "Root Respiration Associated with Ammonium and Nitrate Absorption and Assimilation by Barley", Plant Physiol., 1992, vol. 99, pp. 1294-1301.

Bohnert, H. J., et al., "Adaptations to Environmental Stresses", The Plant Cell, 1995, vol. 7, pp. 1099-1111.

Boyer, J. S., "Plant Productivity and Environment", Science, 1982, vol. 218, pp. 443-448.

Chichkova, S., et al., "Transgenic Tobacco Plants that Overexpress Alfalfa NADH-Glutamate Synthase Have Higher Carbon and Nitrogen Content", Journal of Experimental Botany, 2001, vol. 52, No. 364, pp. 2079-2087.

Cook, D., et al., "A Prominent Role for the CBF Cold Response Pathway in Configuring the Low-Temperature Metabolome of *Arabidopsis*", PNAS, 2004, vol. 101, No. 42, pp. 15243-15248.

Crawford, N. M., et al., "Molecular and Physiological Aspects of Nitrate Uptake in Plants", Trends in Plant Science, 1998, vol. 3, No. 10, pp. 389-395.

Goffeau, A., et al., "Life with 6000 Genes", Science, 1996, vol. 274, pp. 546, 563-567.

Lam, H.-M., et al., "Overexpression of the *ASN1* Gene Enhances Nitrogen Status in Seeds of Arabidopsis", Plant Physiology, 2003, vol. 132, pp. 926-935.

Smirnoff, N., "Plant Resistance to Environmental Stress", Current Opinion in Biotechnology, 1998, vol. 9, pp. 214-219.

Von Wirén, N., et al., "The Molecular Physiology of Ammonium Uptake and Retrieval", Current Opinion in Plant Biology, 2000, vol. 3, pp. 254-261.

Wang, W., et al., "Plant Responses to Drought, Salinity and Extreme Temperatures: Towards Genetic Engineering for Stress Tolerance", Planta, 2003, vol. 218, pp. 1-14.

Yanagisawa, S., et al., "Metabolic Engineering with Dof1 Transcription Factor in Plants: Improved Nitrogen Assimilation and Growth Under Low-Nitrogen Conditions", PNAS, 2004, vol. 101, No. 20, pp. 7833-7838.

Zhu, J.-K., "Cell Signaling under Salt, Water and Cold Stresses", Current Opinion in Plant Biology, 2001, vol. 4, pp. 401-406.

Zhu, J.-K., "Plant Salt Tolerance", Trends in Plant Science, 2001, vol. 6, No. 2, pp. 66-71.

Knight, H., et al., "Abiotic Stress Signalling Pathways: Specificity and Cross-Talk", Trends in Plant Science, 2001, vol. 6, No. 6, pp. 262-267.

Serrano, R., et al., "Genetic Engineering of Salt and Drought Tolerance with Yeast Regulatory Genes", Scientia Horticulturae, 1999, vol. 78, pp. 261-269.

Serrano, R., et al., "A Glimpse of the Mechanisms of Ion Homeostasis during Salt Stress", Journal of Experimental Botany, 1999, vol. 50, Special Issue, pp. 1023-1036.

Shinozaki, K., et al., "Molecular Responses to Dehydration and Low Temperature: Differences and Cross-Talk between Two Stress Signaling Pathways", Current Opinion in Plant Biology, 2000, vol. 3, pp. 217-223.

Caparrós-Martin J. A., et al., "*Arabidopsis thaliana* AtGpp1 and AtGpp2: Two Novel Low Molecular Weight Phosphatases Involved in Plant Glycerol Metabolism", Plant Mol. Biol., 2007, vol. 63, pp. 505-517.

"Using DNA Fragments as Probes", Unit 6.3 in Current Protocols in Molecular Biology, Ausuble, F. M., et al., eds., 1993, pp. 6.3.1-6.3.6, John Wiley & Sons.

Hitchcock, A. L., et al., "A Subset of Membrane-Associated Proteins Is Ubiquitinated in Response to Mutations in the Endoplasmic Reticulum Degradation Machinery", PNAS, 2003, vol. 11, No. 22, pp. 12735-12740.

Martin, A., et al., "Two Cytosolic Glutamine Synthetase Isoforms of Maize Are Specifically Involved in the Control of Grain Production", The Plant Cell, 2006, vol. 18, pp. 3252-3274.

Sun, H., et al., "Highly Effective Expression of Glutamine Synthetase Genes *GS1* and *GS2* in Transgenic Rice Plants Increases Nitrogen-Deficiency Tolerance", Journal of Plant Physiology and Molecular Biology, 2005, vol. 31, No. 5, pp. 492-498.

Kaneko, T., et al., "Sequence Analysis of the Genome of the Unicellular Cyanobacterium *Synechocystis* sp. Strain PCC6803. II. Sequence Determination of the Entire Genome and Assignment of Potential Protein-Coding Regions", DNA Res., 1996, vol. 3, No. 3, pp. 109-136.

"SubName: Full= Precorrin-6y Methylase", UniProt Database Accession No. Q55879, Nov. 1, 1996.

"RecName: Full=Glutamine Synthetase; Short=GS; EC=6.3.1.2; AltName: Full=Glutamate-Ammonia Ligase", UniProt Database Accession No. P32288, Oct. 1, 1993.

Partial European Search Report dated Jun. 20, 2013 Issued in European Application No. 13155119.4.

Partial European Search Report dated Jun. 19, 2013 Issued in European Application No. 13155121.0.

Partial European Search Report dated Jun. 19, 2013 Issued in European Application No. 13155122.8.

\* cited by examiner

Fig. 1a Vector VC-MME220-1 (SEQ ID NO: 1) used for cloning gene of interest for non-targeted expression.
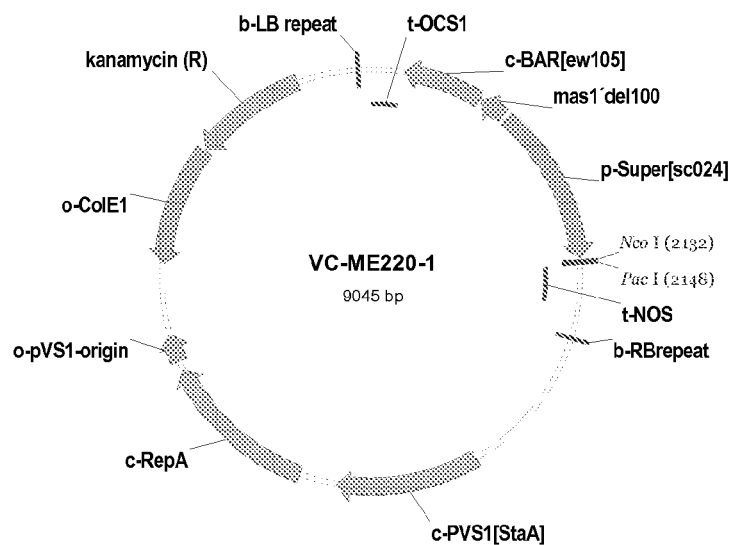
Fig. 1b Vector VC-MME220-1qcz (SEQ ID NO: 6064)used for cloning gene of interest for non-targeted expression.
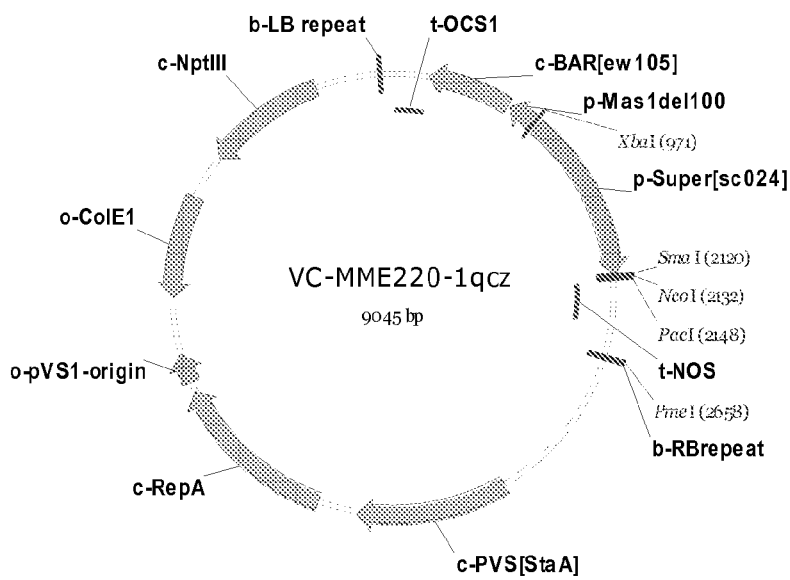

Fig. 2a Vector VC-MME221-1 (SEQ ID NO: 2) used for cloning gene of interest for non-targeted expression.
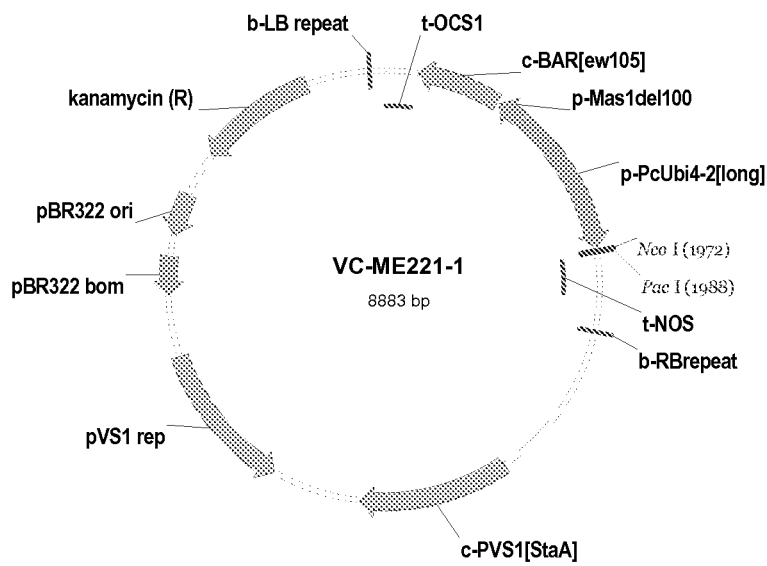
Fig. 2b Vector VC-MME221-1qcz (SEQ ID NO: 6069) used for cloning gene of interest for non-targeted expression.
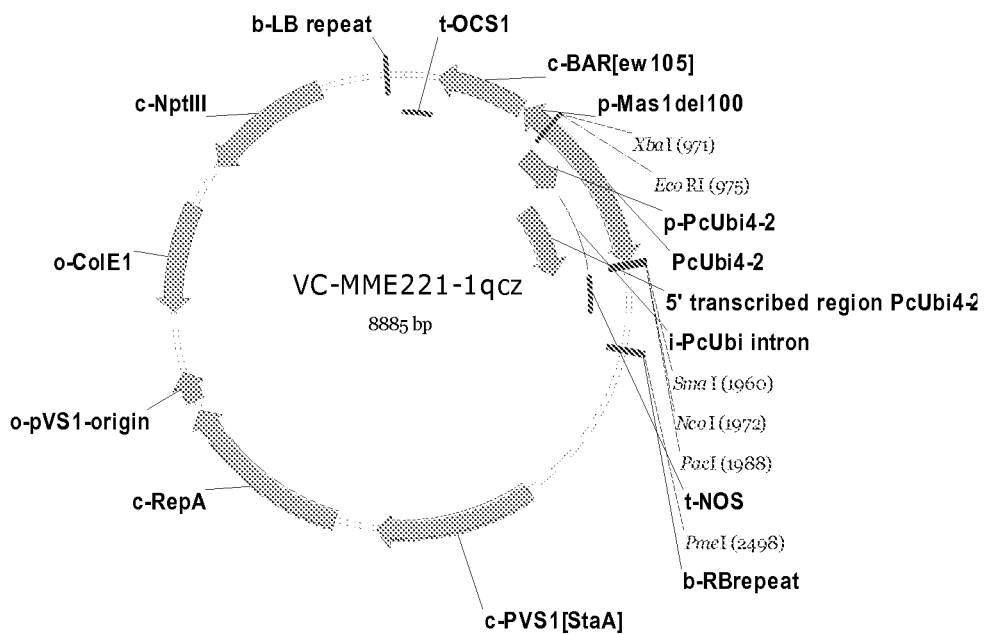

Fig. 3a Vector VC-MME354-1 (SEQ ID NO: 3) used for cloning gene of interest for plastidic targeted expression.
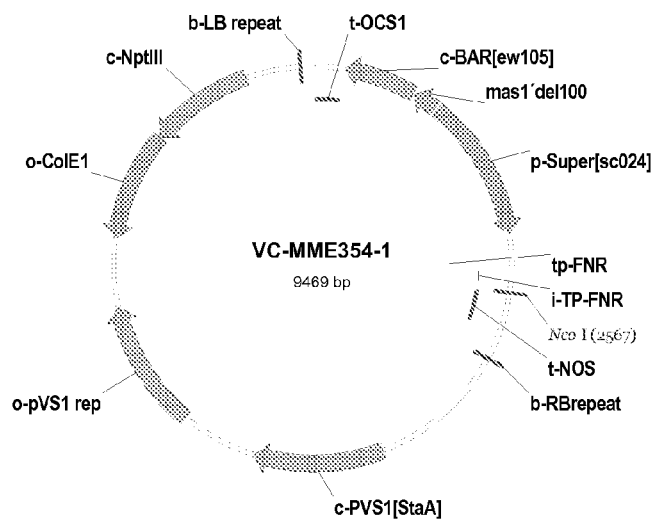
Fig. 3b Vector VC-MME354-1QCZ (SEQ ID NO: 6055) used for cloning gene of interest for plastidic targeted expression.
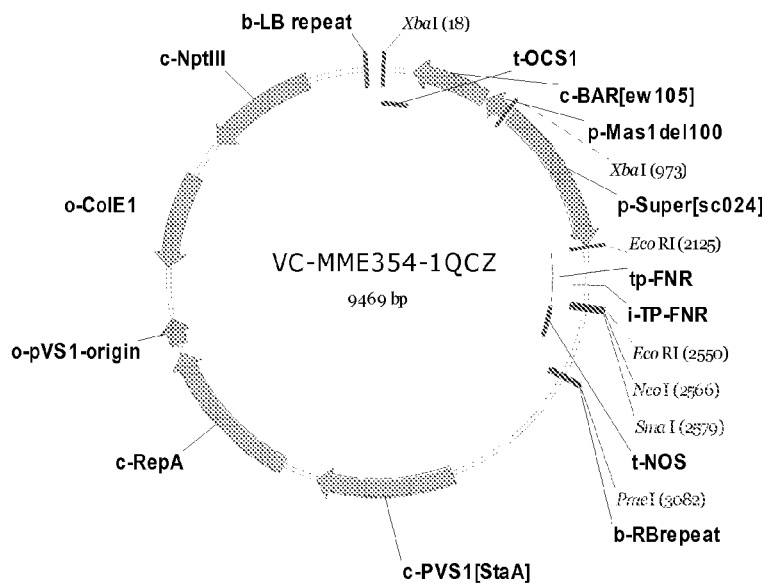

Fig. 4a Vector VC-MME432-1 (SEQ ID NO: 5) used for cloning gene of interest for plastidic targeted expression.
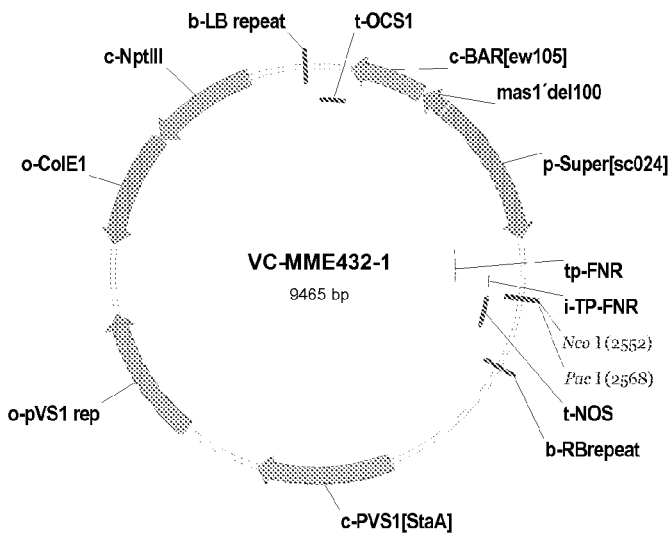
Fig. 4b Vector VC-MME432-1qcz (SEQ ID NO: 6065) used for cloning gene of interest for plastidic targeted expression.
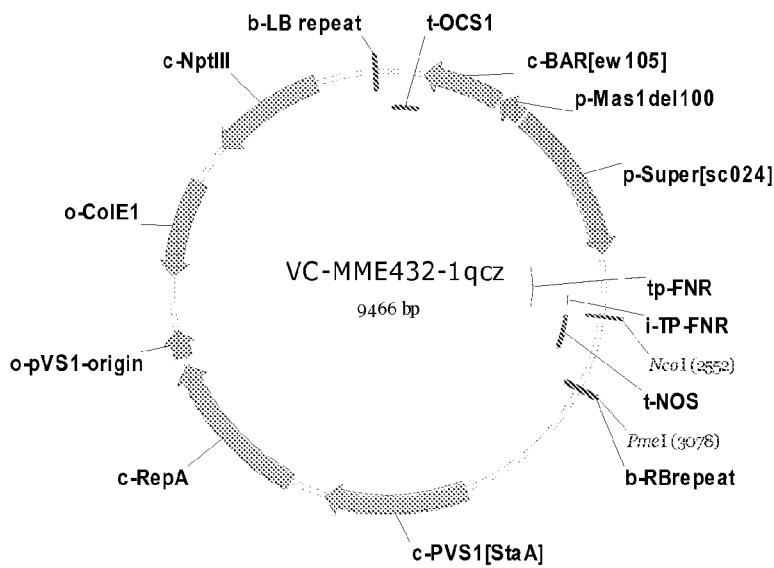

Fig. 5a Vector VC-MME489-1 (SEQ ID NO: 15) used for cloning gene of interest for non-targeted expression and cloning of a targeting sequence.
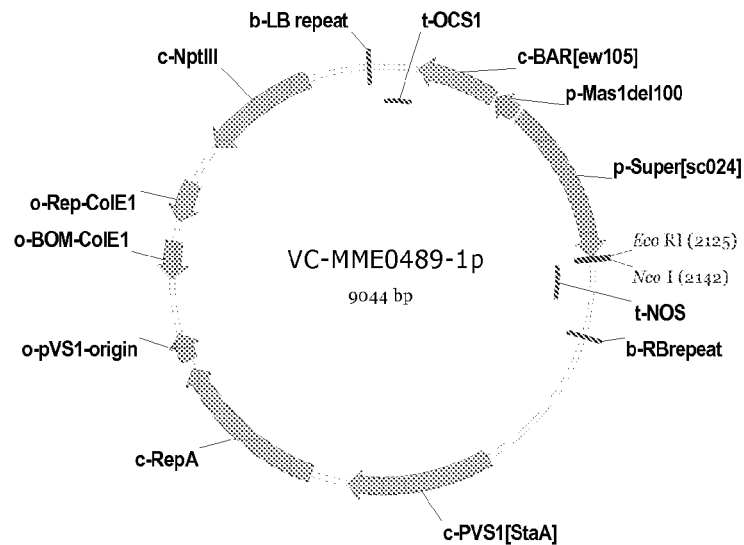
Fig. 5b Vector VC-MME489-1QCZ (SEQ ID NO: 6079) used for cloning gene of interest for non-targeted expression and cloning of a targeting sequence.
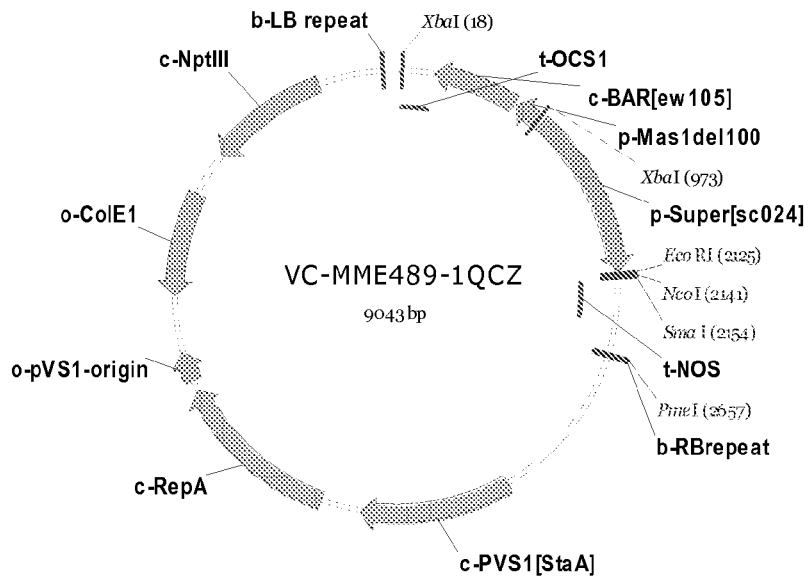

Fig. 6 Vector pMTX0270p (SEQ ID NO: 16) used for cloning of a targeting sequence.
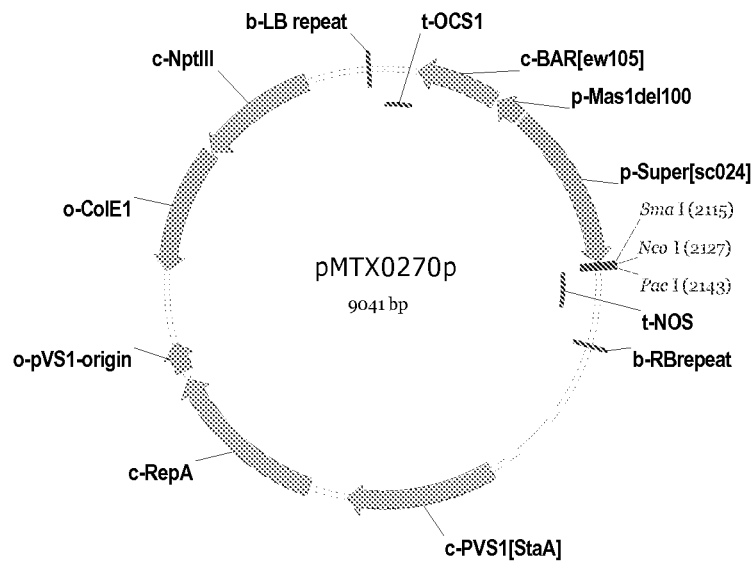
Fig. 7 Vector pMTX155 (SEQ ID NO: 6054) used for used for cloning gene of interest for non-targeted expression.
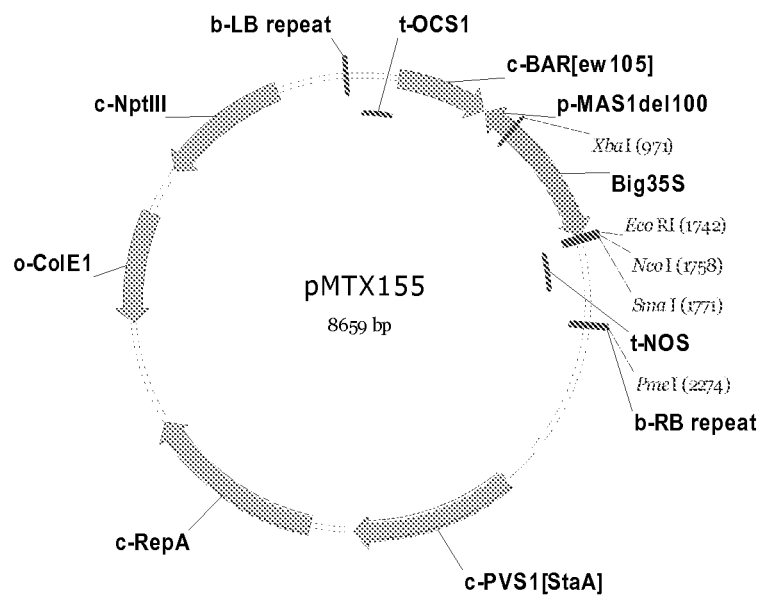

Fig. 8 Vector VC-MME356-1QCZ (SEQ ID NO: 6057) used for mitochondric targeted expression.
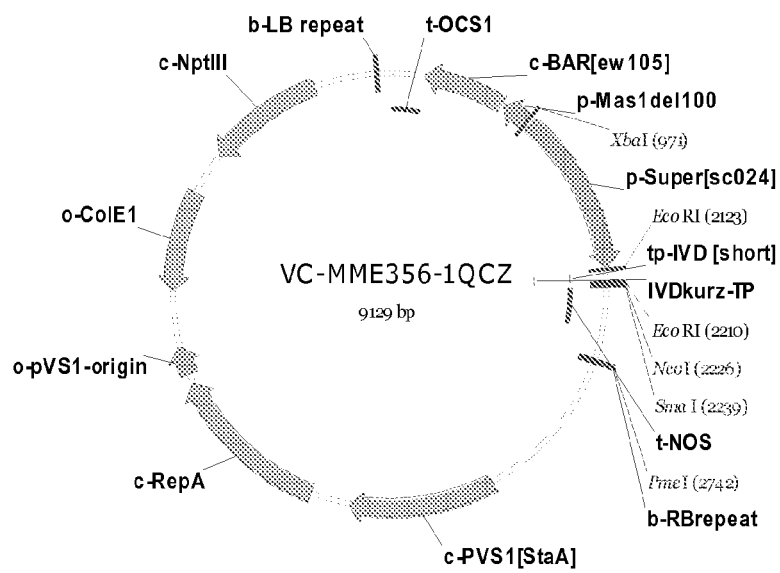
Fig. 9 Vector VC-MME301-1QCZ (SEQ ID NO: 6059) used for non-targeted expres-sion in preferentially seeds.
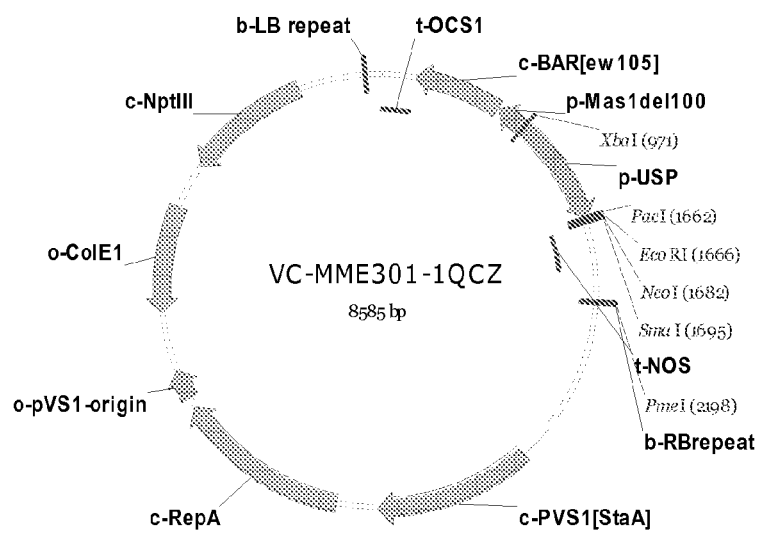

Fig. 10 Vector pMTX461korrp (SEQ ID NO: 6060) used for plastidic targeted expres-sion in preferentially seeds.
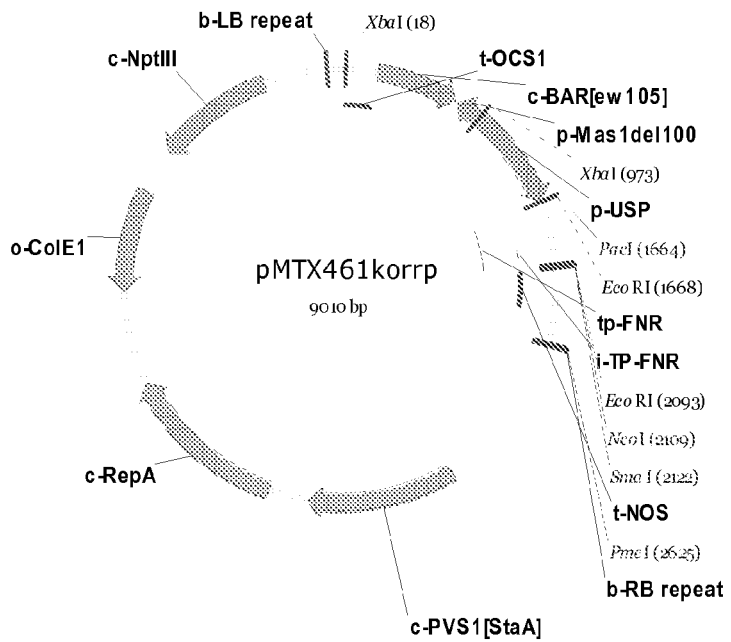
Fig. 11 Vector VC-MME462-1QCZ (SEQ ID NO: 6062) used for mitochondric targeted expression in preferentially seeds.
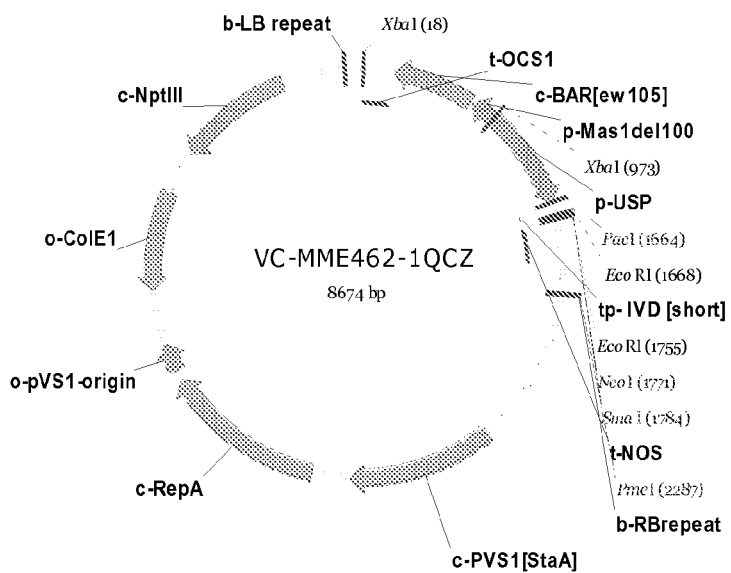

Fig. 12 Vector VC-MME431-1qcz (SEQ ID NO: 6067) used for mitochondric targeted expression.
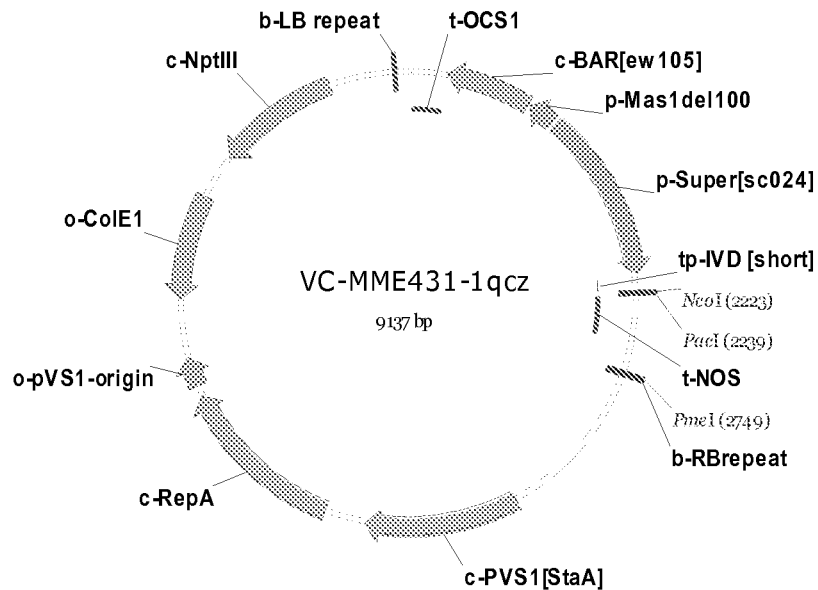
Fig. 13 Vector pMTX447korr (SEQ ID NO: 6070) used for plastidic targeted expres-sion.
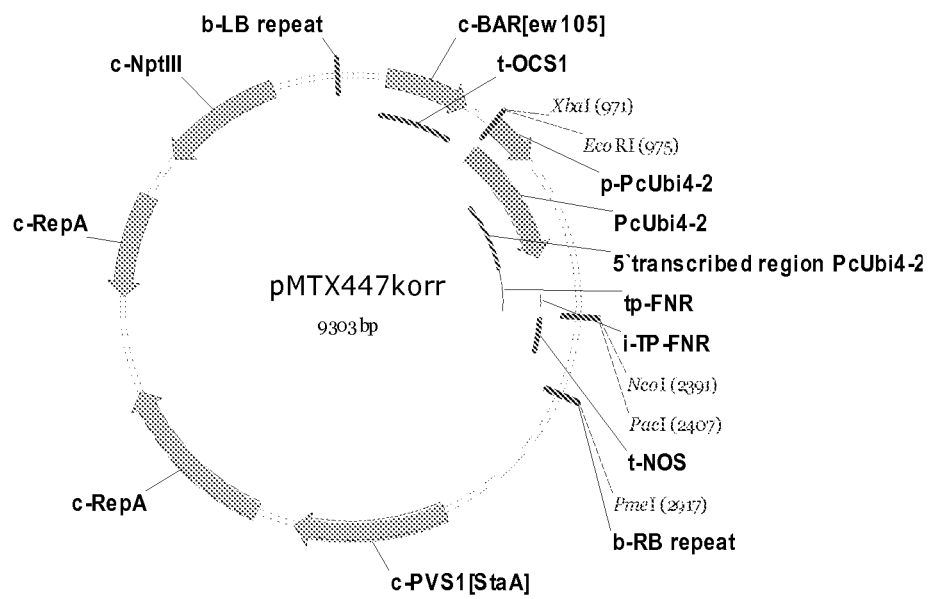

Fig. 14 Vector VC-MME445-1qcz (SEQ ID NO: 6072) used for mitochondric targeted expression.
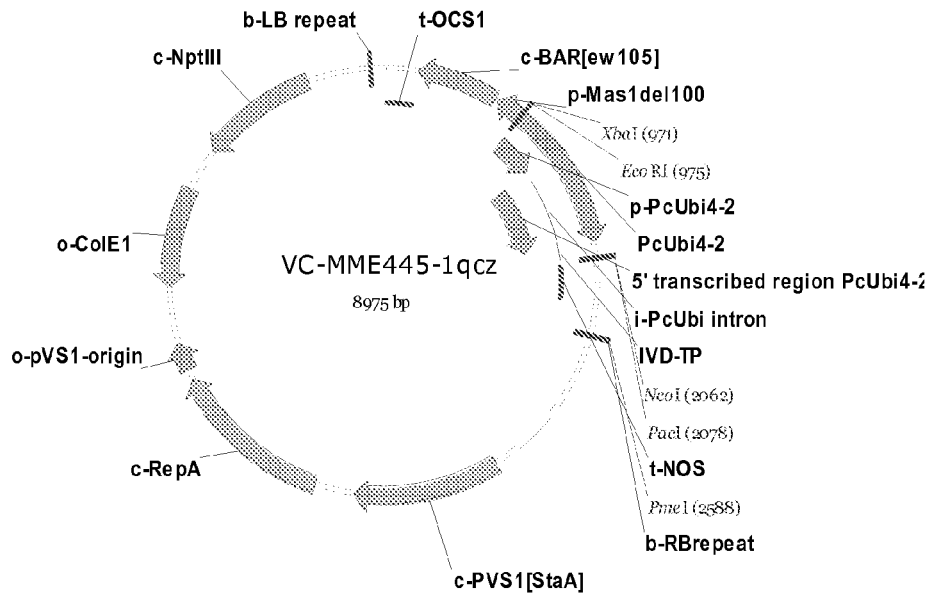
Fig. 15 Vector VC-MME289-1qcz (SEQ ID NO: 6074) used for non targeted expres-sion in preferentially seeds.
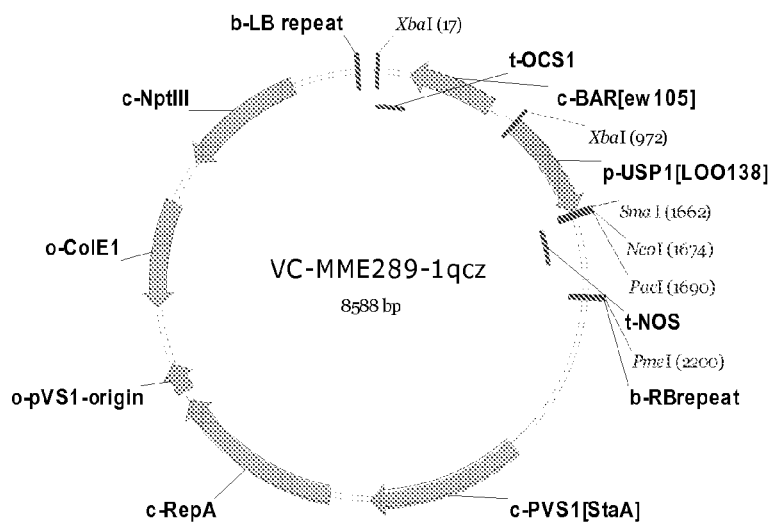

Fig. 16 Vector VC-MME464-1qcz (SEQ ID NO: 6075) used for plastidic targeted ex-pression in preferentially seeds.
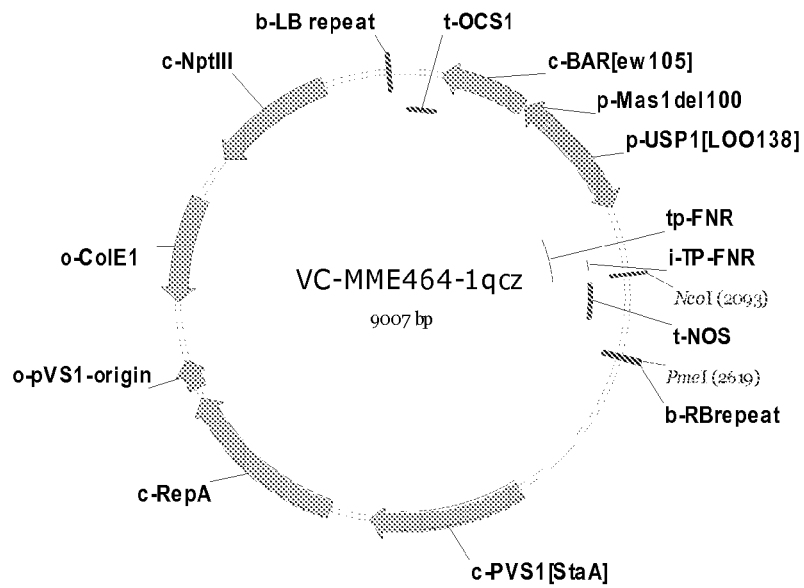
Fig. 17 Vector VC-MME465-1qcz (SEQ ID NO: 6077) used for mitochondric targeted expression in preferentially seeds.
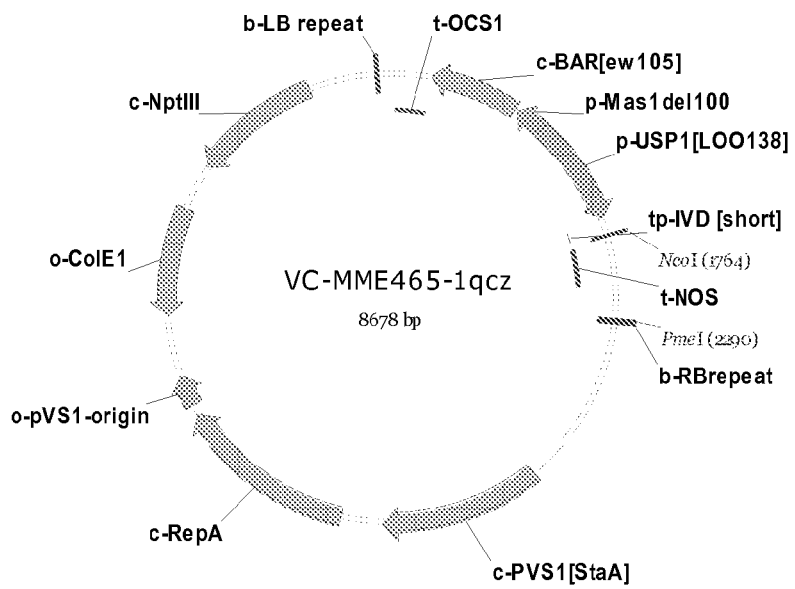

PLANTS WITH INCREASED YIELD

RELATED APPLICATIONS

This application is a national stage application (under 35 U.S.C. §371) of PCT/EP2008/062494, filed Sep. 19, 2008, which claims benefit of European application 07116983.3, filed Sep. 21, 2007, European application 07119635.6, filed Oct. 30, 2007, European application 08153046.1, filed Mar. 20, 2008, European application 08157331.3, filed May 30, 2008 and European application 08162290.4, filed Aug. 13, 2008.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_13987_00116. The size of the text file is 55,926 KB, and the text file was created on Mar. 17, 2010.

FIELD OF THE INVENTION

The present invention disclosed herein provides a method for producing a plant with increased yield as compared to a corresponding wild type plant comprising increasing or generating one or more activities in a plant or a part thereof. The present invention further relates to nucleic acids enhancing or improving one or more traits of a transgenic plant, and cells, progenies, seeds and pollen derived from such plants or parts, as well as methods of making and methods of using such plant cell(s) or plant(s), progenies, seed(s) or pollen. Particularly, said improved trait(s) are manifested in an increased yield, preferably by improving one or more yield-related trait(s), e.g. low temperature tolerance.

BACKGROUND OF THE INVENTION

Under field conditions, plant performance, for example in terms of growth, development, biomass accumulation and seed generation, depends on a plant's tolerance and acclimation ability to numerous environmental conditions, changes and stresses. Since the beginning of agriculture and horticulture, there was a need for improving plant traits in crop cultivation. Breeding strategies foster crop properties to withstand biotic and abiotic stresses, to improve nutrient use efficiency and to alter other intrinsic crop specific yield parameters, i.e. increasing yield by applying technical advances Plants are sessile organisms and consequently need to cope with various environmental stresses. Biotic stresses such as plant pests and pathogens on the one hand, and abiotic environmental stresses on the other hand are major limiting factors for plant growth and productivity (Boyer, Plant Productivity and Environment, Science 218, 443-448 (1982); Bohnert et al., Adaptations to Environmental Stresses, Plant Cell 7(7), 1099-1111 (1995)), thereby limiting plant cultivation and geographical distribution. Plants exposed to different stresses typically have low yields of plant material, like seeds, fruit or other produces. Crop losses and crop yield losses caused by abiotic and biotic stresses represent a significant economic and political factor and contribute to food shortages, particularly in many underdeveloped countries.

Conventional means for crop and horticultural improvements today utilize selective breeding techniques to identify plants with desirable characteristics. Advances in molecular biology have allowed to modify the germplasm of plants in a specific way.—For example, the modification of a single gene, resulted in several cases in a significant increase in e.g. stress tolerance (Wang et al., 2003) as well as other yield-related traits. There is a need to identify genes which confer resistance to various combinations of stresses or which confer improved yield under suboptimal growth conditions. There is still a need to identify genes which confer the overall capacity to improve yield of plants.

Thus, there is a need to identify genes which confer increased yield of a plant.

BRIEF DESCRIPTION OF THE DRAWINGS

FIGS. 1a and 1b. Vector VC-MME220-1 (SEQ ID NO: 1) or VC-MME220-1qcz (SEQ ID NO: 6064) used for cloning gene of interest for non-targeted expression.

FIGS. 2a and 2b. Vector VC-MME221-1 (SEQ ID NO: 2) or VC-MME221-1qcz (SEQ ID NO: 6069) used for cloning gene of interest for non-targeted expression.

FIGS. 3a and 3b. Vector VC-MME354-1 (SEQ ID NO: 3) or VC-MME354-1QCZ (SEQ ID NO: 6055) used for cloning gene of interest for plastidic targeted expression.

FIGS. 4a and 4b. Vector VC-MME432-1 (SEQ ID NO: 5) or VC-MME432-1qcz (SEQ ID NO: 6065) used for cloning gene of interest for plastidic targeted expression.

FIGS. 5a and 5b. Vector VC-MME489-1p (SEQ ID NO: 15) or VC-MME489-1QCZ (SEQ ID NO: 6079) used for cloning gene of interest for non-targeted expression and cloning of a targeting sequence.

FIG. 6. Vector pMTX0270p (SEQ ID NO: 16) used for cloning of a targeting sequence.

FIG. 7. Vector pMTX155 (SEQ ID NO: 6054) used for used for cloning gene of interest for non-targeted expression.

FIG. 8. Vector VC-MME356-1QCZ (SEQ ID NO: 6057) used for mitochondric targeted expression.

FIG. 9. Vector VC-MME301-1QCZ (SEQ ID NO: 6059) used for non-targeted expression in preferentially seeds.

FIG. 10. Vector pMTX461korrp (SEQ ID NO: 6060) used for plastidic targeted expression in preferentially seeds.

FIG. 11. Vector VC-MME462-1QCZ (SEQ ID NO: 6062) used for mitochondric targeted expression in preferentially seeds.

FIG. 12. Vector VC-MME431-1qcz (SEQ ID NO: 6067) used for mitochondric targeted expression.

FIG. 13. Vector pMTX447korr (SEQ ID NO: 6070) used for plastidic targeted expression.

FIG. 14. Vector VC-MME445-1qcz (SEQ ID NO: 6072) used for mitochondric targeted expression.

FIG. 15. Vector VC-MME289-1qcz (SEQ ID NO: 6074) used for non-targeted expression in preferentially seeds.

FIG. 16. Vector VC-MME464-1qcz (SEQ ID NO: 6075) used for plastidic targeted expression in preferentially seeds.

FIG. 17. Vector VC-MME465-1qcz (SEQ ID NO: 6077) used for mitochondric targeted expression in preferentially seeds.

DETAILED DESCRIPTION OF THE INVENTION

Accordingly, in a first embodiment, the present invention provides a method for producing a plant with increased yield as compared to a corresponding wild type plant comprising at least the following step: increasing or generating one or more activities selected from the group consisting of (DL-)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein.

The term "yield" as used herein generally refers to a measurable produce from a plant, particularly a crop. Yield and yield increase (in comparison to a non-transformed starting or wild-type plant) can be measured in a number of ways, and it is understood that a skilled person will be able to apply the correct meaning in view of the particular embodiments, the particular crop concerned and the specific purpose or application concerned.

Preferably, the preferred enhanced or improved yield characteristics of a plant described herein according to the present invention can be achieved in the absence or presence of stress conditions.

The meaning of "yield" is, thus, mainly dependent on the crop of interest and the intended application, and it is understood, that the skilled person will understand in each particular case what is meant from the circumstances of the description.

For the purposes of the description of the present invention, enhanced or increased "yield" refers to one or more yield parameters selected from the group consisting of biomass yield, dry biomass yield, aerial dry biomass yield, underground dry biomass yield, fresh-weight biomass yield, aerial fresh-weight biomass yield, underground fresh-weight biomass yield; enhanced yield of harvestable parts, either dry or fresh-weight or both, either aerial or underground or both; enhanced yield of crop fruit, either dry or fresh-weight or both, either aerial or underground or both; and preferably enhanced yield of seeds, either dry or fresh-weight or both, either aerial or underground or both.

The term "yield" as used herein generally refers to a measurable produce from a plant, particularly a crop.

Yield and yield increase (in comparison to an origin or wild-type plant) can be measured in a number of ways. It is understood that a skilled person will be able to apply the correct meaning in view of the particular embodiments, the particular crop concerned and the specific purpose or application concerned.

For example, the present invention provides methods for producing transgenic plant cells or plants with can show an increased yield-related trait, e.g. an increased tolerance to environmental stress and/or increased intrinsic yield and/or biomass production as compared to a corresponding (e.g. non-transformed) wild type or starting plant by increasing or generating one or more of said activities mentioned above.

In one embodiment, an increase in yield refers to increased harvestable yield, biomass yield and/or an increased seed yield.

"Yield" as described herein refers in one embodiment to harvestable yield of a plant. The yield of a plant can depend on the specific plant/crop of interest as well as its intended application (such as food production, feed production, processed food production, bio-fuel, biogas or alcohol production, or the like) of interest in each particular case. Thus, in one embodiment, yield is calculated as harvest index (expressed as a ratio of the weight of the respective harvestable parts divided by the total biomass), harvestable parts weight per area (acre, square meter, or the like); and the like.

In one embodiment, "yield" refers to biomass yield, e.g. to dry weight biomass yield and/or fresh-weight biomass yield. Biomass yield refers to the aerial or underground parts of a plant, depending on the specific circumstances (test conditions, specific crop of interest, application of interest, and the like). In one embodiment, biomass yield refers to the aerial and underground parts. Biomass yield may be calculated as fresh-weight, dry weight or a moisture adjusted basis. Biomass yield may be calculated on a per plant basis or in relation to a specific area (e.g. biomass yield per acre/square meter/or the like).

In other embodiment, "yield" refers to seed yield which can be measured by one or more of the following parameters: number of seeds or number of filled seeds (per plant or per area (acre/square meter/or the like)); seed filling rate (ratio between number of filled seeds and total number of seeds); number of flowers per plant; seed biomass or total seeds weight (per plant or per area (acre/square meter/or the like); thousand kernel weight (TKW; extrapolated from the number of filled seeds counted and their total weight; an increase in TKW may be caused by an increased seed size, an increased seed weight, an increased embryo size, and/or an increased endosperm). Other parameters allowing to measure seed yield are also known in the art. Seed yield may be determined on a dry weight or on a fresh weight basis, or typically on a moisture adjusted basis, e.g. at 15.5 percent moisture.

Said increased yield in accordance with the present invention can typically be achieved by enhancing or improving, in comparison to an origin or wild-type plant, one or more yield-related traits of the plant. Such yield-related traits of a plant the improvement of which results in increased yield comprise, without limitation, the increase of the intrinsic yield capacity of a plant, improved nutrient use efficiency, and/or increased stress tolerance, in particular increased abiotic stress tolerance.

Accordingly, in one embodiment, the yield-related trait conferring an increase of the plant's yield is an increase of the intrinsic yield capacity of a plant and can be, for example, manifested by improving the specific (intrinsic) seed yield (e.g. in terms of increased seed/grain size, increased ear number, increased seed number per ear, improvement of seed filling, improvement of seed composition, embryo and/or endosperm improvements, or the like); modification and improvement of inherent growth and development mechanisms of a plant (such as plant height, plant growth rate, pod number, pod position on the plant, number of internodes, incidence of pod shatter, efficiency of nodulation and nitrogen fixation, efficiency of carbon assimilation, improvement of seedling vigour/early vigour, enhanced efficiency of germination (under stressed or non-stressed conditions), improvement in plant architecture, cell cycle modifications, photosynthesis modifications, various signaling pathway modifications, modification of transcriptional regulation, modification of translational regulation, modification of enzyme activities, and the like); and/or the like.

Accordingly, in one embodiment, the yield-related trait conferring an increase of the plant's yield is an improvement or increase of stress tolerance of a plant and can be for example manifested by improving or increasing a plant's tolerance against stress, particularly abiotic stress. In the present application, abiotic stress refers generally to abiotic environmental conditions a plant is typically confronted with, including conditions which are typically referred to as "abiotic stress" conditions including, but not limited to, drought (tolerance to drought may be achieved as a result of improved water use efficiency), heat, low temperatures and cold conditions (such as freezing and chilling conditions), salinity, osmotic stress, shade, high plant density, mechanical stress, oxidative stress, and the like.

Accordingly, in one embodiment of the present invention, an increased plant yield is mediated by increasing the "nutrient use efficiency of a plant", e.g. by improving the use efficiency of nutrients including, but not limited to, phosphorus, potassium, and nitrogen.

For example, there is a need for plants that are capable to use nitrogen more efficiently so that less nitrogen is required for growth and therefore resulting in the improved level of yield under nitrogen deficiency conditions. Further, higher yields may be obtained with current or standard levels of nitrogen use.

Accordingly, in one embodiment of the present invention, plant yield is increased by increasing nitrogen use efficiency of a plant or a part thereof. Thus, it is a further object of this invention to provide a plant, which show an enhanced nitrogen use efficiency, and/or exhibit, under conditions of limited nitrogen supply, an increased yield, as compared to a corresponding wild type plant.

Because of the high costs of nitrogen fertilizer in relation to the revenues for agricultural products, and additionally its deleterious effect on the environment, it is desirable to develop strategies to reduce nitrogen input and/or to optimize nitrogen uptake and/or utilization of a given nitrogen availability while simultaneously maintaining optimal yield, productivity and quality of plants, preferably cultivated plants, e.g. crops. Also it is desirable to maintain the yield of crops with lower fertilizer input and/or higher yield on soils of similar or even poorer quality.

Enhanced NUE of the plant can be determined and quantified according to the following method:

Transformed plants are grown in pots in a growth chamber (Svalöf Weibull, Svalöv, Sweden). In case the plants are *Arabidopsis thaliana* seeds thereof are sown in pots containing a 1:1 (v:v) mixture of nutrient depleted soil ("Einheitserde Typ 0", 30% clay, Tantau, Wansdorf Germany) and sand. Germination is induced by a four day period at 4° C., in the dark. Subsequently the plants are grown under standard growth conditions. In case the plants are *Arabidopsis thaliana*, the standard growth conditions are: photoperiod of 16 h light and 8 h dark, 20° C., 60% relative humidity, and a photon flux density of 200 μE. In case the plants are *Arabidopsis thaliana* they are watered every second day with a N-depleted nutrient solution. After 9 to 10 days the plants are individualized. After a total time of 29 to 31 days the plants are harvested and rated by the fresh weight of the aerial parts of the plants, preferably the rosettes.

In a further embodiment, the tolerance to drought is determined according to the method described in the examples.

Accordingly, in one embodiment, the present invention relates to a method for increasing the yield, comprising the following steps:

(a) measuring the N content in the soil, and
(b) determining, whether the N-content in the soil is optimal or suboptimal for the growth of an origin or wild type plant, e.g. a crop, and
(c1) growing the plant of the invention in said soil, if the N-content is suboptimal for the growth of the origin or wild type plant, or
(c2) growing the plant of the invention in the soil and comparing the yield with the yield of a standard, an origin or a wild type plant and selecting and growing the plant, which shows the highest yield, if the N-content is optimal for the origin or wild type plant.

In a further embodiment of the present invention, plant yield is increased by increasing the plant's stress tolerance(s).

Generally, the term "increased tolerance to stress" can be defined as survival of plants, and/or higher yield production, under stress conditions as compared to a non-transformed wild type or starting plant.

During its life-cycle, a plant is generally confronted with a diversity of environmental conditions. Any such conditions, which may, under certain circumstances, have an impact on plant yield, are herein referred to as "stress" condition. Environmental stresses may generally be divided into biotic and abiotic (environmental) stresses. Unfavorable nutrient conditions are sometimes also referred to as "environmental stress". The present invention does also contemplate solutions for this kind of environmental stress, e.g. referring to increased nutrient use efficiency. In a further embodiment of the present invention, plant yield is increased by increasing the abiotic stress tolerance(s) of a plant or a part thereof.

For the purposes of the description of the present invention, the terms "enhanced tolerance to abiotic stress", "enhanced resistance to abiotic environmental stress", "enhanced tolerance to environmental stress", "improved adaptation to environmental stress" and other variations and expressions similar in its meaning are used interchangeably and refer, without limitation, to an improvement in tolerance to one or more abiotic environmental stress(es) as described herein and as compared to a corresponding origin or wild type plant or a part thereof.

The term abiotic stress tolerance(s) refers for example low temperature tolerance, drought tolerance, heat tolerance, salt stress tolerance and others.

Stress tolerance in plants like low temperature, drought, heat and salt stress tolerance can have a common theme important for plant growth, namely the availability of water. Plants are typically exposed during their life cycle to conditions of reduced environmental water content. The protection strategies are similar to those of chilling tolerance.

Accordingly, in one embodiment of the present invention, said yield-related trait relates to an increased water use efficiency of the plant of the invention and/or an increased tolerance to drought conditions of the plant of the invention.

In one embodiment of the present invention drought stress means any environmental stress which leads to a lack of water in plants or reduction of water supply to plants, including a secondary stress by low temperature and/or salt, and/or a primary stress during drought or heat, e.g. desiccation etc.

Increased tolerance to drought conditions can be determined and quantified according to the following method.

Transformed plants are grown individually in pots in a growth chamber (York Industriekälte GmbH, Mannheim, Germany). Germination is induced. In case the plants are *Arabidopsis thaliana* sown seeds are kept at 4° C., in the dark, for 3 days in order to induce germination. Subsequently conditions are changed for 3 days to 20° C./6° C. day/night temperature with a 16/8 h day-night cycle at 150 µE/m²s. Subsequently the plants are grown under standard growth conditions. In case the plants are *Arabidopsis thaliana*, the standard growth conditions are: photoperiod of 16 h light and 8 h dark, 20° C., 60% relative humidity, and a photon flux density of 200 µE. Plants are grown and cultured until they develop leaves. In case the plants are *Arabidopsis thaliana* they are watered daily until they were approximately 3 weeks old. Starting at that time drought was imposed by withholding water. After the non-transformed wild type plants show visual symptoms of injury, the evaluation starts and plants are scored for symptoms of drought symptoms and biomass production comparison to wild type and neighboring plants for 5-6 days in succession.

In a further embodiment, the tolerance to drought, e.g. the tolerance to cycling drought is determined according to the method described in the examples.

In a preferred embodiment, the tolerance to drought is a tolerance to cycling drought.

Accordingly, in one embodiment, the present invention relates to a method for increasing the yield, comprising the following steps:
(a) determining, whether the water supply in the area for planting is optimal or suboptimal for the growth of an origin or wild type plant, e.g. a crop, and/or determining the visual symptoms of injury of plants growing in the area for planting; and
(b1) growing the plant of the invention in said soil, if the water supply is suboptimal for the growth of an origin or wild type plant or visual symptoms for drought can be found at a standard, origin or wild type plant growing in the area; or
(b2) growing the plant of the invention in the soil and comparing the yield with the yield of a standard, an origin or a wild type plant and selecting and growing the plant, which shows the highest yield, if the water supply is optimal for the origin or wild type plant.

Visual symptoms of injury stating for one or any combination of two, three or more of the following features:
a) wilting
b) leaf browning
c) loss of turgor, which results in drooping of leaves or needles stems, and flowers,
d) drooping and/or shedding of leaves or needles,
e) the leaves are green but leaf angled slightly toward the ground compared with controls,
f) leaf blades begun to fold (curl) inward,
g) premature senescence of leaves or needles,
h) loss of chlorophyll in leaves or needles and/or yellowing.

In a further embodiment of the present invention, said yield-related trait of the plant of the invention is an increased tolerance to heat conditions of said plant.

In another embodiment of the present invention, said yield-related trait of the plant of the invention is an increased low temperature tolerance of said plant, e.g. comprising freezing tolerance and/or chilling tolerance.

Low temperatures impinge on a plethora of biological processes. They retard or inhibit almost all metabolic and cellular processes The response of plants to low temperature is an important determinant of their ecological range. The problem of coping with low temperatures is exacerbated by the need to prolong the growing season beyond the short summer found at high latitudes or altitudes.

Most plants have evolved adaptive strategies to protect themselves against low temperatures. Generally, adaptation to low temperature may be divided into chilling tolerance, and freezing tolerance.

Chilling tolerance is naturally found in species from temperate or boreal zones and allows survival and an enhanced growth at low but non-freezing temperatures. Species from tropical or subtropical zones are chilling sensitive and often show wilting, chlorosis or necrosis, slowed growth and even death at temperatures around 10° C. during one or more stages of development. Accordingly, improved or enhanced "chilling tolerance" or variations thereof refers herein to improved adaptation to low but non-freezing temperatures around 10° C., preferably temperatures between 1 to 18° C., more preferably 4-14° C., and most preferred 8 to 12° C.; hereinafter called "chilling temperature".

Freezing tolerance allows survival at near zero to particularly subzero temperatures. It is believed to be promoted by a process termed cold-acclimation which occurs at low but non-freezing temperatures and provides increased freezing tolerance at subzero temperatures. In addition, most species from temperate regions have life cycles that are adapted to seasonal changes of the temperature. For those plants, low temperatures may also play an important role in plant development through the process of stratification and vernalisation. It becomes obvious that a clear-cut distinction between or definition of chilling tolerance and freezing tolerance is difficult and that the processes may be overlapping or interconnected.

Improved or enhanced "freezing tolerance" or variations thereof refers herein to improved adaptation to temperatures near or below zero, namely preferably temperatures below 4° C., more preferably below 3 or 2° C., and particularly preferred at or below 0 (zero) ° C. or below −4° C., or even extremely low temperatures down to −10° C. or lower; hereinafter called "freezing temperature.

"Improved adaptation" to environmental stress like e.g. freezing and/or chilling temperatures refers herein to an improved plant performance resulting in an increased yield, particularly with regard to one or more of the yield related traits as defined in more detail above.

Accordingly, the plant of the invention may in one embodiment show an early seedling growth after exposure to low temperatures to an chilling-sensitive wild type or origin, improving in a further embodiment seed germination rates. The process of seed germination strongly depends on environmental temperature and the properties of the seeds determine the level of activity and performance during germination and seedling emergence when being exposed to low temperature. The method of the invention further provides in one embodiment a plant which show under chilling condition an reduced delay of leaf development.

In one embodiment the method of the invention relates to a production of a tolerant major crop, e.g. corn (maize), bean, rice, soy bean, cotton, tomato, banana, cucumber or potato because most major crops are chilling-sensitive.

Enhanced tolerance to low temperature may, for example, be determined according to the following method:

Transformed plants are grown in pots in a growth chamber (e.g. York, Mannheim, Germany). In case the plants are *Arabidopsis thaliana* seeds thereof are sown in pots containing a 3.5:1 (v:v) mixture of nutrient rich soil (GS90, Tantau, Wansdorf, Germany) and sand. Plants are grown under standard growth conditions. In case the plants are *Arabidopsis*

*thaliana*, the standard growth conditions are: photoperiod of 16 h light and 8 h dark, 20° C., 60% relative humidity, and a photon flux density of 200 μmol/m²s. Plants are grown and cultured. In case the plants are *Arabidopsis thaliana* they are watered every second day. After 9 to 10 days the plants are individualized. Cold (e.g. chilling at 11-12° C.) is applied 14 days after sowing until the end of the experiment. After a total growth period of 29 to 31 days the plants are harvested and rated by the fresh weight of the aerial parts of the plants, in the case of *Arabidopsis* preferably the rosettes.

Accordingly, in one embodiment, the present invention relates to a method for increasing yield, comprising the following steps:
(a) determining, whether the temperature in the area for planting is optimal or suboptimal for the growth of an origin or wild type plant, e.g. a crop; and
(b1) growing the plant of the invention in said soil; if the temperature is suboptimal low for the growth of an origin or wild type plant growing in the area; or
(b2) growing the plant of the invention in the soil and comparing the yield with the yield of a standard, an origin or a wild type plant and selecting and growing the plant, which shows the highest yield, if the temperature is optimal for the origin or wild type plant;

In a further embodiment of the present invention, yield-related trait may also be increased salinity tolerance (salt tolerance), tolerance to osmotic stress, increased shade tolerance, increased tolerance to a high plant density, increased tolerance to mechanical stresses, and/or increased tolerance to oxidative stress.

Accordingly, in one embodiment of the present invention, yield is increased by improving one or more of the yield-related traits as defined herein.

Thus, the present invention provides a method for producing a transgenic plant showing an increased yield-related trait as compared to a corresponding origin or wild type plant, by increasing or generating one or more activities ("activities") selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein.

Thus, in one embodiment, the present invention provides a method for producing a plant showing an increased stress resistance, particularly abiotic stress resistance, as compared to a corresponding origin or wild type plant, by increasing or generating one or more said activities. In another embodiment, the abiotic stress resistance achieved in accordance with the methods of the present invention, and shown by the transgenic plant of the invention; is increased low temperature tolerance, particularly increased tolerance to chilling. In another embodiment, the abiotic stress resistance achieved in accordance with the methods of the present invention, and shown by the transgenic plant of the invention; is increased drought tolerance, particularly increased tolerance to cycling drought.

In another embodiment, the present invention provides a method for producing a plant; showing an increased intrinsic yield, as compared to a corresponding origin or wild type plant, by increasing or generating one or more said activities.

In another embodiment, the present invention provides a method for producing a plant; showing an increased nutrient use efficiency, as compared to a corresponding origin or wild type plant, by increasing or generating one or more said activities. In another embodiment, the nutrient use efficiency achieved in accordance with the methods of the present invention, and shown by the transgenic plant of the invention; is increased nitrogen use efficiency.

Thus, in one further embodiment of the present invention, a method is provided for producing a transgenic plant; progenies, seeds, and/or pollen derived from such plant; each showing an increased an increased low temperature tolerance, particularly chilling tolerance, as compared to a corresponding, e.g. non-transformed, wild type plant cell or plant, by increasing or generating one or more of said activities.

Thus, in one further embodiment of the present invention, a method is provided for producing a transgenic plant; progenies, seeds, and/or pollen derived from such plant; each showing an increased an increased low temperature tolerance as well as nitrogen use efficiency (NUE) and/or increased intrinsic yield and/or cycling drought tolerance, particularly chilling tolerance, and draught tolerance as compared to a corresponding, e.g. non-transformed, wild type plant cell or plant, by increasing or generating one or more of said activities.

Thus, in one further embodiment of the present invention, a method is provided for producing a transgenic plant; progenies, seeds, and/or pollen derived from such plant; each showing an increased an increased low temperature tolerance as well as nitrogen use efficiency (NUE) and increased cycling drought tolerance or increased intrinsic yield, particularly chilling tolerance, and draught tolerance and increase biomass as compared to a corresponding, e.g. non-transformed, wild type plant cell or plant, by increasing or generating one or more of said activities.

Thus, in one further embodiment of the present invention, a method is provided for producing a transgenic plant; progenies, seeds, and/or pollen derived from such plant; each showing an increased an increased low temperature tolerance as well as nitrogen use efficiency (NUE) or increased cycling drought tolerance and increased intrinsic yield, particularly chilling tolerance, and draught tolerance and increase biomass as compared to a corresponding, e.g. non-transformed, wild type plant cell or plant, by increasing or generating one or more of said activities.

Thus, in one further embodiment of the present invention, a method is provided for producing a transgenic plant; progenies, seeds, and/or pollen derived from such plant; each showing an increased low temperature tolerance as well as nitrogen use efficiency (NUE) and increased cycling drought tolerance and increased intrinsic yield, particularly chilling tolerance, and draught tolerance and increase biomass as compared to a corresponding, e.g. non-transformed, wild type plant cell or plant, by increasing or generating one or more of said activities.

Furthermore, in one embodiment, the present invention provides a transgenic plant showing one or more increased yield-related trait as compared to a corresponding, e.g. non-transformed, origin or wild type plant cell or plant, by increasing or generating one or more activities selected from the above mentioned group of activities.

Further, the present invention relates to method for producing a plant with increased yield as compared to a corresponding wild type plant comprising at least one of the steps selected from the group consisting of:
(i) increasing or generating the activity of a polypeptide comprising a polypeptide, a consensus sequence or at least one polypeptide motif as depicted in column 5 or 7 of table II or of table IV, respectively;
(ii) increasing or generating the activity of an expression product of a nucleic acid molecule comprising a polynucleotide as depicted in column 5 or 7 of table I, and
(iii) increasing or generating the activity of a functional equivalent of (i) or (ii).

In one embodiment, the increase or generation of said one or more activities is conferred by one or more nucleic acid sequences comprising a polynucleotide selected from the group as shown in table I, column 5 or 7. Accordingly, the increase or generation of said one or more activities is for example conferred by one or more expression products of said nucleic acid molecule, e.g. proteins. Accordingly, in the present invention described above, the increase or generation of said one or more activities is for example conferred by one or more protein(s) each comprising a polypeptide selected from the group as depicted in table II, column 5 and 7.

For the purposes of the description of the present invention, the proteins having an activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein, protein(s) comprising a polypeptide encoded by one or more nucleic acid sequences as shown in table I, column 5 or 7, or protein(s) comprising a polypeptide as depicted in table II, column 5 and 7, are also referred to as "Yield Related Proteins" or "YRPs".

Accordingly, the genes of the present invention or used in accordance with the present invention which encode a protein having an activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein, which encode a protein comprising a polypeptide encoded for by a nucleic acid sequence as shown in table I, column 5 or 7, and/or which encode a protein comprising a polypeptide as depicted in table II, column 5 and 7, are also referred to as "YRP encoding genes".

Thus, in one embodiment, the present invention provides a method for producing a plant showing increased yield as compared to a corresponding origin or wild type plant, by increasing or generating one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein, which is conferred by one or more nucleic acid sequences comprising a polynucleotide selected from the group as shown in table I, column 5 or 7 or by one or more proteins each comprising a polypeptide encoded by one or more nucleic acid sequences selected from the group as shown in table I, column 5 or 7. or by one or more protein(s) each comprising a polypeptide selected from the group as depicted in table II, column 5 and 7. As mentioned, the increase yield can be mediated by one or more yield-related traits. Thus, the method of the invention relates to the production of a plant showing said one or more yield-related traits.

Thus, the present invention provides a method for producing a plant showing an increased nutrient use efficiency, e.g. nitrogen use efficiency (NUE), increased stress resistance particularly abiotic stress resistance, increased nutrient use efficiency, increased water use efficiency, and/or an increased stress resistance, particularly abiotic stress resistance, particular low temperature tolerance or draught tolerance or an increased intrinsic yield.

In one embodiment, said activity selected from the group consisting of: (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein is increased by increasing the amount and/or specific activity of one or more proteins having said activity, e.g. or of one of more polypeptides as depicted in table II, column 5 and 7.

Further, he present invention relates to a method for producing a plant with increased yield as compared to a corresponding origin or wild type transgenic plant, which comprises (a) increasing or generating, in a plant cell nucleus, a plant cell, a plant or a part thereof, one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein; and (b) cultivating or growing the plant cell, the plant or the part thereof under conditions which permit the development of the plant cell, the plant or the part thereof; and (c) recovering a plant showing increased yield as compared to a corresponding, e.g. non-transformed, origin or wild type plant;

(d) and optionally, selecting the plant or a part thereof, showing increased yield, preferably improved nutrient use efficiency and/or abiotic stress resistance, as compared to a corresponding, e.g. non-transformed, wild type plant cell, a transgenic plant or a part thereof which shows visual symptoms of deficiency and/or death.

Furthermore, the present invention also relates to a method for the identification of a plant with an increased yield comprising screening a population of one or more plant cell nuclei, plant cells, plant tissues or plants or parts thereof for an activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein, comparing the level of activity with the activity level in a reference; identifying one or more plant cell nuclei, plant cells, plant tissues or plants or parts thereof with the activity increased compared to the reference, optionally producing a plant from the identified plant cell nuclei, cell or tissue.

In one further embodiment, the present invention also relates to a method for the identification of a plant with an increased yield comprising screening a population of one or more plant cell nuclei, plant cells, plant tissues or plants or parts thereof for the expression level of an nucleic acid coding for an polypeptide conferring an activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein, comparing the level of expression with a reference; identifying one or more plant cell nuclei, plant cells, plant tissues or plants or parts thereof with the expression level increased compared to the reference, optionally producing a plant from the identified plant cell nuclei, cell or tissue.

In another embodiment, the present invention relates to a method for increasing yield of a population of plants, comprising checking the growth temperature(s) in the area for planting, comparing the temperatures with the optimal growth temperature of a plant species or a variety considered for planting, planting and growing the plant of the invention if the growth temperature is not optimal for the planting and growing of the plant species or the variety considered for planting. The method can be repeated in parts or in whole once or more.

In one embodiment, it was an object of the present invention to develop a process for improving the adaptation to environmental stress, particularly adaptation to low temperature, i.e. enhancing the tolerance to low temperature comprising but not limited to enhancing chilling tolerance and/or freezing tolerance, in a photosynthetic active organism, which are reflected alone or altogether in such increased abiotic stress adaptation and/or a process for an increased yield under conditions of abiotic stress, particularly low temperature.

It was found that this object is achieved by providing a process according to the present invention described herein.

It was further an object of the present invention to provide a plant cell and/or a plant with enhanced tolerance to abiotic environmental stress, particularly low temperature, and/or showing under conditions of abiotic environmental stress like low temperature an increased yield, as compared to a corresponding, e.g. non-transformed, wild type or starting plant cell and/or plant.

It was found that this object is achieved by providing a plant cell and/or plant according to the present invention described herein.

In one embodiment of the present invention, these traits are achieved by a process for an enhanced tolerance to abiotic environmental stress in a photosynthetic active organism, preferably a plant, as compared to a corresponding (non-transformed) wild type or starting photosynthetic active organism.

"Improved adaptation" to environmental stress like e.g. freezing and/or chilling temperatures refers to an improved plant performance.

Accordingly, for the purposes of the description of the present invention, the term "low temperature" with respect to low temperature stress on a photosynthetic active organism, preferably a plant and most preferred a crop plant, refers to any of the low temperature conditions as described above, preferably chilling and/or freezing temperatures as defined above, as the context requires.

In a further embodiment, "enhanced tolerance to abiotic environmental stress" in a photosynthetic active organism means that the photosynthetic active organism, preferably a plant, when confronted with abiotic environmental stress conditions as mentioned above, e.g. like low temperature conditions including chilling and freezing temperatures or drought, exhibits an enhanced yield, e.g. a yield as mentioned above, e.g. a seed yield or biomass yield, as compared to a corresponding (non-transformed) wild type or starting photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced dry biomass yield as compared to a corresponding, e.g. non-transformed, wild type photosynthetic active organism. In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced aerial dry biomass yield as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced underground dry biomass yield as compared to a corresponding, e.g. non-transformed, wild type photosynthetic active organism.

In another embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced fresh weight biomass yield as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced aerial fresh weight biomass yield as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced underground fresh weight biomass yield as compared to a corresponding, e.g. non-transformed, wild type photosynthetic active organism.

In another embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of harvestable parts of a plant as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of dry harvestable parts of a plant as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of dry aerial harvestable parts of a plant as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of underground dry harvestable parts of a plant as compared to a corresponding, e.g. non-transformed, wild type photosynthetic active organism.

In another embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of fresh weight harvestable parts of a plant as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of aerial fresh weight harvestable parts of a plant as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of underground fresh weight harvestable parts of a plant as compared to a corresponding, e.g. non-transformed, wild type photosynthetic active organism.

In a further embodiment, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of the crop fruit as compared to a corresponding, e.g.

non-transformed, wild type photosynthetic active organism. In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of the fresh crop fruit as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of the dry crop fruit as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced grain dry weight as compared to a corresponding, e.g. non-transformed, wild type photosynthetic active organism. In a further embodiment, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of seeds as compared to a corresponding, e.g. non-transformed, wild type photosynthetic active organism. In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of fresh weight seeds as compared to a corresponding, e.g. non-transformed, wild type photosynthetic active organism.

In an embodiment thereof, the term "enhanced tolerance to abiotic environmental stress" in a photosynthetic active organism means that the photosynthetic active organism, preferably a plant, when confronted with abiotic environmental stress conditions like low temperature conditions including chilling and freezing temperatures, exhibits an enhanced yield of dry seeds as compared to a corresponding, e.g. non-transformed, wild type photosynthetic active organism.

In another embodiment of the present invention, these traits are achieved by a process for an increased yield under conditions of environmental stress, particularly abiotic environmental stress, in a photosynthetic active organism, preferably a plant, as compared to a corresponding (non-transformed) wild type or starting photosynthetic active organism. In one embodiment thereof, the term "increased yield" means that the photosynthetic active organism, especially a plant, exhibits an increased yield, e.g. exhibits an increased growth rate, under conditions of abiotic environmental stress, compared to the corresponding wild-type photosynthetic active organism.

An increased growth rate may be reflected inter alia by or confers an increased biomass production of the whole plant, or an increased biomass production of the aerial parts of a plant, or by an increased biomass production of the underground parts of a plant, or by an increased biomass production of parts of a plant, like stems, leaves, blossoms, fruits, and/or seeds.

In an embodiment thereof, increased yield includes higher fruit yields, higher seed yields, higher fresh matter production, and/or higher dry matter production.

In another embodiment thereof, the term "increased yield" means that the photosynthetic active organism, preferably plant, exhibits an prolonged growth under conditions of abiotic environmental stress, as compared to the corresponding, e.g. non-transformed, wild type photosynthetic active organism. A prolonged growth comprises survival and/or continued growth of the photosynthetic active organism, preferably plant, at the moment when the non-transformed wild type photosynthetic active organism shows visual symptoms of deficiency and/or death.

Accordingly, in a preferred embodiment, the present invention provides a method for producing a transgenic plant cell with increased yield, e.g. tolerance to abiotic environmental stress and/or another increased yield-related trait, as compared to a corresponding, e.g. non-transformed, wild type plant cell by increasing or generating one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein.

In one embodiment of the invention the proteins having an activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein and the polypeptides as depicted in table II, column 5 and 7 are named "LTRRP" or "Yield Related Proteins" ("YRPs"). Both terms shall have the same meaning and are interchangeable.

In another preferred embodiment a photosynthetic active organism, especially a plant, shows increased yield under conditions of abiotic environmental stress, e.g. a plant, shows an enhanced tolerance to abiotic environmental stress or another yield-related trait.

In another embodiment this invention fulfills the need to identify new, unique genes capable of conferring increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait, to photosynthetic active organism, preferably plants, upon expression or over-expression of endogenous and/or exogenous genes.

In another embodiment thereof this invention fulfills the need to identify new, unique genes capable of conferring increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait, to photosynthetic active organism, preferably plants, upon expression or over-expression of endogenous genes.

In another embodiment thereof this invention fulfills the need to identify new, unique genes capable of conferring increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait, to photosynthetic active organism, preferably plants, upon expression or over-expression of exogenous genes.

In another embodiment this invention fulfills the need to identify new, unique genes capable of conferring an enhanced tolerance to abiotic environmental stress in combination with an increase of yield to photosynthetic active organism, preferably plants, upon expression or over-expression of endogenous and/or exogenous genes.

Accordingly, the present invention relates to a method for producing a for example transgenic photosynthetic active organism or a part thereof, or a plant cell, a plant or a part thereof e.g. for the generation of such a plant, with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding for example non-transformed wild type photosynthetic active organism or a part thereof, or a plant cell, a plant or a part thereof, which comprises (a) increasing or generating one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein in a photosynthetic active organism or a part thereof, e.g. a plant cell, a plant or a part thereof, and (b) growing the photosynthetic active organism or a part thereof, e.g. a plant cell, a plant or a part thereof under conditions which permit the development of a photosynthetic active organism or a part thereof, preferably a plant cell, a plant or a part thereof, with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type photosynthetic active organism or a part thereof, preferably a plant cell, a plant or a part thereof.

In an further embodiment, the present invention relates to a method for producing a transgenic plant cell nucleus, a transgenic plant cell, a transgenic plant or a part thereof, resulting in increased yield as compared to a corresponding non-transformed wild type plant cell, a transgenic plant or a part thereof, which comprises (a) increasing or generating, in said plant cell nucleus, plant cell, plant or part thereof, one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein;

(b) growing a plant cell, a plant or a part thereof under conditions, preferably in presence or absence of nutrient deficiency and/or abiotic stress, which permits the development of a plant cell, a plant or a part thereof, showing increased yield as compared to a corresponding non-transformed wild type plant cell, a transgenic plant or a part thereto, and (c) selecting the plant cell, a plant or a part thereof, showing increased yield, preferably improved nutrient use efficiency and/or abiotic stress resistance, as compared to a corresponding non-transformed wild type plant cell, a transgenic plant or a part thereof which shows visual symptoms of deficiency and/or death under said conditions.

In an embodiment the present invention relates to a method for producing a, e.g. transgenic, photosynthetic active organism or a part thereof, preferably a plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding e.g. non-transformed wild type photosynthetic active organism or a part thereof, preferably a plant cell, a plant or a part thereof, which comprises (a) increasing or generating one or more activities selected from the group consisting of: (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein in a photosynthetic active organism or a part thereof, preferably a plant cell, a plant or a part thereof, (b) growing the photosynthetic active organism or a part thereof, preferably a plant cell, a plant or a part thereof together with e.g. non-transformed wild type photosynthetic active organism or a part thereof, preferably a plant, e.g. under conditions of abiotic environmental stress (c) selecting the photosynthetic active organism or a part thereof, preferably a plant cell, a plant or a part thereof, with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait, as compared to a corresponding, e.g. non-transformed, wild type photosynthetic active organism or a part thereof, preferably a plant cell, a plant or a part thereof, after the, e.g. non-transformed, wild type photosynthetic active organism or a part thereof, preferably a plant cell, a plant or a part thereof, show visual symptoms of deficiency and/or death.

In one embodiment throughout the description abiotic environmental stress, refers to low temperature stress.

In one embodiment the present invention relates to a method for producing an, e.g. transgenic, photosynthetic active organism or a part thereof, preferably a plant cell, a plant or a part thereof, e.g. for the generation of said plant, with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type photosynthetic active organism or a part thereof, preferably a plant cell, a plant or a part thereof, which comprises (a) increasing or generating the activity of a protein as shown in table II, column 3 or encoded by the nucleic acid sequences as shown in table I, column 5, in photosynthetic active organism or a part thereof, preferably a plant cell nucleus, a plant cell, a plant or a part thereof, and (b) growing the photosynthetic active organism or a part thereof, preferably a plant cell, a plant or a part thereof under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type photosynthetic active organism or a part thereof, preferably a plant.

In one embodiment, said activity, e.g. the activity of said protein as shown in table II, column 3 or encoded by the nucleic acid sequences as shown in table I, column 5, is increased in the part of a cell as indicated in table II or table I in column 6.

The method of the invention comprises in one embodiment the following steps:

(i) increasing or generating of the expression of; and/or
(ii) increasing or generating the expression of an expression product; and/or
(iii) increasing or generating one or more activities of an expression product encoded by;

at least one nucleic acid molecule comprising a nucleic acid molecule selected from the group consisting of:

(a) a nucleic acid molecule encoding the polypeptide shown in column 5 or 7 of table II;
(b) a nucleic acid molecule shown in column 5 or 7 of table I;
(c) a nucleic acid molecule, which, as a result of the degeneracy of the genetic code, can be derived from a polypeptide sequence depicted in column 5 or 7 of table II and confers an increased yield as compared to a corresponding, e.g. non-transformed, wild type plant cell, a transgenic plant or a part thereof;
(d) a nucleic acid molecule having at least 30% identity with the nucleic acid molecule sequence of a polynucleotide comprising the nucleic acid molecule shown in column 5 or 7 of table I and confers an increased yield as compared to a corresponding, e.g. non-transformed, wild type plant cell, a transgenic plant or a part thereof;
(e) a nucleic acid molecule encoding a polypeptide having at least 30% identity with the amino acid sequence of the polypeptide encoded by the nucleic acid molecule of (a) to (c) and having the activity represented by a nucleic acid molecule comprising a polynucleotide as depicted in column 5 of table I and confers an increased yield as compared to a corresponding, e.g. non-transformed, wild type plant cell, a transgenic plant or a part thereof;
(f) a nucleic acid molecule which hybridizes with a nucleic acid molecule of (a) to (c) under stringent hybridization conditions and confers an increased yield as compared to a corresponding, e.g. non-transformed, wild type plant cell, a transgenic plant or a part thereof;
(g) a nucleic acid molecule encoding a polypeptide which can be isolated with the aid of monoclonal or polyclonal antibodies made against a polypeptide encoded by one of the nucleic acid molecules of (a) to (e) and having the activity represented by the nucleic acid molecule comprising a polynucleotide as depicted in column 5 of table I;
(h) a nucleic acid molecule encoding a polypeptide comprising the consensus sequence or one or more polypeptide motifs as shown in column 7 of table IV and preferably having the activity represented by a nucleic acid molecule comprising a polynucleotide as depicted in column 5 of table II or IV;
(i) a nucleic acid molecule encoding a polypeptide having the activity represented by a protein as depicted in column 5 of table II and conferring increased yield as compared to a corresponding, e.g. non-transformed, wild type plant cell, a transgenic plant or a part thereof;
(j) nucleic acid molecule which comprises a polynucleotide, which is obtained by amplifying a cDNA library or a genomic library using the primers in column 7 of table III and preferably having the activity represented by a nucleic acid molecule comprising a polynucleotide as depicted in column 5 of table II or IV; and
(k) a nucleic acid molecule which is obtainable by screening a suitable nucleic acid library under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt, or 500 nt, 1000 nt, 1500 nt, 2000 nt or 3000 nt of a nucleic acid molecule complementary to a nucleic acid molecule sequence characterized in (a) to (e) and encoding a polypeptide having the activity represented by a protein comprising a polypeptide as depicted in column 5 of table II.

Furthermore, the present invention relates to a method for producing a transgenic plant with increased yield as compared to a corresponding, e.g. non-transformed, wild type plant, transforming a plant cell or a plant cell nucleus or a plant tissue to produce such a plant, with a nucleic acid molecule comprising a nucleic acid molecule selected from the group consisting of:

(a) a nucleic acid molecule encoding the polypeptide shown in column 5 or 7 of table II;
(b) a nucleic acid molecule shown in column 5 or 7 of table I;
(c) a nucleic acid molecule, which, as a result of the degeneracy of the genetic code, can be derived from a polypeptide sequence depicted in column 5 or 7 of table II and confers an increased yield as compared to a corresponding, e.g. non-transformed, wild type plant cell, a transgenic plant or a part thereof;
(d) a nucleic acid molecule having at least 30% identity with the nucleic acid molecule sequence of a polynucleotide comprising the nucleic acid molecule shown in column 5 or 7 of table I and confers an increased yield as compared to a corresponding, e.g. non-transformed, wild type plant cell, a transgenic plant or a part thereof;
(e) a nucleic acid molecule encoding a polypeptide having at least around 30% identity with the amino acid sequence of the polypeptide encoded by the nucleic acid molecule of (a) to (c) and having the activity represented by a nucleic acid molecule comprising a polynucleotide as depicted in column 5 of table I and confers an increased yield as compared to a corresponding, e.g. non-transformed, wild type plant cell, a transgenic plant or a part thereof;
(f) a nucleic acid molecule which hybridizes with a nucleic acid molecule of (a) to (c) under stringent hybridization conditions and confers an increased yield as compared to a corresponding, e.g. non-transformed, wild type plant cell, a transgenic plant or a part thereof;

(g) a nucleic acid molecule encoding a polypeptide which can be isolated with the aid of monoclonal or polyclonal antibodies made against a polypeptide encoded by one of the nucleic acid molecules of (a) to (e) and having the activity represented by the nucleic acid molecule comprising a polynucleotide as depicted in column 5 of table I;

(h) a nucleic acid molecule encoding a polypeptide comprising the consensus sequence or one or more polypeptide motifs as shown in column 7 of table IV and preferably having the activity represented by a nucleic acid molecule comprising a polynucleotide as depicted in column 5 of table II or IV;

(i) a nucleic acid molecule encoding a polypeptide having the activity represented by a protein as depicted in column 5 of table II and conferring increased yield as compared to a corresponding, e.g. non-transformed, wild type plant cell, a transgenic plant or a part thereof;

(j) nucleic acid molecule which comprises a polynucleotide, which is obtained by amplifying a cDNA library or a genomic library using the primers in column 7 of table III and preferably having the activity represented by a nucleic acid molecule comprising a polynucleotide as depicted in column 5 of table II or IV; and (k) a nucleic acid molecule which is obtainable by screening a suitable nucleic acid library under stringent hybridization conditions with a probe comprising a complementary sequence of a nucleic acid molecule of (a) or (b) or with a fragment thereof, having at least 50 nt of a nucleic acid molecule complementary to a nucleic acid molecule sequence characterized in (a) to (e) and encoding a polypeptide having the activity represented by a protein comprising a polypeptide as depicted in column 5 of table II, and regenerating a transgenic plant from that transformed plant cell nucleus, plant cell or plant tissue with increased yield.

A modification, i.e. an increase, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable. Furthermore such an increase can be reached by the introduction of the inventive nucleic acid sequence or the encoded protein in the correct cell compartment for example into the nucleus or cytoplasmic respectively or into plastids either by transformation and/or targeting. For the purposes of the description of the present invention, the terms "cytoplasmic" and "non-targeted" shall indicate, that the nucleic acid of the invention is expressed without the addition of an non-natural transit peptide encoding sequence. A non-natural transit peptide encoding sequence is a sequence which is not a natural part of a nucleic acid of the invention, e.g. of the nucleic acids depicted in table I column 5 or 7, but is rather added by molecular manipulation steps as for example described in the example under "plastid targeted expression". Therefore the terms "cytoplasmic" and "non-targeted" shall not exclude a targeted localisation to any cell compartment for the products of the inventive nucleic acid sequences by their naturally occurring sequence properties within the background of the transgenic organism. The sub-cellular location of the mature polypeptide derived from the enclosed sequences can be predicted by a skilled person for the organism (plant) by using software tools like TargetP (Emanuelsson et al., (2000), Predicting sub-cellular localization of proteins based on their N-terminal amino acid sequence., J. Mol. Biol. 300, 1005-1016.), ChloroP (Emanuelsson et al. (1999), ChloroP, a neural network-based method for predicting chloroplast transit peptides and their cleavage sites., Protein Science, 8: 978-984.) or other predictive software tools (Emanuelsson et al. (2007), Locating proteins in the cell using TargetP, SignalP, and related tools., Nature Protocols 2, 953-971).

Accordingly, the present invention relates to a method for producing a, e.g. transgenic plant cell, a plant or a part thereof, with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a) increasing or generating one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein in an organelle, especially in the plastid of a plant cell, and (b) growing the plant cell under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant.

In one embodiment, an activity as disclosed herein as being conferred by a polypeptide shown in table II is increase or generated in the plastid, e.g. an organelle, if in column 6 of each table I the term "plastidic" is listed for said polypeptide.

In another embodiment the present invention relates to a method for producing an, e.g. transgenic, plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a) increasing or generating one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein in the cytoplasm of a plant cell, and (b) growing the plant cell under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant.

In one embodiment, an activity as disclosed herein as being conferred by a polypeptide shown in table II is increase or generated in the cytoplasm, if in column 6 of each table I the term "cytoplasmic" is listed for said polypeptide.

In one embodiment, the activity of SLR1348 as disclosed herein as being conferred by a polypeptide shown in table II, as hit 44 is increase or generated in the mitochondria.

In one embodiment the present invention relates to a method for producing an e.g. transgenic, plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a) increasing or generating the activity of a protein as shown in table II, column 3 encoded by the nucleic acid sequences as shown in table I, column 5 or 7, in the cellular compartment as indicated in column 6 of said tables, and (b) growing the plant cell under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant.

In one embodiment the present invention relates to a method for producing an e.g. transgenic, plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a) increasing or generating the activity of a protein as shown in table II, column 3 encoded by the nucleic acid sequences as shown in table I, column 5 or 7, in an organelle, especially in the plastid of a plant cell, and (b) growing the plant cell under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant.

In one embodiment, an activity of polypeptide shown in table II is increase or generated in the plastid, if in column 6 of table I the term "plastid" is listed for said polypeptide.

In one embodiment the present invention relates to a method for producing a, e.g. transgenic, plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a) increasing or generating the activity of a protein as shown in table II, column 3 encoded by the nucleic acid sequences as shown in table I, column 5 or 7, in the cytoplasm of a plant cell, and (b) growing the plant cell under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant.

In one embodiment, an activity of polypeptide shown in table II is increase or generated in the cytoplasm, if in column 6 of table I the term "cytoplasm" is listed for said polypeptide. In one embodiment, an activity of polypeptide shown in table II is increase or generated in the cytoplasm and other compartments, e.g. plastids and/or mitochondria, of a plant cell, if in column 6 of table I the term "cytoplasm" is listed for said polypeptide.

In one embodiment the present invention relates to a method for producing a, e.g. transgenic, plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a) increasing or generating the activity of a protein as shown in table II, column 3 encoded by the nucleic acid sequences as shown in table I, column 5 or 7, in the mitochondria of a plant cell, and (b) growing the plant cell under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant.

In one embodiment, an activity of polypeptide shown in table II is increase or generated in the mitochondria, if in column 6 of table I the term "mitochondria" is listed for said polypeptide.

In another embodiment the present invention is related to a method for producing an e.g. transgenic, plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a1) increasing or generating one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer75w-a-protein, yhr213w-a-protein, YML079W-protein, YMR157C-protein, YNL024C-protein, and YNR040W-protein in an organelle of a plant cell, or (a2) increasing or generating the activity of a protein as shown in table II, column 3 encoded by the nucleic acid sequences as shown in table I, column 5 or 7, which are joined to a nucleic acid sequence encoding a transit peptide in a plant cell; or (a3) increasing or generating the activity of a protein as shown in table II, column 3 encoded by the nucleic acid sequences as shown in table I, column 5 or 7, which are joined to a nucleic acid sequence encoding an organelle localization sequence, especially a chloroplast localization sequence, in a plant cell, and (b) growing the plant cell under conditions which permit the development of a plant with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant.

In another embodiment, the present invention relates to a method for producing a transgenic plant cell, a plant or a part thereof with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, a plant or a part thereof, which comprises (a1) increasing or generating the activity of a protein as shown in table II, column 3 encoded by the nucleic acid sequences as shown in table I, column 5 or 7, in an organelle of a plant through the transformation of the organelle, or (a2) increasing or generating the activity of a protein as shown in table II, column 3 encoded by the nucleic acid sequences as shown in table I, column 5 or 7 in the plastid of a plant, or in one or more parts thereof through the transformation of the plastids;

and (b) growing the plant cell under conditions which permit the development of a plant with enhanced tolerance to abiotic environmental stress and/or increased yield as compared to a corresponding, e.g. non-transformed, wild type plant.

Consequently, the present invention also refers to a method for producing a plant with increased yield, e.g. based on an increased or improved yield-related trait, as compared to a corresponding wild type plant comprising at least one of the steps selected from the group consisting of:

(i) increasing or generating the activity of a polypeptide comprising a polypeptide, a consensus sequence or at least one polypeptide motif as depicted in column 5 or 7 of table II or of table IV, respectively;
(ii) increasing or generating the activity of an expression product of a nucleic acid molecule comprising a polynucleotide as depicted in column 5 or 7 of table I, and
(iii) increasing or generating the activity of a functional equivalent of (i) or (ii).

In principle the nucleic acid sequence encoding a transit peptide can be isolated from every organism such as microorganisms such as algae or plants containing plastids preferably chloroplasts. A "transit peptide" is an amino acid sequence, whose encoding nucleic acid sequence is translated together with the corresponding structural gene. That means the transit peptide is an integral part of the translated protein and forms an amino terminal extension of the protein. Both are translated as so called "pre-protein". In general the transit peptide is cleaved off from the pre-protein during or just after import of the protein into the correct cell organelle such as a plastid to yield the mature protein. The transit peptide ensures correct localization of the mature protein by facilitating the transport of proteins through intracellular membranes.

Nucleic acid sequences encoding a transit peptide can be derived from a nucleic acid sequence encoding a protein finally resided in the plastid and stemming from an organism selected from the group consisting of the genera *Acetabularia, Arabidopsis, Brassica, Capsicum, Chlamydomonas, Cururbita, Dunaliella, Euglena, Flaveria, Glycine, Helianthus, Hordeum, Lemna, Lolium, Lycopersion, Malus, Medicago, Mesembryanthemum, Nicotiana, Oenotherea, Oryza, Petunia, Phaseolus, Physcomitrella, Pinus, Pisum, Raphanus, Silene, Sinapis, Solanum, Spinacea, Stevia, Synechococcus, Triticum* and *Zea*.

For example, such transit peptides, which are beneficially used in the inventive process, are derived from the nucleic acid sequence encoding a protein selected from the group consisting of ribulose bisphosphate carboxylase/oxygenase, 5-enolpyruvyl-shikimate-3-phosphate synthase, acetolactate synthase, chloroplast ribosomal protein CS17, Cs protein, ferredoxin, plastocyanin, ribulose bisphosphate carboxylase activase, tryptophan synthase, acyl carrier protein, plastid chaperonin-60, cytochrome $c_{552}$, 22-kDA heat shock protein, 33-kDa Oxygen-evolving enhancer protein 1, ATP synthase γ subunit, ATP synthase δ subunit, chlorophyll-a/b-binding proteinII-1, Oxygen-evolving enhancer protein 2, Oxygen-evolving enhancer protein 3, photosystem I: P21, photosystem I: P28, photosystem I: P30, photosystem I: P35, photosystem I: P37, glycerol-3-phosphate acyltransferases, chlorophyll a/b binding protein, CAB2 protein, hydroxymethyl-bilane synthase, pyruvate-orthophosphate dikinase, CAB3 protein, plastid ferritin, ferritin, early light-inducible protein, glutamate-1-semialdehyde aminotransferase, protochlorophyllide reductase, starch-granule-bound amylase synthase, light-harvesting chlorophyll a/b-binding protein of photosystem II, major pollen allergen Lol p 5a, plastid ClpB ATP-dependent protease, superoxide dismutase, ferredoxin NADP oxidoreductase, 28-kDa ribonucleoprotein, 31-kDa ribonucleoprotein, 33-kDa ribonucleoprotein, acetolactate synthase, ATP synthase $CF_0$ subunit 1, ATP synthase $CF_0$ subunit 2, ATP synthase $CF_0$ subunit 3, ATP synthase $CF_0$ subunit 4, cytochrome f, ADP-glucose pyrophosphorylase, glutamine synthase, glutamine synthase 2, carbonic anhydrase, GapA protein, heat-shock-protein hsp21, phosphate translocator, plastid ClpA ATP-dependent protease, plastid ribosomal protein CL24, plastid ribosomal protein CL9, plastid ribosomal protein PsCL18, plastid ribosomal protein PsCL25, DAHP synthase, starch phosphorylase, root acyl carrier protein II, betaine-aldehyde dehydrogenase, GapB protein, glutamine synthetase 2, phosphoribulokinase, nitrite reductase, ribosomal protein L12, ribosomal protein L13, ribosomal protein L21, ribosomal protein L35, ribosomal protein L40, triose phosphate-3-phosphoglyerate-phosphate translocator, ferredoxin-dependent glutamate synthase, glyceraldehyde-3-phosphate dehydrogenase, NADP-dependent malic enzyme and NADP-malate dehydrogenase.

In one embodiment the nucleic acid sequence encoding a transit peptide is derived from a nucleic acid sequence encoding a protein finally resided in the plastid and stemming from an organism selected from the group consisting of the species *Acetabularia mediterranea, Arabidopsis thaliana, Brassica campestris, Brassica napus, Capsicum annuum, Chlamydomonas reinhardtii, Cururbita moschata, Dunaliella salina, Dunaliella tertiolecta, Euglena gracilis, Flaveria trinervia, Glycine max, Helianthus annuus, Hordeum vulgare, Lemna gibba, Lolium perenne, Lycopersion esculentum, Malus domestica, Medicago falcata, Medicago sativa, Mesembryanthemum crystallinum, Nicotiana plumbaginifolia, Nicotiana sylvestris, Nicotiana tabacum, Oenotherea hookeri, Oryza sativa, Petunia hybrida, Phaseolus vulgaris, Physcomitrella patens, Pinus tunbergii, Pisum sativum, Raphanus sativus, Silene pratensis, Sinapis alba, Solanum tuberosum, Spinacea oleracea, Stevia rebaudiana, Synechococcus, Synechocystis, Triticum aestivum* and *Zea mays*.

Nucleic acid sequences are encoding transit peptides are disclosed by von Heijne et al. (Plant Molecular Biology Reporter, 9 (2), 104, (1991)), which are hereby incorporated by reference. Table V shows some examples of the transit peptide sequences disclosed by von Heijne et al.

According to the disclosure of the invention especially in the examples the skilled worker is able to link other nucleic acid sequences disclosed by von Heijne et al. to the nucleic acid sequences shown in table I, columns 5 and 7, e.g. for the nucleic acid molecules for which in column 6 of table I the term "plastidic" is indicated.

Nucleic acid sequences encoding transit peptides are derived from the genus *Spinacia* such as chloroplast 30S ribosomal protein PSrp-1, root acyl carrier protein II, acyl carrier protein, ATP synthase: γ subunit, ATP synthase: δ subunit, cytochrom f, ferredoxin I, ferredoxin NADP oxidoreductase (=FNR), nitrite reductase, phosphoribulokinase, plastocyanin or carbonic anhydrase. The skilled worker will recognize that various other nucleic acid sequences encoding transit peptides can easily isolated from plastid-localized proteins, which are expressed from nuclear genes as precursors and are then targeted to plastids. Such transit peptides encoding sequences can be used for the construction of other expression constructs. The transit peptides advantageously used in the inventive process and which are part of the inventive nucleic acid sequences and proteins are typically 20 to 120 amino acids, preferably 25 to 110, 30 to 100 or 35 to 90 amino acids, more preferably 40 to 85 amino acids and most preferably 45 to 80 amino acids in length and functions posttranslational to direct the protein to the plastid preferably to the chloroplast. The nucleic acid sequences encoding such transit peptides are localized upstream of nucleic acid sequence encoding the mature protein. For the correct molecular joining of the transit peptide encoding nucleic acid and the nucleic acid encoding the protein to be targeted it is sometimes necessary to introduce additional base pairs at the joining position, which forms restriction enzyme recognition sequences useful for the molecular joining of the different nucleic acid molecules. This procedure might lead to very few additional amino acids at the N-terminal of the mature imported protein, which usually and preferably do not interfere with the protein function. In any case, the additional base pairs at the joining position which forms restriction enzyme recognition sequences have to be chosen with care, in order to avoid the formation of stop codons or codons which encode amino acids with a strong influence on protein folding, like e.g. proline. It is preferred that such additional codons encode small structural flexible amino acids such as glycine or alanine.

As mentioned above the nucleic acid sequences coding for the proteins as shown in table II, column 3 or 5 and its homologs as disclosed in table I, columns 7 can be joined to a nucleic acid sequence encoding a transit peptide, e.g. if for the nucleic acid molecule in column 6 of table I the term "plastidic" is indicated. This nucleic acid sequence encoding a transit peptide ensures transport of the protein to the respective organelle, especially the plastid. The nucleic acid sequence of the gene to be expressed and the nucleic acid sequence encoding the transit peptide are operably linked. Therefore the transit peptide is fused in frame to the nucleic acid sequence coding for proteins as shown in table II, column 3 or 5 and its homologs as disclosed in table I, columns 5, e.g. if for the nucleic acid molecule in column 6 of table I the term "plastidic" is indicated.

The term "organelle" according to the invention shall mean for example "mitochondria" or preferably "plastid" (throughout the specification the "plural" shall comprise the "singular" and vice versa). The term "plastid" according to the invention are intended to include various forms of plastids including proplastids, chloroplasts, chromoplasts, gerontoplasts, leucoplasts, amyloplasts, elaioplasts and etioplasts, preferably chloroplasts. They all have as a common ancestor the aforementioned proplasts.

Other transit peptides are disclosed by Schmidt et al. (J. Biol. Chem. 268 (36), 27447 (1993)), Della-Cioppa et al. (Plant. Physiol. 84, 965 (1987)), de Castro Silva Filho et al. (Plant Mol. Biol. 30, 769 (1996)), Zhao et al. (J. Biol. Chem. 270 (11), 6081(1995)), Römer et al. (Biochem. Biophys. Res. Commun. 196 (3), 1414 (1993)), Keegstra et al. (Annu. Rev. Plant Physiol. Plant Mol. Biol. 40, 471(1989)), Lubben et al. (Photosynthesis Res. 17, 173 (1988)) and Lawrence et al. (J. Biol. Chem. 272 (33), 20357 (1997)). A general review about targeting is disclosed by Kermode Allison R. in Critical Reviews in Plant Science 15 (4), 285 (1996) under the title "Mechanisms of Intracellular Protein Transport and Targeting in Plant Cells.".

Favored transit peptide sequences, which are used in the inventive process and which form part of the inventive nucleic acid sequences are generally enriched in hydroxylated amino acid residues (serine and threonine), with these two residues generally constituting 20 to 35% of the total. They often have an amino-terminal region empty of Gly, Pro, and charged residues. Furthermore they have a number of small hydrophobic amino acids such as valine and alanine and generally acidic amino acids are lacking. In addition they generally have a middle region rich in Ser, Thr, Lys and Arg. Overall they have very often a net positive charge.

Alternatively, nucleic acid sequences coding for the transit peptides may be chemically synthesized either in part or wholly according to structure of transit peptide sequences disclosed in the prior art. Said natural or chemically synthesized sequences can be directly linked to the sequences encoding the mature protein or via a linker nucleic acid sequence, which may be typically less than 500 base pairs, preferably less than 450, 400, 350, 300, 250 or 200 base pairs, more preferably less than 150, 100, 90, 80, 70, 60, 50, 40 or 30 base pairs and most preferably less than 25, 20, 15, 12, 9, 6 or 3 base pairs in length and are in frame to the coding sequence. Furthermore favorable nucleic acid sequences encoding transit peptides may comprise sequences derived from more than one biological and/or chemical source and may include a nucleic acid sequence derived from the amino-terminal region of the mature protein, which in its native state is linked to the transit peptide. In a preferred embodiment of the invention said amino-terminal region of the mature protein is typically less than 150 amino acids, preferably less than 140, 130, 120, 110, 100 or 90 amino acids, more preferably less than 80, 70, 60, 50, 40, 35, 30, 25 or 20 amino acids and most preferably less than 19, 18, 17, 16, 15, 14, 13, 12, 11 or 10 amino acids in length. But even shorter or longer stretches are also possible. In addition target sequences, which facilitate the transport of proteins to other cell compartments such as the vacuole, endoplasmic reticulum, Golgi complex, glyoxysomes, peroxisomes or mitochondria may be also part of the inventive nucleic acid sequence.

The proteins translated from said inventive nucleic acid sequences are a kind of fusion proteins that means the nucleic acid sequences encoding the transit peptide, for example the ones shown in table V, for example the last one of the table, are joint to the nucleic acid sequences shown in table I, columns 5 and 7, e.g. if for the nucleic acid molecule in column 6 of table I the term "plastidic" is indicated. The person skilled in the art is able to join said sequences in a functional manner. Advantageously the transit peptide part is cleaved off from the protein part shown in table II, columns 5 and 7 during the transport preferably into the plastids. All products of the cleavage of the preferred transit peptide shown in the last line of table V have preferably the N-terminal amino acid sequences QIA CSS or QIA EFQLTT in front of the start methionine of the protein mentioned in table II, columns 5 and 7. Other short amino acid sequences of an range of 1 to 20 amino acids preferable 2 to 15 amino acids, more preferable 3 to 10 amino acids most preferably 4 to 8 amino acids are also possible in front of the start methionine of the protein mentioned in table II, columns 5 and 7. In case of the amino acid sequence QIA CSS the three amino acids in front of the start methionine are stemming from the LIC (=ligation independent cloning) cassette. Said short amino acid sequence is preferred in the case of the expression of *Escherichia coli* genes. In case of the amino acid sequence QIA EFQLTT the six amino acids in front of the start methionine are stemming from the LIC cassette. Said short amino acid sequence is preferred in the case of the expression of *Saccharomyces cerevisiae* genes. The skilled worker knows that other short sequences are also useful in the expression of the genes mentioned in table I, columns 5 and 7. Furthermore the skilled worker is aware of the fact that there is not a need for such short sequences in the expression of the genes.

TABLE V

Examples of transit peptides disclosed by von Heijne et al.

| Trans Pep | Organism | Transit Peptide | SEQ ID NO: | Reference |
|---|---|---|---|---|
| 1 | Acetabularia mediterranea | MASIMMNKSVVLSKECAKPLATPK VTLNKRGFATTIATKNREMMVWQP FNNKMFETFSFLPP | 17 | Mol. Gen. Genet. 218, 445 (1989) |
| 2 | Arabidopsis thaliana | MAASLQSTATFLQSAKIATAPSRG SSHLRSTQAVGKSFGLETSSARLT CSFQSDFKDFTGKCSDAVKIAGFA LATSALVVSGASAEGAPK | 18 | EMBO J. 8, 3187 (1989) |
| 3 | Arabidopsis thaliana | MAQVSRICNGVQNPSLICNLSKSS QRKSPLSVSLKTQQHPRAYPISSS WGLKKSGMTLIGSLERPLKVMSSV STAEKASEIVLQPIREISGLIKLP | 19 | Mol. Gen. Genet. 210, 437 (1987) |
| 4 | Arabidopsis thaliana | MAAATTTTTSSSISFSTKPSPSS SKSPLPISRFSLPFSLNPLKSSSS SRRRGIKSSSPSSISAVLNTTTNV TTTPSPTKPTKPETFISRFAPDQP RKGA | 20 | Plant Physiol. 85, 1110 (1987) |
| 5 | Arabidopsis thaliana | MITSSLTCSLQALKLSSPFAHGST PLSSLSKPNSFPNHRMPALVPV | 21 | J. Biol. Chem. 265, 2763 (1990) |
| 6 | Arabidopsis thaliana | MASLLGTSSSAI-WASPSLSSPSS KPSSSPICFRPGKLFGSKLNAGIQ IRPKKNRSRYHVSVMNVATEINST EQVVGKFDSKKSARPVYPFAAI | 22 | EMBO J. 9, 1337 (1990) |
| 7 | Arabidopsis thaliana | MASTALSSAIVGTSFIRRSPAPIS LRSLPSANTQSLFGLKKSGTARGG RVVAM | 23 | Plant Physiol. 93, 572 (1990) |
| 8 | Arabidopsis thaliana | MAASTMALSSPAFAGKAVNLSPAA SEVLGSGRVTNRKTV | 24 | Nucl. Acids Res. 14, 4051 (1986) |
| 9 | Arabidopsis thaliana | MAAITSATVTIPSFTGLKLAVSSK PKTLSTISRSSSATRAPPKLALKS SLKDFGVIAVATAASIVLAGNAMA MEVLLGSDDGSLAFVPSEFT | 25 | Gene 65, 59 (1988) |
| 10 | Arabidopsis thaliana | MAAAVSTVGAINRAPLSLNGSGSG AVSAPASTFLGKKVVTVSRFAQSN KKSNGSFKVLAVKEDKQTDGDRWR GLAYDTSDDQIDI | 26 | Nucl. Acids Res. 17, 2871 (1989) |
| 11 | Arabidopsis thaliana | MKSSMLSSTAWTSPAQATMVAPFT GLKSSASFPVTRKANNDITSITSN GGRVSC | 27 | Plant Mol. Biol. 11, 745 (1988) |
| 12 | Arabidopsis thaliana | MAASGTSARFRASVSSAPSSSSQL THLKSPFKAVKYTPLPSSRSKSSS FSVSCTIAKDPPVLMAAGSDPALW QRPDSFGRFGKFGGKYVPE | 28 | Proc. Natl. Acad. Sci. USA, 86, 4604 (1989) |
| 13 | Brassica campestris | MSTTFCSSVCMQATSLAATTRISF QKPLAVSTTNLSFNLRRSIPTRFS ISCAAKPETVEKVSKIVKKQLSLK DDQKVVAE | 29 | Nucl. Acids Res. 15, 7197 (1987) |
| 14 | Brassica napus | MATTFSASVSMQATSLATTTRISF QKPVLVSNHGRTNLSFNLSRTRLSI SC | 30 | Eur. J. Biochem. 174, 287 (1988) |
| 15 | Chlamydomonas reinhardtii | MQALSSRVNIAAKPQRAQRLVVRA EEVKAAPKKEVGPKRGSLVK | 31 | Plant Mol. Biol. 12, 463 (1989) |
| 16 | Cucurbita moschata | MAELIQDKESAQSAATAAAASSGY ERRNEPAHSRKFLEVRSEEELL-S CIKK | 32 | FEBS Lett. 238, 424 (1988) |

TABLE V-continued

Examples of transit peptides disclosed by von Heijne et al.

| Trans Pep | Organism | Transit Peptide | SEQ ID NO: | Reference |
|---|---|---|---|---|
| 17 | Spinacea oleracea | MSTINGCLTSISPSRTQLKNTSTL RPTFIANSRVNPSSSVPPSLIRNQ PVFAAPAPIITPTL | 33 | J. Biol. Chem. 265, (10) 5414 (1990) |
| 18 | Spinacea oleracea | MTTAVTAAVSFPSTKTTSLSARCS SVISPDKISYKKVPLYYRNVSATG KMGPIRAQIASDVEAPPPAPAK-V EKMS | 34 | Curr. Genet. 13, 517 (1988) |
| 19 | Spinacea oleracea | MTTAVTAAVSFPSTKTTSLSARSS SVISPDKISYKKVPLYYRNVSATG KMGPIRA | 35 | |

Alternatively to the targeting of the sequences shown in table II, columns 5 and 7 preferably of sequences in general encoded in the nucleus with the aid of the targeting sequences mentioned for example in table V alone or in combination with other targeting sequences preferably into the plastids, the nucleic acids of the invention can directly be introduced into the plastidal genome, e.g. for which in column 6 of table II the term "plastidic" is indicated. Therefore in a preferred embodiment the nucleic acid sequences shown in table I, columns 5 and 7 are directly introduced and expressed in plastids, particularly if in column 6 of table I the term "plastidic" is indicated.

The term "introduced" in the context of this specification shall mean the insertion of a nucleic acid sequence into the organism by means of a "transfection", "transduction" or preferably by "transformation".

A plastid, such as a chloroplast, has been "transformed" by an exogenous (preferably foreign) nucleic acid sequence if nucleic acid sequence has been introduced into the plastid that means that this sequence has crossed the membrane or the membranes of the plastid. The foreign DNA may be integrated (covalently linked) into plastid DNA making up the genome of the plastid, or it may remain not integrated (e.g., by including a chloroplast origin of replication). "Stably" integrated DNA sequences are those, which are inherited through plastid replication, thereby transferring new plastids, with the features of the integrated DNA sequence to the progeny.

For expression a person skilled in the art is familiar with different methods to introduce the nucleic acid sequences into different organelles such as the preferred plastids. Such methods are for example disclosed by Maiga P. (Annu. Rev. Plant Biol. 55, 289 (2004)), Evans T. (WO 2004/040973), McBride K. E. et al. (U.S. Pat. No. 5,455,818), Daniell H. et al. (U.S. Pat. No. 5,932,479 and U.S. Pat. No. 5,693,507) and Straub J. M. et al. (U.S. Pat. No. 6,781,033). A preferred method is the transformation of microspore-derived hypocotyl or cotyledonary tissue (which are green and thus contain numerous plastids) leaf tissue and afterwards the regeneration of shoots from said transformed plant material on selective medium. As methods for the transformation bombarding of the plant material or the use of independently replicating shuttle vectors are well known by the skilled worker. But also a PEG-mediated transformation of the plastids or Agrobacterium transformation with binary vectors is possible. Useful markers for the transformation of plastids are positive selection markers for example the chloramphenicol-, streptomycin-, kanamycin-, neomycin-, amikamycin-, spectinomycin-, triazine- and/or lincomycin-tolerance genes. As additional markers named in the literature often as secondary markers, genes coding for the tolerance against herbicides such as phosphinothricin (=glufosinate, BASTA™, Liberty™, encoded by the bar gene), glyphosate (=N-(phosphonomethyl)glycine, Roundup™, encoded by the 5-enolpyruvylshikimate-3-phosphate synthase gene=epsps), sulfonylureas (like Staple™, encoded by the acetolactate synthase (ALS) gene), imidazolinones [=IMI, like imazethapyr, imazamox, Clearfield™, encoded by the acetohydroxyacid synthase (AHAS) gene, also known as acetolactate synthase (ALS) gene] or bromoxynil (=Buctril™, encoded by the oxy gene) or genes coding for antibiotics such as hygromycin or G418 are useful for further selection. Such secondary markers are useful in the case when most genome copies are transformed. In addition negative selection markers such as the bacterial cytosine deaminase (encoded by the codA gene) are also useful for the transformation of plastids.

Thus, in one embodiment, an activity disclosed herein as being conferred by a polypeptide shown in table II is increase or generated by linking the polypeptide disclosed in table II or a polypeptide conferring the same said activity with an targeting signal as herein described, if in column 6 of table II the term "plastidic" is listed for said polypeptide. For example, the polypeptide described can be linked to the targeting signal shown in table VII.

Accordingly, in the method of the invention for producing a transgenic plant with increased yield as compared to a corresponding, e.g. non-transformed, wild type plant, comprising transforming a plant cell or a plant cell nucleus or a plant tissue with the mentioned nucleic acid molecule, said nucleic acid molecule selected from said mentioned group encodes for a polypeptide conferring said activity being linked to a targeting signal as mentioned herein, e.g. as mentioned in table VII, e.g. if in column 6 of table II the term "plastidic" is listed for the encoded polypeptide.

To increase the possibility of identification of transformants it is also desirable to use reporter genes other then the aforementioned tolerance genes or in addition to said genes. Reporter genes are for example β-galactosidase-, β-glucuronidase-(GUS), alkaline phosphatase- and/or green-fluorescent protein-genes (GFP).

By transforming the plastids the intraspecies specific transgene flow is blocked, because a lot of species such as corn, cotton and rice have a strict maternal inheritance of plastids. By placing the genes specified in table I, columns 5 and 7, e.g. if for the nucleic acid molecule in column 6 of table I the term "plastidic" is indicated, or active fragments thereof in the plastids of plants, these genes will not be present in the pollen of said plants.

A further embodiment of the invention relates to the use of so called "chloroplast localization sequences", in which a first RNA sequence or molecule is capable of transporting or "chaperoning" a second RNA sequence, such as a RNA sequence transcribed from the sequences depicted in table I, columns 5 and 7 or a sequence encoding a protein, as depicted in table II, columns 5 and 7, from an external environment inside a cell or outside a plastid into a chloroplast. In one embodiment the chloroplast localization signal is substantially similar or complementary to a complete or intact viroid sequence, e.g. if for the polypeptide in column 6 of table II the term "plastidic" is indicated. The chloroplast localization signal may be encoded by a DNA sequence, which is transcribed into the chloroplast localization RNA. The term "viroid" refers to a naturally occurring single stranded RNA molecule (Flores, C. R. Aced Sci III. 324 (10), 943 (2001)). Viroids usually contain about 200-500 nucleotides and generally exist as circular molecules. Examples of viroids that contain chloroplast localization signals include but are not limited to ASBVd, PLMVd, CChMVd and ELVd. The viroid sequence or a functional part of it can be fused to the sequences depicted in table I, columns 5 and 7 or a sequence encoding a protein, as depicted in table II, columns 5 and 7 in such a manner that the viroid sequence transports a sequence transcribed from a sequence as depicted in table I, columns 5 and 7 or a sequence encoding a protein as depicted in table II, columns 5 and 7 into the chloroplasts, e.g. e.g. if for said nucleic acid molecule or polynucleotide in column 6 of table I or II the term "plastidic" is indicated. A preferred embodiment uses a modified ASBVd (Navarro et al., Virology. 268 (1), 218 (2000)).

In a further specific embodiment the protein to be expressed in the plastids such as the proteins depicted in table II, columns 5 and 7, e.g. if for the polypeptide in column 6 of table II the term "plastidic" is indicated, are encoded by different nucleic acids. Such a method is disclosed in WO 2004/040973, which shall be incorporated by reference. WO 2004/040973 teaches a method, which relates to the translocation of an RNA corresponding to a gene or gene fragment into the chloroplast by means of a chloroplast localization sequence. The genes, which should be expressed in the plant or plants cells, are split into nucleic acid fragments, which are introduced into different compartments in the plant e.g. the nucleus, the plastids and/or mitochondria. Additionally plant cells are described in which the chloroplast contains a ribozyme fused at one end to an RNA encoding a fragment of a protein used in the inventive process such that the ribozyme can trans-splice the translocated fusion RNA to the RNA encoding the gene fragment to form and as the case may be reunite the nucleic acid fragments to an intact mRNA encoding a functional protein for example as disclosed in table II, columns 5 and 7.

In another embodiment of the invention the nucleic acid sequences as shown in table I, columns 5 and 7, e.g. if in column 6 of table I the term "plastidic" is indicated, used in the inventive process are transformed into plastids, which are metabolic active. Those plastids should preferably maintain at a high copy number in the plant or plant tissue of interest, most preferably the chloroplasts found in green plant tissues, such as leaves or cotyledons or in seeds.

In another embodiment of the invention the nucleic acid sequences as shown in table I, columns 5 and 7, e.g. if in column 6 of table I the term "mitochondric" is indicated, used in the inventive process are transformed into mitochondria, which are metabolic active. in the cytsol or cytoplasm or in an organelle such as a plastid or mitochondria or both For a good expression in the plastids the nucleic acid sequences as shown in table I, columns 5 and 7, e.g. if in column 6 of table I the term "plastidic" is indicated, are introduced into an expression cassette using a preferably a promoter and terminator, which are active in plastids preferably a chloroplast promoter. Examples of such promoters include the psbA promoter from the gene from spinach or pea, the rbcL promoter, and the atpB promoter from corn.

The terms "Comprises"/"comprising" and grammatical variations thereof when used in this specification are to be taken to specify the presence of stated features, integers, steps or components or groups thereof, but not to preclude the presence or addition of one or more other features, integers, steps, components or groups thereof.

In accordance with the invention, the term "plant cell" or the term "organism" as understood herein relates always to a plant cell or a organelle thereof, preferably a plastid, more preferably chloroplast.

As used herein, "plant" is meant to include not only a whole plant but also a part thereof i.e., one or more cells, and tissues, including for example, leaves, stems, shoots, roots, flowers, fruits and seeds.

Surprisingly it was found, that the transgenic expression of the *Saccharomyces cerevisiae, E. coli, Synechocystis* or *A. thaliana* protein as shown in table II, column 3 in a plant such as *A. thaliana* for example, conferred increased yield, e.g. with an increased yield-related trait, for example enhanced tolerance to abiotic environmental stress, increased nutrient use efficiency, increased drought tolerance, low temperature tolerance and/or another increased yield-related trait to the transgenic plant cell, plant or a part thereof as compared to a corresponding, e.g. non-transformed, wild type plant cell, a plant or a part thereof.

Accordingly, in one embodiment, in case the activity of a polypeptide according to the polypeptide SEQ ID NO. 39, or encoded by a nucleic acid molecule comprising the nucleic acid SEQ ID NO. 38, or a homolog of said nucleic acid molecule or polypeptide, e.g. in case the activity of the *Escherichia coli* nucleic acid molecule or a polypeptide, respectively, comprising the nucleic acid SEQ ID NO. 38 or polypeptide SEQ ID NO. 39, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 38 or polypeptide SEQ ID NO. 39, respectively, is increased or generated or if the activity "pyrimidine deaminase/reductase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 39, or encoded by a nucleic acid molecule comprising the nucleic acid SEQ ID NO. 38, a homolog of said nucleic acid molecule or polypeptide, e.g. in case the activity of the *Escherichia coli* nucleic acid molecule or a polypeptide comprising the nucleic acid SEQ ID NO. 38 or polypeptide SEQ ID NO. 39, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 38 or polypeptide SEQ ID NO. 39, respectively, is increased or generated or if the activity "pyrimidine deaminase/reductase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.361-fold, for example plus at least 100% thereof, under conditions of low temperature is conferred compared to a corresponding on-modified, e.g. non-transformed, wild type plant cell, a plant or a part thereof.

In a further embodiment, in case the activity of a polypeptide according to the polypeptide SEQ ID NO. 39, or encoded by a nucleic acid molecule comprising the nucleic acid SEQ ID NO. 38, or a homolog of said nucleic acid molecule or polypeptide, e.g. in case the activity of the *Escherichia coli* nucleic acid molecule or a polypeptide comprising the nucleic acid SEQ ID NO. 38 or polypeptide SEQ ID NO. 39, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 38 or polypeptide SEQ ID NO. 39, respectively, is increased or generated or if the activity "pyrimidine deaminase/reductase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.610-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 39, or encoded by a nucleic acid molecule comprising the nucleic acid SEQ ID NO. 38, or a homolog of said nucleic acid molecule or polypeptide, e.g. in case the activity of the *Escherichia coli* nucleic acid molecule or a polypeptide comprising the nucleic acid SEQ ID NO. 38 or polypeptide SEQ ID NO. 39, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 38 or polypeptide SEQ ID NO. 39, respectively, is increased or generated or if the activity "pyrimidine deaminase/reductase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.168-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 148, or encoded by a nucleic acid molecule comprising the nucleic acid SEQ ID NO. 147, or a homolog of said nucleic acid molecule or polypeptide, e.g. in case the activity of the *Escherichia coli* nucleic acid molecule or a polypeptide, respectively, comprising the nucleic acid SEQ ID NO. 147 or polypeptide SEQ ID NO. 148, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 147 or polypeptide SEQ ID NO. 148, respectively, is increased or generated or if the activity "oxidoreductase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 148, or encoded by a nucleic acid molecule comprising the nucleic acid SEQ ID NO. 147, or a homolog of said nucleic acid molecule or polypeptide, e.g. in case the activity of the *Escherichia coli* nucleic acid molecule or a polypeptide comprising the nucleic acid SEQ ID NO. 147 or polypeptide SEQ ID NO. 148, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 147 or polypeptide SEQ ID NO. 148, respectively, is increased or generated or if the activity "oxidoreductase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.357-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 148, or encoded by a nucleic acid molecule comprising the nucleic acid SEQ ID NO. 147, or a homolog of said nucleic acid molecule or polypeptide, e.g. in case the activity of the *Escherichia coli* nucleic acid molecule or a polypeptide comprising the nucleic acid SEQ ID NO. 147 or polypeptide SEQ ID NO. 148, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 147 or polypeptide SEQ ID NO. 148, respectively, is increased or generated or if the activity "oxidoreductase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.209-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 148, or encoded by a nucleic acid molecule comprising the nucleic acid SEQ ID NO. 147, or a homolog of said nucleic acid molecule or polypeptide, e.g. in case the activity of the *Escherichia coli* nucleic acid molecule or a polypeptide comprising the nucleic acid SEQ ID NO. 147 or polypeptide SEQ ID NO. 148, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 147 or polypeptide SEQ ID NO. 148, respectively, is increased or generated or if the activity "oxidoreductase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.088-fold, for example plus at least 100% thereof, under conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 173, or encoded by a nucleic acid molecule comprising the nucleic acid SEQ ID NO. 172, or a homolog of said nucleic acid molecule or polypeptide, e.g. in case the activity of the *Escherichia coli* nucleic acid molecule or a polypeptide, respectively, comprising the nucleic acid SEQ ID NO. 172 or polypeptide SEQ ID NO. 173, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 172 or polypeptide SEQ ID NO. 173, respectively, is increased or generated or if the activity "glycerol dehydrogenase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 173, or encoded by a nucleic acid molecule comprising the nucleic acid SEQ ID NO. 172, or a homolog of said nucleic acid molecule or polypeptide, e.g. in case the activity of the *Escherichia coli* nucleic acid molecule or a polypeptide comprising the nucleic acid SEQ ID NO. 172 or polypeptide SEQ ID NO. 173, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 172 or polypeptide SEQ ID NO. 173, respectively, is increased or generated or if the activity "glycerol dehydrogenase" is increased or generated in a plant cell, plant or part thereof, especially if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.353-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 173, or encoded by a nucleic acid molecule comprising the nucleic acid SEQ ID NO. 172, or a homolog of said nucleic acid molecule or polypeptide, e.g. in case the activity of the *Escherichia coli* nucleic acid molecule or a polypeptide comprising the nucleic acid SEQ ID NO. 172 or polypeptide SEQ ID NO. 173, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 172 or polypeptide SEQ ID NO. 173, respectively, is increased or generated or if the activity "glycerol dehydrogenase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.457-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 173, or encoded by a nucleic acid molecule comprising the nucleic acid SEQ ID NO. 172, or a homolog of said nucleic acid molecule or polypeptide, e.g. in case the activity of the *Escherichia coli* nucleic acid molecule or a polypeptide comprising the nucleic acid SEQ ID NO. 172 or polypeptide SEQ ID NO. 173, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 172 or polypeptide SEQ ID NO. 173, respectively, is increased or generated or if the activity "glycerol dehydrogenase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.191-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 383, or encoded by a nucleic acid molecule comprising the nucleic acid SEQ ID NO. 382, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 382 or polypeptide SEQ ID NO. 383, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 382 or polypeptide SEQ ID NO. 383, respectively, is increased or generated or if the activity "uridine diphosphate-N-acetylglucosamine transporter" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 383, or encoded by a nucleic acid molecule comprising the nucleic acid SEQ ID NO. 382, or a homolog of said nucleic acid molecule or polypeptide, e.g. in case the activity of the *Saccharomyces cerevisiae* nucleic acid molecule or a polypeptide comprising the nucleic acid SEQ ID NO. 382 or polypeptide SEQ ID NO. 383, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 382 or polypeptide SEQ ID NO. 383, respectively, is increased or generated or if the activity "uridine diphosphate-N-acetylglucosamine transporter" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.575-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 383, or encoded by a nucleic acid molecule comprising the nucleic acid SEQ ID NO. 382, or a homolog of said nucleic acid molecule or polypeptide, e.g. in case the activity of the *Saccharomyces cerevisiae* nucleic acid molecule or a polypeptide comprising the nucleic acid SEQ ID NO. 382 or polypeptide SEQ ID NO. 383, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 382 or polypeptide SEQ ID NO. 383, respectively, is increased or generated or if the activity "uridine diphosphate-N-acetylglucosamine transporter" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.370-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 383, or encoded by a nucleic acid molecule comprising the nucleic acid SEQ ID NO. 382, or a homolog of said nucleic acid molecule or polypeptide, e.g. in case the activity of the *Saccharomyces cerevisiae* nucleic acid molecule or a polypeptide comprising the nucleic acid SEQ ID NO. 382 or polypeptide SEQ ID NO. 383, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 382 or polypeptide SEQ ID NO. 383, respectively, is increased or generated or if the activity "uridine diphosphate-N-acetylglucosamine transporter" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under conditions (intrinsic yield), e.g. in the absence of nutrient deficiency as well as stress conditions, is conferred.

Particularly, an increase of yield from 1.05-fold to 1.306-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 407, or encoded by a nucleic acid molecule comprising the nucleic acid SEQ ID NO. 406, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 406 or polypeptide SEQ ID NO. 407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 406 or polypeptide SEQ ID NO. 407, respectively, is increased or generated or if the activity "DNA and protein binding protein for controlling the proteome at post-transcriptional level" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 407, or encoded by a nucleic acid molecule comprising the nucleic acid SEQ ID NO. 406, or a homolog of said nucleic acid molecule or polypeptide, e.g. in case the activity of the *Saccharomyces cerevisiae* nucleic acid molecule or a polypeptide comprising the nucleic acid SEQ ID NO. 406 or polypeptide SEQ ID NO. 407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 406 or polypeptide SEQ ID NO. 407, respectively, is increased or generated or if the activity "DNA and protein binding protein for controlling the proteome at post-transcriptional level" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.300-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 407, or encoded by a nucleic acid molecule comprising the nucleic acid SEQ ID NO. 406, or a homolog of said nucleic acid molecule or polypeptide, e.g. in case the activity of the *Saccharomyces cerevisiae* nucleic acid molecule or a polypeptide comprising the nucleic acid SEQ ID NO. 406 or polypeptide SEQ ID NO. 407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 406 or polypeptide SEQ ID NO. 407, respectively, is increased or generated or if the activity "DNA and protein binding protein for controling the proteome at post-transcriptional level" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.340-fold, for example plus at least 100% thereof, under standard conditions (intrinsic yield), e.g. in the absence of nutrient deficiency as well as stress conditions is conferred compared to a corresponding on-modified, e.g. non-transformed, wild type plant cell, a plant or a part thereof.

Accordingly, in one embodiment, in case the activity of a polypeptide according to the polypeptide SEQ ID NO. 918, or encoded by a nucleic acid molecule comprising the nucleic acid SEQ ID NO. 917, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 917 or polypeptide SEQ ID NO. 918, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 917 or polypeptide SEQ ID NO. 918, respectively, is increased or generated or if the activity "protein required for degradation of glycoproteins" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 918, or encoded by a nucleic acid molecule comprising the nucleic acid SEQ ID NO. 917, or a homolog of said nucleic acid molecule or polypeptide, e.g. in case the activity of the *Saccharomyces cerevisiae* nucleic acid molecule or a polypeptide comprising the nucleic acid SEQ ID NO. 917 or polypeptide SEQ ID NO. 918, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 917 or polypeptide SEQ ID NO. 918, respectively, is increased or generated or if the activity "protein required for degradation of glycoproteins" is increased or generated in a plant cell, plant or part thereof, especially if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.697-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 918, or encoded by a nucleic acid molecule comprising the nucleic acid SEQ ID NO. 917, or a homolog of said nucleic acid molecule or polypeptide, e.g. in case the activity of the *Saccharomyces cerevisiae* nucleic acid molecule or a polypeptide comprising the nucleic acid SEQ ID NO. 917 or polypeptide SEQ ID NO. 918, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 917 or polypeptide SEQ ID NO. 918, respectively, is increased or generated or if the activity "protein required for degradation of glycoproteins" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred. Particularly, an increase of yield from 1.05-fold to 1.469-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 918, or encoded by a nucleic acid molecule comprising the nucleic acid SEQ ID NO. 917, or a homolog of said nucleic acid molecule or polypeptide, e.g. in case the activity of the *Saccharomyces cerevisiae* nucleic acid molecule or a polypeptide comprising the nucleic acid SEQ ID NO. 917 or polypeptide SEQ ID NO. 918, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 917 or polypeptide SEQ ID NO. 918, respectively, is increased or generated or if the activity "protein required for degradation of glycoproteins" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.369-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 953, or encoded by a nucleic acid molecule comprising the nucleic acid SEQ ID NO. 952, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 952 or polypeptide SEQ ID NO. 953, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 952 or polypeptide SEQ ID NO. 953, respectively, is increased or generated or if the activity "aquaporin" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 953, or encoded by a nucleic acid molecule comprising the nucleic acid SEQ ID NO. 952, or a homolog of said nucleic acid molecule or polypeptide, e.g. in case the activity of the *Saccharomyces cerevisiae* nucleic acid molecule or a polypeptide comprising the nucleic acid SEQ ID NO. 952 or polypeptide SEQ ID NO. 953, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 952 or polypeptide SEQ ID NO. 953, respectively, is increased or generated or if the activity "aquaporin" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.353-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 953, or encoded by a nucleic acid molecule comprising the nucleic acid SEQ ID NO. 952, or a homolog of said nucleic acid molecule or polypeptide, e.g. in case the activity of the *Saccharomyces cerevisiae* nucleic acid molecule or a polypeptide comprising the nucleic acid SEQ ID NO. 952 or polypeptide SEQ ID NO. 953, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 952 or polypeptide SEQ ID NO. 953, respectively, is increased or generated or if the activity "aquaporin" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.525-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 953, or encoded by a nucleic acid molecule comprising the nucleic acid SEQ ID NO. 952, or a homolog of said nucleic acid molecule or polypeptide, e.g. in case the activity of the *Saccharomyces cerevisiae* nucleic acid molecule or a polypeptide comprising the nucleic acid SEQ ID NO. 952 or polypeptide SEQ ID NO. 953, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 952 or polypeptide SEQ ID NO. 953, respectively, is increased or generated or if the activity "aquaporin" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.162-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 1321, or encoded by a nucleic acid molecule comprising the nucleic acid SEQ ID NO. 1320, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 1320 or polypeptide SEQ ID NO. 1321, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1320 or polypeptide SEQ ID NO. 1321, respectively, is increased or generated or if the activity "inorganic phosphate transporter" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 1321, or encoded by a nucleic acid molecule comprising the nucleic acid SEQ ID NO. 1320, or a homolog of said nucleic acid molecule or polypeptide, e.g. in case the activity of the *Saccharomyces cerevisiae* nucleic acid molecule or a polypeptide comprising the nucleic acid SEQ ID NO. 1320 or polypeptide SEQ ID NO. 1321, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1320 or polypeptide SEQ ID NO. 1321, respectively, is increased or generated or if the activity "inorganic phosphate transporter" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.405-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 1321, or encoded by a nucleic acid molecule comprising the nucleic acid SEQ ID NO. 1320, or a homolog of said nucleic acid molecule or polypeptide, e.g. in case the activity of the *Saccharomyces cerevisiae* nucleic acid molecule or a polypeptide comprising the nucleic acid SEQ ID NO. 1320 or polypeptide SEQ ID NO. 1321, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1320 or polypeptide SEQ ID NO. 1321, respectively, is increased or generated or if the activity "inorganic phosphate transporter" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.597-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 1321, or encoded by a nucleic acid molecule comprising the nucleic acid SEQ ID NO. 1320, or a homolog of said nucleic acid molecule or polypeptide, e.g. in case the activity of the *Saccharomyces cerevisiae* nucleic acid molecule or a polypeptide comprising the nucleic acid SEQ ID NO. 1320 or polypeptide SEQ ID NO. 1321, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1320 or polypeptide SEQ ID NO. 1321, respectively, is increased or generated or if the activity "inorganic phosphate transporter" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.327-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 1649, or encoded by a nucleic acid molecule comprising the nucleic acid SEQ ID NO. 1648, or a homolog of said nucleic acid molecule or polypeptide, e.g. in case the activity of the *Saccharomyces cerevisiae* nucleic acid molecule or a polypeptide comprising the nucleic acid SEQ ID NO. 1648 or polypeptide SEQ ID NO. 1649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1648 or polypeptide SEQ ID NO. 1649, respectively, is increased or generated or if the activity "ammonium transporter" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 1649, or encoded by a nucleic acid molecule comprising the nucleic acid SEQ ID NO. 1648, or a homolog of said nucleic acid molecule or polypeptide, e.g. in case the activity of the *Saccharomyces cerevisiae* nucleic acid molecule or a polypeptide comprising the nucleic acid SEQ ID NO. 1648 or polypeptide SEQ ID NO. 1649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1648 or polypeptide SEQ ID NO. 1649, respectively, is increased or generated or if the activity "ammonium transporter" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.808-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 1649, or encoded by a nucleic acid molecule comprising the nucleic acid SEQ ID NO. 1648, or a homolog of said nucleic acid molecule or polypeptide, e.g. in case the activity of the *Saccharomyces cerevisiae* nucleic acid molecule or a polypeptide comprising the nucleic acid SEQ ID NO. 1648 or polypeptide SEQ ID NO. 1649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1648 or polypeptide SEQ ID NO. 1649, respectively, is increased or generated or if the activity "ammonium transporter" is increased or generated in a plant cell, plant or part thereof, especially if the polypeptide cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.593-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 1649, or encoded by a nucleic acid molecule comprising the nucleic acid SEQ ID NO. 1648, or a homolog of said nucleic acid molecule or polypeptide, e.g. in case the activity of the *Saccharomyces cerevisiae* nucleic acid molecule or a polypeptide comprising the nucleic acid SEQ ID NO. 1648 or polypeptide SEQ ID NO. 1649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 1648 or polypeptide SEQ ID NO. 1649, respectively, is increased or generated or if the activity "ammonium transporter" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.214-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 2066, or encoded by a nucleic acid molecule comprising the nucleic acid SEQ ID NO. 2065, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 2065 or polypeptide SEQ ID NO. 2066, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2065 or polypeptide SEQ ID NO. 2066, respectively, is increased or generated or if the activity "YNR040W-protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 2066, or encoded by a nucleic acid molecule comprising the nucleic acid SEQ ID NO. 2065, or a homolog of said nucleic acid molecule or polypeptide, e.g. in case the activity of the *Saccharomyces cerevisiae* nucleic acid molecule or a polypeptide comprising the nucleic acid SEQ ID NO. 2065 or polypeptide SEQ ID NO. 2066, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2065 or polypeptide SEQ ID NO. 2066, respectively, is increased or generated or if the activity "YNR040W-protein" is increased or generated in a plant cell, plant or part thereof, especially if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.390-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 2066, or encoded by a nucleic acid molecule comprising the nucleic acid SEQ ID NO. 2065, or a homolog of said nucleic acid molecule or polypeptide, e.g. in case the activity of the *Saccharomyces cerevisiae* nucleic acid molecule or a polypeptide comprising the nucleic acid SEQ ID NO. 2065 or polypeptide SEQ ID NO. 2066, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2065 or polypeptide SEQ ID NO. 2066, respectively, is increased or generated or if the activity "YNR040W-protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.069-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

In a further embodiment, in case the activity of a polypeptide according to the polypeptide SEQ ID NO. 2066, or encoded by a nucleic acid molecule comprising the nucleic acid SEQ ID NO. 2065, or a homolog of said nucleic acid molecule or polypeptide, e.g, in case the activity of the *Saccharomyces cerevisiae* nucleic acid molecule or a polypeptide comprising the nucleic acid SEQ ID NO. 2065 or polypeptide SEQ ID NO. 2066, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2065 or polypeptide SEQ ID NO. 2066, respectively, is increased or generated or if the activity "YNR040W-protein" is increased or generated in a plant cell, plant or part thereof, especially if the polypeptide is cytoplasmic localized, an increased drought tolerance as compared to a corresponding non-modified, e.g. a non-transformed, wild type plant cell, a plant or a part thereof is conferred. In one embodiment an increased cycling drought tolerance is conferred.

Particularly, an increase of yield from 1.05-fold to 1.496-fold, for example plus at least 100% thereof, under abiotic stress conditions, e.g. in the under drought conditions, in particular cycling drought conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 2082, or encoded by a nucleic acid molecule comprising the nucleic acid SEQ ID NO. 2081, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 2081 or polypeptide SEQ ID NO. 2082, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2081 or polypeptide SEQ ID NO. 2082, respectively, is increased or generated or if the activity "glutamine synthetase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 2082, or encoded by a nucleic acid molecule comprising the nucleic acid SEQ ID NO. 2081, or a homolog of said nucleic acid molecule or polypeptide, e.g. in case the activity of the *Saccharomyces cerevisiae* nucleic acid molecule or a polypeptide comprising the nucleic acid SEQ ID NO. 2081 or polypeptide SEQ ID NO. 2082, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2081 or polypeptide SEQ ID NO. 2082, respectively, is increased or generated or if the activity "glutamine synthetase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.451-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 2082, or encoded by a nucleic acid molecule comprising the nucleic acid SEQ ID NO. 2081, or a homolog of said nucleic acid molecule or polypeptide, e.g. in case the activity of the *Saccharomyces cerevisiae* nucleic acid molecule or a polypeptide comprising the nucleic acid SEQ ID NO. 2081 or polypeptide SEQ ID NO. 2082, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2081 or polypeptide SEQ ID NO. 2082, respectively, is increased or generated or if the activity "glutamine synthetase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.237-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 2082, or encoded by a nucleic acid molecule comprising the nucleic acid SEQ ID NO. 2081, or a homolog of said nucleic acid molecule or polypeptide, e.g. in case the activity of the *Saccharomyces cerevisiae* nucleic acid molecule or a polypeptide comprising the nucleic acid SEQ ID NO. 2081 or polypeptide SEQ ID NO. 2082, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2081 or polypeptide SEQ ID NO. 2082, respectively, is increased or generated or if the activity "glutamine synthetase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.236-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 2407, or encoded by a nucleic acid molecule comprising the nucleic acid SEQ ID NO. 2406, or a homolog of said nucleic acid molecule or polypeptide, e.g. in case the activity of the *Escherichia coli* nucleic acid molecule or a polypeptide, respectively, comprising the nucleic acid SEQ ID NO. 2406 or polypeptide SEQ ID NO. 2407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2406 or polypeptide SEQ ID NO. 2407, respectively, is increased or generated or if the activity "formate acetyltransferase 1" is increased or generated in a plant cell, plant or part thereof, especially if localized plastidic and/or cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 2407, or encoded by a nucleic acid molecule comprising the nucleic acid SEQ ID NO. 2406, or a homolog of said nucleic acid molecule or polypeptide, e.g. in case the activity of the *Escherichia coli* nucleic acid molecule or a polypeptide comprising the nucleic acid SEQ ID NO. 2406 or polypeptide SEQ ID NO. 2407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2406 or polypeptide SEQ ID NO. 2407, respectively, is increased or generated or if the activity "formate acetyltransferase 1" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, expressing under the control of a plastidic signal sequence, an increase of yield from 1.1-fold to 1.391-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 2407, or encoded by a nucleic acid molecule comprising the nucleic acid SEQ ID NO. 2406, or a homolog of said nucleic acid molecule or polypeptide, e.g. in case the activity of the *Escherichia coli* nucleic acid molecule or a polypeptide comprising the nucleic acid SEQ ID NO. 2406 or polypeptide SEQ ID NO. 2407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2406 or polypeptide SEQ ID NO. 2407, respectively, is increased or generated or if the activity "formate acetyltransferase 1" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, expressing under the control of a plastidic signal sequence, an increase of yield from 1.05-fold to 1.397-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 2407, or encoded by a nucleic acid molecule comprising the nucleic acid SEQ ID NO. 2406, or a homolog of said nucleic acid molecule or polypeptide, e.g. in case the activity of the *Escherichia coli* nucleic acid molecule or a polypeptide comprising the nucleic acid SEQ ID NO. 2406 or polypeptide SEQ ID NO. 2407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2406 or polypeptide SEQ ID NO. 2407, respectively, is increased or generated or if the activity "formate acetyltransferase 1" is increased or generated in a plant cell, plant or part thereof, especially if the polypeptide is plastidic and/or cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, expressing under the control of a plastidic signal sequence, an increase of yield from 1.05-fold to 1.260, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Particularly, expressing without combining said sequence or molecule with a further targeting or signal sequence, e.g. without a further target sequence or signal sequence, an increase of yield from 1.05-fold to 1.286-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

In a further embodiment, in case the activity of a polypeptide according to the polypeptide SEQ ID NO. 2407, or encoded by a nucleic acid molecule comprising the nucleic acid SEQ ID NO. 2406, or a homolog of said nucleic acid molecule or polypeptide, e.g. in case the activity of the *Escherichia coli* nucleic acid molecule or a polypeptide comprising the nucleic acid SEQ ID NO. 2406 or polypeptide SEQ ID NO. 2407, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2406 or polypeptide SEQ ID NO. 2407, respectively, is increased or generated or if the activity "formate acetyltransferase 1" is increased or generated in a plant cell, plant or part thereof, especially if the polypeptide is plastidic localized, an increased drought tolerance as compared to a corresponding non-modified, e.g. a non-transformed, wild type plant cell, a plant or a part thereof is conferred. In one embodiment an increased cycling drought tolerance is conferred.

Particularly, expressing under the control of a plastidic signal sequence, an increase of yield from 1.05-fold to 1.276-fold, for example plus at least 100% thereof, under abiotic stress conditions, e.g. under drought conditions, in particular cycling drought conditions, is conferred compared pared to a corresponding non-modified, e.g. non-transformed, wild type plant cell, a plant or a part thereof.

Accordingly, in one embodiment, in case the activity of a polypeptide according to the polypeptide SEQ ID NO. 2565, or encoded by a nucleic acid molecule comprising the nucleic acid SEQ ID NO. 2564, or a homolog of said nucleic acid molecule or polypeptide, e.g. in case the activity of the *Escherichia coli* nucleic acid molecule or a polypeptide, respectively, comprising the nucleic acid SEQ ID NO. 2564 or polypeptide SEQ ID NO. 2565, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2564 or polypeptide SEQ ID NO. 2565, respectively, is increased or generated or if the activity "enoyl-CoA hydratase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 2565, or encoded by a nucleic acid molecule comprising the nucleic acid SEQ ID NO. 2564, or a homolog of said nucleic acid molecule or polypeptide, e.g. in case the activity of the *Escherichia coli* nucleic acid molecule or a polypeptide comprising the nucleic acid SEQ ID NO. 2564 or polypeptide SEQ ID NO. 2565, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2564 or polypeptide SEQ ID NO. 2565, respectively, is increased or generated or if the activity "enoyl-CoA hydratase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.224-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 2565, or encoded by a nucleic acid molecule comprising the nucleic acid SEQ ID NO. 2564, or a homolog of said nucleic acid molecule or polypeptide, e.g, in case the activity of the *Escherichia coli* nucleic acid molecule or a polypeptide comprising the nucleic acid SEQ ID NO. 2564 or polypeptide SEQ ID NO. 2565, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2564 or polypeptide SEQ ID NO. 2565, respectively, is increased or generated or if the activity "enoyl-CoA hydratase" is increased or generated in a plant cell, plant or part thereof, especially if the polypeptide is cytoplasmic localized, an increased drought tolerance as compared to a corresponding non-modified, e.g. a non-transformed, wild type plant cell, a plant or a part thereof is conferred. In one embodiment an increased cycling drought tolerance is conferred.

Particularly, an increase of yield from 1.05-fold to 1.244-fold, for example plus at least 100% thereof, under abiotic stress conditions, e.g. under drought conditions, in particular cycling drought conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 2842, or encoded by a nucleic acid molecule comprising the nucleic acid SEQ ID NO. 2841, or a homolog of said nucleic acid molecule or polypeptide, e.g. in case the activity of the *Escherichia coli* nucleic acid molecule or a polypeptide, respectively, comprising the nucleic acid SEQ ID NO. 2841 or polypeptide SEQ ID NO. 2842, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2841 or polypeptide SEQ ID NO. 2842, respectively, is increased or generated or if the activity "glucitol/sorbitol-specific enzyme IIA component protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 2842, or encoded by a nucleic acid molecule comprising the nucleic acid SEQ ID NO. 2841, or a homolog of said nucleic acid molecule or polypeptide, e.g. in case the activity of the *Escherichia coli* nucleic acid molecule or a polypeptide comprising the nucleic acid SEQ ID NO. 2841 or polypeptide SEQ ID NO. 2842, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2841 or polypeptide SEQ ID NO. 2842, respectively, is increased or generated or if the activity "glucitol/sorbitol-specific enzyme IIA component protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.462-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 2842, or encoded by a nucleic acid molecule comprising the nucleic acid SEQ ID NO. 2841, or a homolog of said nucleic acid molecule or polypeptide, e.g. in case the activity of the *Escherichia coli* nucleic acid molecule or a polypeptide comprising the nucleic acid SEQ ID NO. 2841 or polypeptide SEQ ID NO. 2842, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2841 or polypeptide SEQ ID NO. 2842, respectively, is increased or generated or if the activity "glucitol/sorbitol-specific enzyme IIA component protein" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred. Particularly, an increase of yield from 1.05-fold to 1.140-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 2842, or encoded by a nucleic acid molecule comprising the nucleic acid SEQ ID NO. 2841, or a homolog of said nucleic acid molecule or polypeptide, e.g. in case the activity of the *Escherichia coli* nucleic acid molecule or a polypeptide comprising the nucleic acid SEQ ID NO. 2841 or polypeptide SEQ ID NO. 2842, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2841 or polypeptide SEQ ID NO. 2842, respectively, is increased or generated or if the activity "glucitol/sorbitol-specific enzyme IIA component protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.133-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

In a further embodiment, in case the activity of a polypeptide according to the polypeptide SEQ ID NO. 2842, or encoded by a nucleic acid molecule comprising the nucleic acid SEQ ID NO. 2841, or a homolog of said nucleic acid molecule or polypeptide, e.g, in case the activity of the *Escherichia coli* nucleic acid molecule or a polypeptide comprising the nucleic acid SEQ ID NO. 2841 or polypeptide SEQ ID NO. 2842, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2841 or polypeptide SEQ ID NO. 2842, respectively, is increased or generated or if the activity "glucitol/sorbitol-specific enzyme IIA component protein" is increased or generated in a plant cell, plant or part thereof, especially if the polypeptide is plastidic localized, an increased drought tolerance as compared to a corresponding non-modified, e.g. a non-transformed, wild type plant cell, a plant or a part thereof is conferred. In one embodiment an increased cycling drought tolerance is conferred.

Particularly, an increase of yield from 1.05-fold to 1.192-fold, for example plus at least 100% thereof, under abiotic stress conditions, e.g. under drought conditions, in particular cycling drought conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 2880, or encoded by a nucleic acid molecule comprising the nucleic acid SEQ ID NO. 2879, or a homolog of said nucleic acid molecule or polypeptide, e.g. in case the activity of the *Escherichia coli* nucleic acid molecule or a polypeptide, respectively, comprising the nucleic acid SEQ ID NO. 2879 or polypeptide SEQ ID NO. 2880, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2879 or polypeptide SEQ ID NO. 2880, respectively, is increased or generated or if the activity "aminomethyltransferase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 2880, or encoded by a nucleic acid molecule comprising the nucleic acid SEQ ID NO. 2879, or a homolog of said nucleic acid molecule or polypeptide, e.g. in case the activity of the *Escherichia coli* nucleic acid molecule or a polypeptide comprising the nucleic acid SEQ ID NO. 2879 or polypeptide SEQ ID NO. 2880, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2879 or polypeptide SEQ ID NO. 2880, respectively, is increased or generated or if the activity "aminomethyltransferase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.289-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 2880, or encoded by a nucleic acid molecule comprising the nucleic acid SEQ ID NO. 2879, or a homolog of said nucleic acid molecule or polypeptide, e.g. in case the activity of the *Escherichia coli* nucleic acid molecule or a polypeptide comprising the nucleic acid SEQ ID NO. 2879 or polypeptide SEQ ID NO. 2880, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2879 or polypeptide SEQ ID NO. 2880, respectively, is increased or generated or if the activity "aminomethyltransferase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.104-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

In a further embodiment, in case the activity of a polypeptide according to the polypeptide SEQ ID NO. 2880, or encoded by a nucleic acid molecule comprising the nucleic acid SEQ ID NO. 2879, or a homolog of said nucleic acid molecule or polypeptide, e.g, in case the activity of the *Escherichia coli* nucleic acid molecule or a polypeptide comprising the nucleic acid SEQ ID NO. 2879 or polypeptide SEQ ID NO. 2880, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 2879 or polypeptide SEQ ID NO. 2880, respectively, is increased or generated or if the activity "aminomethyltransferase" is increased or generated in a plant cell, plant or part thereof, especially if the polypeptide is cytoplasmic localized, an increased drought tolerance as compared to a corresponding non-modified, e.g. a non-transformed, wild type plant cell, a plant or a part thereof is conferred. In one embodiment an increased cycling drought tolerance is conferred.

Particularly, an increase of yield from 1.05-fold to 1.233-fold, for example plus at least 100% thereof, under abiotic stress conditions, e.g. under drought conditions, in particular cycling drought conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 3110, or encoded by a nucleic acid molecule comprising the nucleic acid SEQ ID NO. 3109, or a homolog of said nucleic acid molecule or polypeptide, e.g. in case the activity of the *Escherichia coli* nucleic acid molecule or a polypeptide, respectively, comprising the nucleic acid SEQ ID NO. 3109 or polypeptide SEQ ID NO. 3110, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3109 or polypeptide SEQ ID NO. 3110, respectively, is increased or generated or if the activity "Phosphocarrier protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 3110, or encoded by a nucleic acid molecule comprising the nucleic acid SEQ ID NO. 3109, or a homolog of said nucleic acid molecule or polypeptide, e.g. in case the activity of the *Escherichia coli* nucleic acid molecule or a polypeptide comprising the nucleic acid SEQ ID NO. 3109 or polypeptide SEQ ID NO. 3110, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3109 or polypeptide SEQ ID NO. 3110, respectively, is increased or generated or if the activity "Phosphocarrier protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.304-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 3110, or encoded by a nucleic acid molecule comprising the nucleic acid SEQ ID NO. 3109, or a homolog of said nucleic acid molecule or polypeptide, e.g. in case the activity of the *Escherichia coli* nucleic acid molecule or a polypeptide comprising the nucleic acid SEQ ID NO. 3109 or polypeptide SEQ ID NO. 3110, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3109 or polypeptide SEQ ID NO. 3110, respectively, is increased or generated or if the activity "Phosphocarrier protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.160-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 3404, or encoded by a nucleic acid molecule comprising the nucleic acid SEQ ID NO. 3403, or a homolog of said nucleic acid molecule or polypeptide, e.g. in case the activity of the *Escherichia coli* nucleic acid molecule or a polypeptide, respectively, comprising the nucleic acid SEQ ID NO. 3403 or polypeptide SEQ ID NO. 3404, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3403 or polypeptide SEQ ID NO. 3404, respectively, is increased or generated or if the activity "two-module transport protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 3404, or encoded by a nucleic acid molecule comprising the nucleic acid SEQ ID NO. 3403, or a homolog of said nucleic acid molecule or polypeptide, e.g. in case the activity of the *Escherichia coli* nucleic acid molecule or a polypeptide comprising the nucleic acid SEQ ID NO. 3403 or polypeptide SEQ ID NO. 3404, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3403 or polypeptide SEQ ID NO. 3404, respectively, is increased or generated or if the activity "two-module transport protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.696-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 3404, or encoded by a nucleic acid molecule comprising the nucleic acid SEQ ID NO. 3403, or a homolog of said nucleic acid molecule or polypeptide, e.g. in case the activity of the *Escherichia coli* nucleic acid molecule or a polypeptide comprising the nucleic acid SEQ ID NO. 3403 or polypeptide SEQ ID NO. 3404, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3403 or polypeptide SEQ ID NO. 3404, respectively, is increased or generated or if the activity "two-module transport protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.435-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

In a further embodiment, in case the activity of a polypeptide according to the polypeptide SEQ ID NO. 3404, or encoded by a nucleic acid molecule comprising the nucleic acid SEQ ID NO. 3403, or a homolog of said nucleic acid molecule or polypeptide, e.g. in case the activity of the *Escherichia coli* nucleic acid molecule or a polypeptide comprising the nucleic acid SEQ ID NO. 3403 or polypeptide SEQ ID NO. 3404, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3403 or polypeptide SEQ ID NO. 3404, respectively, is increased or generated or if the activity "two-module transport protein" is increased or generated in a plant cell, plant or part thereof, especially if the polypeptide is cytoplasmic localized, an increased drought tolerance as compared to a corresponding non-modified, e.g. a non-transformed, wild type plant cell, a plant or a part thereof is conferred. In one embodiment an increased cycling drought tolerance is conferred.

Particularly, an increase of yield from 1.05-fold to 1.128-fold, for example plus at least 100% thereof, under abiotic stress conditions, e.g. under drought conditions, in particular cycling drought conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 3442, or encoded by a nucleic acid molecule comprising the nucleic acid SEQ ID NO. 3441, or a homolog of said nucleic acid molecule or polypeptide, e.g. in case the activity of the *Escherichia coli* nucleic acid molecule or a polypeptide, respectively, comprising the nucleic acid SEQ ID NO. 3441 or polypeptide SEQ ID NO. 3442, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3441 or polypeptide SEQ ID NO. 3442, respectively, is increased or generated or if the activity "GTP-binding protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 3442, or encoded by a nucleic acid molecule comprising the nucleic acid SEQ ID NO. 3441, or a homolog of said nucleic acid molecule or polypeptide, e.g. in case the activity of the *Escherichia coli* nucleic acid molecule or a polypeptide comprising the nucleic acid SEQ ID NO. 3441 or polypeptide SEQ ID NO. 3442, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3441 or polypeptide SEQ ID NO. 3442, respectively, is increased or generated or if the activity "GTP-binding protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.611-fold, for example plus at least 100% thereof, under conditions of low temperature is conferred compared to a corresponding non-modified, e.g. non-transformed, wild type plant cell, a plant or a part thereof.

Accordingly, in one embodiment, in case the activity of a polypeptide according to the polypeptide SEQ ID NO. 3979, or encoded by a nucleic acid molecule comprising the nucleic acid SEQ ID NO. 3978, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 3978 or polypeptide SEQ ID NO. 3979, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3978 or polypeptide SEQ ID NO. 3979, respectively, is increased or generated or if the activity "Peroxisomal targeting signal 2 receptor" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 3979, or encoded by a nucleic acid molecule comprising the nucleic acid SEQ ID NO. 3978, or a homolog of said nucleic acid molecule or polypeptide, e.g. in case the activity of the *Saccharomyces cerevisiae* nucleic acid molecule or a polypeptide comprising the nucleic acid SEQ ID NO. 3978 or polypeptide SEQ ID NO. 3979, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3978 or polypeptide SEQ ID NO. 3979, respectively, is increased or generated or if the activity "Peroxisomal targeting signal 2 receptor" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.274-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 3979, or encoded by a nucleic acid molecule comprising the nucleic acid SEQ ID NO. 3978, or a homolog of said nucleic acid molecule or polypeptide, e.g. in case the activity of the *Saccharomyces cerevisiae* nucleic acid molecule or a polypeptide comprising the nucleic acid SEQ ID NO. 3978 or polypeptide SEQ ID NO. 3979, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3978 or polypeptide SEQ ID NO. 3979, respectively, is increased or generated or if the activity "Peroxisomal targeting signal 2 receptor" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.305-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 3979, or encoded by a nucleic acid molecule comprising the nucleic acid SEQ ID NO. 3978, or a homolog of said nucleic acid molecule or polypeptide, e.g. in case the activity of the *Saccharomyces cerevisiae* nucleic acid molecule or a polypeptide comprising the nucleic acid SEQ ID NO. 3978 or polypeptide SEQ ID NO. 3979, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 3978 or polypeptide SEQ ID NO. 3979, respectively, is increased or generated or if the activity "Peroxisomal targeting signal 2 receptor" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.476-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4048, or encoded by a nucleic acid molecule comprising the nucleic acid SEQ ID NO. 4047, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4047 or polypeptide SEQ ID NO. 4048, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4047 or polypeptide SEQ ID NO. 4048, respectively, is increased or generated or if the activity "yer175w-a-protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4048, or encoded by a nucleic acid molecule comprising the nucleic acid SEQ ID NO. 4047, or a homolog of said nucleic acid molecule or polypeptide, e.g. in case the activity of the *Saccharomyces cerevisiae* nucleic acid molecule or a polypeptide comprising the nucleic acid SEQ ID NO. 4047 or polypeptide SEQ ID NO. 4048, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4047 or polypeptide SEQ ID NO. 4048, respectively, is increased or generated or if the activity "yer175w-a-protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 2.340-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 4048, or encoded by a nucleic acid molecule comprising the nucleic acid SEQ ID NO. 4047, or a homolog of said nucleic acid molecule or polypeptide, e.g. in case the activity of the *Saccharomyces cerevisiae* nucleic acid molecule or a polypeptide comprising the nucleic acid SEQ ID NO. 4047 or polypeptide SEQ ID NO. 4048, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4047 or polypeptide SEQ ID NO. 4048, respectively, is increased or generated or if the activity "yer175w-a-protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.370-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4052, or encoded by a nucleic acid molecule comprising the nucleic acid SEQ ID NO. 4051, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4051 or polypeptide SEQ ID NO. 4052, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4051 or polypeptide SEQ ID NO. 4052, respectively, is increased or generated or if the activity "hexose transporter" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4052, or encoded by a nucleic acid molecule comprising the nucleic acid SEQ ID NO. 4051, or a homolog of said nucleic acid molecule or polypeptide, e.g. in case the activity of the *Saccharomyces cerevisiae* nucleic acid molecule or a polypeptide comprising the nucleic acid SEQ ID NO. 4051 or polypeptide SEQ ID NO. 4052, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4051 or polypeptide SEQ ID NO. 4052, respectively, is increased or generated or if the activity "hexose transporter" is increased or generated in a plant cell, plant or part thereof, especially, if the polypeptide tide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.271-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 4052, or encoded by a nucleic acid molecule comprising the nucleic acid SEQ ID NO. 4051, or a homolog of said nucleic acid molecule or polypeptide, e.g. in case the activity of the *Saccharomyces cerevisiae* nucleic acid molecule or a polypeptide comprising the nucleic acid SEQ ID NO. 4051 or polypeptide SEQ ID NO. 4052, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4051 or polypeptide SEQ ID NO. 4052, respectively, is increased or generated or if the activity "hexose transporter" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.256-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 4052, or encoded by a nucleic acid molecule comprising the nucleic acid SEQ ID NO. 4051, or a homolog of said nucleic acid molecule or polypeptide, e.g. in case the activity of the *Saccharomyces cerevisiae* nucleic acid molecule or a polypeptide comprising the nucleic acid SEQ ID NO. 4051 or polypeptide SEQ ID NO. 4052, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4051 or polypeptide SEQ ID NO. 4052, respectively, is increased or generated or if the activity "hexose transporter" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.398-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

In a further embodiment, in case the activity of a polypeptide according to the polypeptide SEQ ID NO. 4052, or encoded by a nucleic acid molecule comprising the nucleic acid SEQ ID NO. 4051, or a homolog of said nucleic acid molecule or polypeptide, e.g. in case the activity of the *Saccharomyces cerevisiae* nucleic acid molecule or a polypeptide comprising the nucleic acid SEQ ID NO. 4051 or polypeptide SEQ ID NO. 4052, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4051 or polypeptide SEQ ID NO. 4052, respectively, is increased or generated or if the activity "hexose transporter" is increased or generated in a plant cell, plant or part thereof, especially if the polypeptide is plastidic localized, an increased drought tolerance as compared to a corresponding non-modified, e.g. a non-transformed, wild type plant cell, a plant or a part thereof is conferred. In one embodiment an increased cycling drought tolerance is conferred.

Particularly, an increase of yield from 1.05-fold to 1.324-fold, for example plus at least 100% thereof, under abiotic stress conditions, e.g. under drought conditions, in particular cycling drought conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4132, or encoded by a nucleic acid molecule comprising the nucleic acid SEQ ID NO. 4131, or a homolog of said nucleic acid molecule or polypeptide, e.g. in case the activity of the *Saccharomyces cerevisiae* nucleic acid molecule or a polypeptide, respectively, comprising the nucleic acid SEQ ID NO.

4131 or polypeptide SEQ ID NO. 4132, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4131 or polypeptide SEQ ID NO. 4132, respectively, is increased or generated or if the activity "2-deoxyglucose-6-phosphate phosphatase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4132, or encoded by a nucleic acid molecule comprising the nucleic acid SEQ ID NO. 4131, or a homolog of said nucleic acid molecule or polypeptide, e.g. in case the activity of the *Saccharomyces cerevisiae* nucleic acid molecule or a polypeptide comprising the nucleic acid SEQ ID NO. 4131 or polypeptide SEQ ID NO. 4132, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4131 or polypeptide SEQ ID NO. 4132, respectively, is increased or generated or if the activity "2-deoxyglucose-6-phosphate phosphatase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.215-fold, for example plus at least 100% thereof, under conditions of low temperature is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4218, or encoded by a nucleic acid molecule comprising the nucleic acid SEQ ID NO. 4217, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4217 or polypeptide SEQ ID NO. 4218, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4217 or polypeptide SEQ ID NO. 4218, respectively, is increased or generated or if the activity "lanosterol synthase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4218, or encoded by a nucleic acid molecule comprising the nucleic acid SEQ ID NO. 4217, or a homolog of said nucleic acid molecule or polypeptide, e.g. in case the activity of the *Saccharomyces cerevisiae* nucleic acid molecule or a polypeptide comprising the nucleic acid SEQ ID NO. 4217 or polypeptide SEQ ID NO. 4218, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4217 or polypeptide SEQ ID NO. 4218, respectively, is increased or generated or if the activity "lanosterol synthase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.387-fold, for example plus at least 100% thereof, under conditions of low temperature is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4492, or encoded by a nucleic acid molecule comprising the nucleic acid SEQ ID NO. 4491, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4491 or polypeptide SEQ ID NO. 4492, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4491 or polypeptide SEQ ID NO. 4492, respectively, is increased or generated or if the activity "yhr213w-a-protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4492, or encoded by a nucleic acid molecule comprising the nucleic acid SEQ ID NO. 4491, or a homolog of said nucleic acid molecule or polypeptide, e.g. in case the activity of the *Saccharomyces cerevisiae* nucleic acid molecule or a polypeptide comprising the nucleic acid SEQ ID NO. 4491 or polypeptide SEQ ID NO. 4492, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4491 or polypeptide SEQ ID NO. 4492, respectively, is increased or generated or if the activity "yhr213w-a-protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.570-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 4492, or encoded by a nucleic acid molecule comprising the nucleic acid SEQ ID NO. 4491, or a homolog of said nucleic acid molecule or polypeptide, e.g. in case the activity of the *Saccharomyces cerevisiae* nucleic acid molecule or a polypeptide comprising the nucleic acid SEQ ID NO. 4491 or polypeptide SEQ ID NO. 4492, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4491 or polypeptide SEQ ID NO. 4492, respectively, is increased or generated or if the activity "yhr213w-a-protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.407-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4496, or encoded by a nucleic acid molecule comprising the nucleic acid SEQ ID NO. 4495, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4495 or polypeptide SEQ ID NO. 4496, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4495 or polypeptide SEQ ID NO. 4496, respectively, is increased or generated or if the activity "(DL)-glycerol-3-phosphatase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4496, or encoded by a nucleic acid molecule comprising the nucleic acid SEQ ID NO. 4495, or a homolog of said nucleic acid molecule or polypeptide, e.g. in case the activity of the *Saccharomyces cerevisiae* nucleic acid molecule or a polypeptide comprising the nucleic acid SEQ ID NO. 4495 or polypeptide SEQ ID NO. 4496, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4495 or polypeptide SEQ ID NO. 4496, respectively, is increased or generated or if the activity "(DL)-glycerol-3-phosphatase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.523-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 4496, or encoded by a nucleic acid molecule comprising the nucleic acid SEQ ID NO. 4495, or a homolog of said nucleic acid molecule or polypeptide, e.g. in case the activity of the *Saccharomyces cerevisiae* nucleic acid molecule or a polypeptide comprising the nucleic acid SEQ ID NO. 4495 or polypeptide SEQ ID NO. 4496, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4495 or polypeptide SEQ ID NO. 4496, respectively, is increased or generated or if the activity "(DL)-glycerol-3-phosphatase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.498-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 4496, or encoded by a nucleic acid molecule comprising the nucleic acid SEQ ID NO. 4495, or a homolog of said nucleic acid molecule or polypeptide, e.g. in case the activity of the *Saccharomyces cerevisiae* nucleic acid molecule or a polypeptide comprising the nucleic acid SEQ ID NO. 4495 or polypeptide SEQ ID NO. 4496, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4495 or polypeptide SEQ ID NO. 4496, respectively, is increased or generated or if the activity "(DL)-glycerol-3-phosphatase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.383-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4559, or encoded by a nucleic acid molecule comprising the nucleic acid SEQ ID NO. 4558, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4558 or polypeptide SEQ ID NO. 4559, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4558 or polypeptide SEQ ID NO. 4559, respectively, is increased or generated or if the activity "transcriptional regulatory protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4559, or encoded by a nucleic acid molecule comprising the nucleic acid SEQ ID NO. 4558, or a homolog of said nucleic acid molecule or polypeptide, e.g. in case the activity of the *Saccharomyces cerevisiae* nucleic acid molecule or a polypeptide comprising the nucleic acid SEQ ID NO. 4558 or polypeptide SEQ ID NO. 4559, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4558 or polypeptide SEQ ID NO. 4559, respectively, is increased or generated or if the activity "transcriptional regulatory protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.296-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 4559, or encoded by a nucleic acid molecule comprising the nucleic acid SEQ ID NO. 4558, or a homolog of said nucleic acid molecule or polypeptide, e.g. in case the activity of the *Saccharomyces cerevisiae* nucleic acid molecule or a polypeptide comprising the nucleic acid SEQ ID NO. 4558 or polypeptide SEQ ID NO. 4559, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4558 or polypeptide SEQ ID NO. 4559, respectively, is increased or generated or if the activity "transcriptional regulatory protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.175-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4590, or encoded by a nucleic acid molecule comprising the nucleic acid SEQ ID NO. 4589, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4589 or polypeptide SEQ ID NO. 4590, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4589 or polypeptide SEQ ID NO. 4590, respectively, is increased or generated or if the activity "Glycogen synthesis initiator protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4590, or encoded by a nucleic acid molecule comprising the nucleic acid SEQ ID NO. 4589, or a homolog of said nucleic acid molecule or polypeptide, e.g. in case the activity of the *Saccharomyces cerevisiae* nucleic acid molecule or a polypeptide comprising the nucleic acid SEQ ID NO. 4589 or polypeptide SEQ ID NO. 4590, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4589 or polypeptide SEQ ID NO. 4590, respectively, is increased or generated or if the activity "Glycogen synthesis initiator protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.48-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 4590, or encoded by a nucleic acid molecule comprising the nucleic acid SEQ ID NO. 4589, or a homolog of said nucleic acid molecule or polypeptide, e.g. in case the activity of the *Saccharomyces cerevisiae* nucleic acid molecule or a polypeptide comprising the nucleic acid SEQ ID NO. 4589 or polypeptide SEQ ID NO. 4590, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4589 or polypeptide SEQ ID NO. 4590, respectively, is increased or generated or if the activity "Glycogen synthesis initiator protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.065-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 4623, or encoded by a nucleic acid molecule comprising the nucleic acid SEQ ID NO. 4622, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 4622 or polypeptide SEQ ID NO. 4623, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4622 or polypeptide SEQ ID NO. 4623, respectively, is increased or generated or if the activity "aspartate aminotransferase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 4623, or encoded by a nucleic acid molecule comprising the nucleic acid SEQ ID NO. 4622, or a homolog of said nucleic acid molecule or polypeptide, e.g. in case the activity of the *Saccharomyces cerevisiae* nucleic acid molecule or a polypeptide comprising the nucleic acid SEQ ID NO. 4622 or polypeptide SEQ ID NO. 4623, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4622 or polypeptide SEQ ID NO. 4623, respectively, is increased or generated or if the activity "aspartate aminotransferase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.848-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 4623, or encoded by a nucleic acid molecule comprising the nucleic acid SEQ ID NO. 4622, or a homolog of said nucleic acid molecule or polypeptide, e.g. in case the activity of the *Saccharomyces cerevisiae* nucleic acid molecule or a polypeptide comprising the nucleic acid SEQ ID NO. 4622 or polypeptide SEQ ID NO. 4623, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4622 or polypeptide SEQ ID NO. 4623, respectively, is increased or generated or if the activity "aspartate aminotransferase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.172-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 4623, or encoded by a nucleic acid molecule comprising the nucleic acid SEQ ID NO. 4622, or a homolog of said nucleic acid molecule or polypeptide, e.g. in case the activity of the *Saccharomyces cerevisiae* nucleic acid molecule or a polypeptide comprising the nucleic acid SEQ ID NO. 4622 or polypeptide SEQ ID NO. 4623, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 4622 or polypeptide SEQ ID NO. 4623, respectively, is increased or generated or if the activity "aspartate aminotransferase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.329-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 5071, or encoded by a nucleic acid molecule comprising the nucleic acid SEQ ID NO. 5070, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 5070 or polypeptide SEQ ID NO. 5071, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5070 or polypeptide SEQ ID NO. 5071, respectively, is increased or generated or if the activity "YML079W-protein" is increased or generated in a plant cell, plant or part thereof, especially if localized plastidic and/or cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 5071, or encoded by a nucleic acid molecule comprising the nucleic acid SEQ ID NO. 5070, or a homolog of said nucleic acid molecule or polypeptide, e.g. in case the activity of the *Saccharomyces cerevisiae* nucleic acid molecule or a polypeptide comprising the nucleic acid SEQ ID NO. 5070 or polypeptide SEQ ID NO. 5071, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5070 or polypeptide SEQ ID NO. 5071, respectively, is increased or generated or if the activity "YML079W-protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, expressing under the control of a plastidic signal sequence, an increase of yield from 1.1-fold to 1.331-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 5071, or encoded by a nucleic acid molecule comprising the nucleic acid SEQ ID NO. 5070, or a homolog of said nucleic acid molecule or polypeptide, e.g. in case the activity of the *Saccharomyces cerevisiae* nucleic acid molecule or a polypeptide comprising the nucleic acid SEQ ID NO. 5070 or polypeptide SEQ ID NO. 5071, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5070 or polypeptide SEQ ID NO. 5071, respectively, is increased or generated or if the activity "YML079W-protein" is increased or generated in a plant cell, plant or part thereof, especially if the polypeptide tide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, expressing without combining said sequence or molecule with a further targeting or signal sequence, e.g. without a further heterologous target sequence or signal sequence as described herein, an increase of yield from 1.05-fold to 1.057 (cytoplasmic)-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 5071, or encoded by a nucleic acid molecule comprising the nucleic acid SEQ ID NO. 5070, or a homolog of said nucleic acid molecule or polypeptide, e.g. in case the activity of the *Saccharomyces cerevisiae* nucleic acid molecule or a polypeptide comprising the nucleic acid SEQ ID NO. 5070 or polypeptide SEQ ID NO. 5071, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5070 or polypeptide SEQ ID NO. 5071, respectively, is increased or generated or if the activity "YML079W-protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, expressing under the control of a plastidic signal sequence, an increase of yield from 1.05-fold to 1.066-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 5103, or encoded by a nucleic acid molecule comprising the nucleic acid SEQ ID NO. 5102, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 5102 or polypeptide SEQ ID NO. 5103, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5102 or polypeptide SEQ ID NO. 5103, respectively, is increased or generated or if the activity "YMR157C-protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 5103, or encoded by a nucleic acid molecule comprising the nucleic acid SEQ ID NO. 5102, or a homolog of said nucleic acid molecule or polypeptide, e.g. in case the activity of the *Saccharomyces cerevisiae* nucleic acid molecule or a polypeptide comprising the nucleic acid SEQ ID NO. 5102 or polypeptide SEQ ID NO. 5103, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5102 or polypeptide SEQ ID NO. 5103, respectively, is increased or generated or if the activity "YMR157C-protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.267-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 5103, or encoded by a nucleic acid molecule comprising the nucleic acid SEQ ID NO. 5102, or a homolog of said nucleic acid molecule or polypeptide, e.g. in case the activity of the *Saccharomyces cerevisiae* nucleic acid molecule or a polypeptide comprising the nucleic acid SEQ ID NO. 5102 or polypeptide SEQ ID NO. 5103, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5102 or polypeptide SEQ ID NO. 5103, respectively, is increased or generated or if the activity "YMR157C-protein" is increased or generated in a plant cell, plant or part thereof, especially if the polypeptide tide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.211-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 5116, or encoded by a nucleic acid molecule comprising the nucleic acid SEQ ID NO. 5115, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 5115 or polypeptide SEQ ID NO. 5116, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5115 or polypeptide SEQ ID NO. 5116, respectively, is increased or generated or if the activity "YNL024C-protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 5116, or encoded by a nucleic acid molecule comprising the nucleic acid SEQ ID NO. 5115, or a homolog of said nucleic acid molecule or polypeptide, e.g. in case the activity of the *Saccharomyces cerevisiae* nucleic acid molecule or a polypeptide comprising the nucleic acid SEQ ID NO. 5115 or polypeptide SEQ ID NO. 5116, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5115 or polypeptide SEQ ID NO. 5116, respectively, is increased or generated or if the activity "YNL024C-protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.376-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 5116, or encoded by a nucleic acid molecule comprising the nucleic acid SEQ ID NO. 5115, or a homolog of said nucleic acid molecule or polypeptide, e.g. in case the activity of the *Saccharomyces cerevisiae* nucleic acid molecule or a polypeptide comprising the nucleic acid SEQ ID NO. 5115 or polypeptide SEQ ID NO. 5116, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5115 or polypeptide SEQ ID NO. 5116, respectively, is increased or generated or if the activity "YNL024C-protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.068-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 5160, or encoded by a nucleic acid molecule comprising the nucleic acid SEQ ID NO. 5159, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 5159 or polypeptide SEQ ID NO. 5160, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5159 or polypeptide SEQ ID NO. 5160, respectively, is increased or generated or if the activity "Argininosuccinate synthase" is increased or generated in a plant cell, plant or part thereof, especially if localized plastidic and/or cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 5160, or encoded by a nucleic acid molecule comprising the nucleic acid SEQ ID NO. 5159, or a homolog of said nucleic acid molecule or polypeptide, e.g. in case the activity of the *Saccharomyces cerevisiae* nucleic acid molecule or a polypeptide comprising the nucleic acid SEQ ID NO. 5159 or polypeptide SEQ ID NO. 5160, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5159 or polypeptide SEQ ID NO. 5160, respectively, is increased or generated or if the activity "Argininosuccinate synthase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, expressing under the control of a plastidic signal sequence, an increase of yield from 1.1-fold to 1.300-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 5160, or encoded by a nucleic acid molecule comprising the nucleic acid SEQ ID NO. 5159, or a homolog of said nucleic acid molecule or polypeptide, e.g. in case the activity of the *Saccharomyces cerevisiae* nucleic acid molecule or a polypeptide comprising the nucleic acid SEQ ID NO. 5159 or polypeptide SEQ ID NO. 5160, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5159 or polypeptide SEQ ID NO. 5160, respectively, is increased or generated or if the activity "Argininosuccinate synthase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Expressing without combining said sequence or molecule with a further targeting or signal sequence, e.g. without a further heterologous target sequence or signal sequence as described herein, an increase of yield from 1.05-fold to 1.172 (cytoplasmic)-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 5160, or encoded by a nucleic acid molecule comprising the nucleic acid SEQ ID NO. 5159, or a homolog of said nucleic acid molecule or polypeptide, e.g. in case the activity of the *Saccharomyces cerevisiae* nucleic acid molecule or a polypeptide comprising the nucleic acid SEQ ID NO. 5159 or polypeptide SEQ ID NO. 5160, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5159 or polypeptide SEQ ID NO. 5160, respectively, is increased or generated or if the activity "Argininosuccinate synthase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, expressing under the control of a plastidic signal sequence, an increase of yield from 1.05-fold to 1.091-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 5747, or encoded by a nucleic acid molecule comprising the nucleic acid SEQ ID NO. 5746, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 5746 or polypeptide SEQ ID NO. 5747, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5746 or polypeptide SEQ ID NO. 5747, respectively, is increased or generated or if the activity "subunit of TORC1" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 5747, or encoded by a nucleic acid molecule comprising the nucleic acid SEQ ID NO. 5746, or a homolog of said nucleic acid molecule or polypeptide, e.g. in case the activity of the *Saccharomyces cerevisiae* nucleic acid molecule or a polypeptide comprising the nucleic acid SEQ ID NO. 5746 or polypeptide SEQ ID NO. 5747, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5746 or polypeptide SEQ ID NO. 5747, respectively, is increased or generated or if the activity "subunit of TORC1" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 2.471-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 5747, or encoded by a nucleic acid molecule comprising the nucleic acid SEQ ID NO. 5746, or a homolog of said nucleic acid molecule or polypeptide, e.g. in case the activity of the *Saccharomyces cerevisiae* nucleic acid molecule or a polypeptide comprising the nucleic acid SEQ ID NO. 5746 or polypeptide SEQ ID NO. 5747, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5746 or polypeptide SEQ ID NO. 5747, respectively, is increased or generated or if the activity "subunit of TORC1" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.169-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 5747, or encoded by a nucleic acid molecule comprising the nucleic acid SEQ ID NO. 5746, or a homolog of said nucleic acid molecule or polypeptide, e.g. in case the activity of the *Saccharomyces cerevisiae* nucleic acid molecule or a polypeptide comprising the nucleic acid SEQ ID NO. 5746 or polypeptide SEQ ID NO. 5747, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5746 or polypeptide SEQ ID NO. 5747, respectively, is increased or generated or if the activity "subunit of TORC1" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.326-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 5757, or encoded by a nucleic acid molecule comprising the nucleic acid SEQ ID NO. 5756, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 5756 or polypeptide SEQ ID NO. 5757, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5756 or polypeptide SEQ ID NO. 5757, respectively, is increased or generated or if the activity "Phosphoadenosine phosphosulfate reductase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 5757, or encoded by a nucleic acid molecule comprising the nucleic acid SEQ ID NO. 5756, or a homolog of said nucleic acid molecule or polypeptide, e.g. in case the activity of the *Saccharomyces cerevisiae* nucleic acid molecule or a polypeptide comprising the nucleic acid SEQ ID NO. 5756 or polypeptide SEQ ID NO. 5757, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5756 or polypeptide SEQ ID NO. 5757, respectively, is increased or generated or if the activity "Phosphoadenosine phosphosulfate reductase" is increased or generated in a plant cell, plant or part thereof, especially if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.303-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 5757, or encoded by a nucleic acid molecule comprising the nucleic acid SEQ ID NO. 5756, or a homolog of said nucleic acid molecule or polypeptide, e.g. in case the activity of the *Saccharomyces cerevisiae* nucleic acid molecule or a polypeptide comprising the nucleic acid SEQ ID NO. 5756 or polypeptide SEQ ID NO. 5757, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 5756 or polypeptide SEQ ID NO. 5757, respectively, is increased or generated or if the activity "Phosphoadenosine phosphosulfate reductase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.219-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 6087, or encoded by a nucleic acid molecule comprising the nucleic acid SEQ ID NO. 6086, or a homolog of said nucleic acid molecule or polypeptide, e.g. in case the activity of the *Escherichia coli* nucleic acid molecule or a polypeptide, respectively, comprising the nucleic acid SEQ ID NO. 6086 or polypeptide SEQ ID NO. 6087, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6086 or polypeptide SEQ ID NO. 6087, respectively, is increased or generated or if the activity "Enoyl CoA hydratase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 6087, or encoded by a nucleic acid molecule comprising the nucleic acid SEQ ID NO. 6086, or a homolog of said nucleic acid molecule or polypeptide, e.g. in case the activity of the *Escherichia coli* nucleic acid molecule or a polypeptide comprising the nucleic acid SEQ ID NO. 6086 or polypeptide SEQ ID NO. 6087, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6086 or polypeptide SEQ ID NO. 6087, respectively, is increased or generated or if the activity "Enoyl CoA hydratase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.336-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 6087, or encoded by a nucleic acid molecule comprising the nucleic acid SEQ ID NO. 6086, or a homolog of said nucleic acid molecule or polypeptide, e.g. in case the activity of the *Escherichia coli* nucleic acid molecule or a polypeptide comprising the nucleic acid SEQ ID NO. 6086 or polypeptide SEQ ID NO. 6087, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6086 or polypeptide SEQ ID NO. 6087, respectively, is increased or generated or if the activity "Enoyl CoA hydratase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.117-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 6582, or encoded by a nucleic acid molecule comprising the nucleic acid SEQ ID NO. 6581, or a homolog of said nucleic acid molecule or polypeptide, e.g. in case the activity of the *Escherichia coli* nucleic acid molecule or a polypeptide, respectively, comprising the nucleic acid SEQ ID NO. 6581 or polypeptide SEQ ID NO. 6582, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6581 or polypeptide SEQ ID NO. 6582, respectively, is increased or generated or if the activity "B1906-protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 6582, or encoded by a nucleic acid molecule comprising the nucleic acid SEQ ID NO. 6581, or a homolog of said nucleic acid molecule or polypeptide, e.g. in case the activity of the *Escherichia coli* nucleic acid molecule or a polypeptide comprising the nucleic acid SEQ ID NO. 6581 or polypeptide SEQ ID NO. 6582, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6581 or polypeptide SEQ ID NO. 6582, respectively, is increased or generated or if the activity "B1906-protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.290-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 6582, or encoded by a nucleic acid molecule comprising the nucleic acid SEQ ID NO. 6581, or a homolog of said nucleic acid molecule or polypeptide, e.g. in case the activity of the *Escherichia coli* nucleic acid molecule or a polypeptide comprising the nucleic acid SEQ ID NO. 6581 or polypeptide SEQ ID NO. 6582, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6581 or polypeptide SEQ ID NO. 6582, respectively, is increased or generated or if the activity "B1906-protein" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.321-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 6582, or encoded by a nucleic acid molecule comprising the nucleic acid SEQ ID NO. 6581, or a homolog of said nucleic acid molecule or polypeptide, e.g. in case the activity of the *Escherichia coli* nucleic acid molecule or a polypeptide comprising the nucleic acid SEQ ID NO. 6581 or polypeptide SEQ ID NO. 6582, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6581 or polypeptide SEQ ID NO. 6582, respectively, is increased or generated or if the activity "B1906-protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.092-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 6610, or encoded by a nucleic acid molecule comprising the nucleic acid SEQ ID NO. 6609, or a homolog of said nucleic acid molecule or polypeptide, e.g. in case the activity of the *Escherichia coli* nucleic acid molecule or a polypeptide, respectively, comprising the nucleic acid SEQ ID NO. 6609 or polypeptide SEQ ID NO. 6610, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6609 or polypeptide SEQ ID NO. 6610, respectively, is increased or generated or if the activity "CoA-transferase-like protein (NAD(P)-binding)" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 6610, or encoded by a nucleic acid molecule comprising the nucleic acid SEQ ID NO. 6609, or a homolog of said nucleic acid molecule or polypeptide, e.g. in case the activity of the *Escherichia coli* nucleic acid molecule or a polypeptide comprising the nucleic acid SEQ ID NO. 6609 or polypeptide SEQ ID NO. 6610, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6609 or polypeptide SEQ ID NO. 6610, respectively, is increased or generated or if the activity "CoA-transferase-like protein (NAD(P)-binding)" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.328-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 6610, or encoded by a nucleic acid molecule comprising the nucleic acid SEQ ID NO. 6609, or a homolog of said nucleic acid molecule or polypeptide, e.g. in case the activity of the *Escherichia coli* nucleic acid molecule or a polypeptide comprising the nucleic acid SEQ ID NO. 6609 or polypeptide SEQ ID NO. 6610, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6609 or polypeptide SEQ ID NO. 6610, respectively, is increased or generated or if the activity "CoA-transferase-like protein (NAD(P)-binding)" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.261-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 6610, or encoded by a nucleic acid molecule comprising the nucleic acid SEQ ID NO. 6609, or a homolog of said nucleic acid molecule or polypeptide, e.g. in case the activity of the *Escherichia coli* nucleic acid molecule or a polypeptide comprising the nucleic acid SEQ ID NO. 6609 or polypeptide SEQ ID NO. 6610, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6609 or polypeptide SEQ ID NO. 6610, respectively, is increased or generated or if the activity "CoA-transferase-like protein (NAD(P)-binding)" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.121-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 6950, or encoded by a nucleic acid molecule comprising the nucleic acid SEQ ID NO. 6949, or a homolog of said nucleic acid molecule or polypeptide, e.g. in case the activity of the *Escherichia coli* nucleic acid molecule or a polypeptide, respectively, comprising the nucleic acid SEQ ID NO. 6949 or polypeptide SEQ ID NO. 6950, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6949 or polypeptide SEQ ID NO. 6950, respectively, is increased or generated or if the activity "Molybdenum-binding subunit of aldehyde oxidases and xanthine dehydrogenases" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 6950, or encoded by a nucleic acid molecule comprising the nucleic acid SEQ ID NO. 6949, or a homolog of said nucleic acid molecule or polypeptide, e.g. in case the activity of the *Escherichia coli* nucleic acid molecule or a polypeptide comprising the nucleic acid SEQ ID NO. 6949 or polypeptide SEQ ID NO. 6950, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6949 or polypeptide SEQ ID NO. 6950, respectively, is increased or generated or if the activity "Molybdenum-binding subunit of aldehyde oxidases and xanthine dehydrogenases" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.230-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 6950, or encoded by a nucleic acid molecule comprising the nucleic acid SEQ ID NO. 6949, or a homolog of said nucleic acid molecule or polypeptide, e.g. in case the activity of the *Escherichia coli* nucleic acid molecule or a polypeptide comprising the nucleic acid SEQ ID NO. 6949 or polypeptide SEQ ID NO. 6950, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6949 or polypeptide SEQ ID NO. 6950, respectively, is increased or generated or if the activity "Molybdenum-binding subunit of aldehyde oxidases and xanthine dehydrogenases" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.202-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 6950, or encoded by a nucleic acid molecule comprising the nucleic acid SEQ ID NO. 6949, or a homolog of said nucleic acid molecule or polypeptide, e.g. in case the activity of the *Escherichia coli* nucleic acid molecule or a polypeptide comprising the nucleic acid SEQ ID NO. 6949 or polypeptide SEQ ID NO. 6950, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 6949 or polypeptide SEQ ID NO. 6950, respectively, is increased or generated or if the activity "Molybdenum-binding subunit of aldehyde oxidases and xanthine dehydrogenases" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.074-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 7079, or encoded by a nucleic acid molecule comprising the nucleic acid SEQ ID NO. 7078, or a homolog of said nucleic acid molecule or polypeptide, e.g. in case the activity of the *Escherichia coli* nucleic acid molecule or a polypeptide, respectively, comprising the nucleic acid SEQ ID NO. 7078 or polypeptide SEQ ID NO. 7079, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7078 or polypeptide SEQ ID NO. 7079, respectively, is increased or generated or if the activity "Pirin-like protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 7079, or encoded by a nucleic acid molecule comprising the nucleic acid SEQ ID NO. 7078, or a homolog of said nucleic acid molecule or polypeptide, e.g. in case the activity of the *Escherichia coli* nucleic acid molecule or a polypeptide comprising the nucleic acid SEQ ID NO. 7078 or polypeptide SEQ ID NO. 7079, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the nucleic acid molecule SEQ ID NO. 7078 or polypeptide SEQ ID NO. 7079, respectively, is increased or generated or if the activity "Pirin-like protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.381-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 7079, or encoded by a nucleic acid molecule comprising the nucleic acid SEQ ID NO. 7078, or a homolog of said nucleic acid molecule or polypeptide, e.g. in case the activity of the *Escherichia coli* nucleic acid molecule or a polypeptide comprising the nucleic acid SEQ ID NO. 7078 or polypeptide SEQ ID NO. 7079, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7078 or polypeptide SEQ ID NO. 7079, respectively, is increased or generated or if the activity "Pirin-like protein" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.533-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 7079, or encoded by a nucleic acid molecule comprising the nucleic acid SEQ ID NO. 7078, or a homolog of said nucleic acid molecule or polypeptide, e.g. in case the activity of the *Escherichia coli* nucleic acid molecule or a polypeptide comprising the nucleic acid SEQ ID NO. 7078 or polypeptide SEQ ID NO. 7079, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7078 or polypeptide SEQ ID NO. 7079, respectively, is increased or generated or if the activity "Pirin-like protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.082-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 7271, or encoded by a nucleic acid molecule comprising the nucleic acid SEQ ID NO. 7270, or a homolog of said nucleic acid molecule or polypeptide, e.g. in case the activity of the *Escherichia coli* nucleic acid molecule or a polypeptide, respectively, comprising the nucleic acid SEQ ID NO. 7270 or polypeptide SEQ ID NO. 7271, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7270 or polypeptide SEQ ID NO. 7271, respectively, is increased or generated or if the activity "Heat shock protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 7271, or encoded by a nucleic acid molecule comprising the nucleic acid SEQ ID NO. 7270, or a homolog of said nucleic acid molecule or polypeptide, e.g. in case the activity of the *Escherichia coli* nucleic acid molecule or a polypeptide comprising the nucleic acid SEQ ID NO. 7270 or polypeptide SEQ ID NO. 7271, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7270 or polypeptide SEQ ID NO. 7271, respectively, is increased or generated or if the activity "Heat shock protein" is increased or generated in a plant cell, plant or part thereof, especially if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.394-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 7271, or encoded by a nucleic acid molecule comprising the nucleic acid SEQ ID NO. 7270, or a homolog of said nucleic acid molecule or polypeptide, e.g. in case the activity of the *Escherichia coli* nucleic acid molecule or a polypeptide comprising the nucleic acid SEQ ID NO. 7270 or polypeptide SEQ ID NO. 7271, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7270 or polypeptide SEQ ID NO. 7271, respectively, is increased or generated or if the activity "Heat shock protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.191-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 7468, or encoded by a nucleic acid molecule comprising the nucleic acid SEQ ID NO. 7467, or a homolog of said nucleic acid molecule or polypeptide, e.g. in case the activity of the *Escherichia coli* nucleic acid molecule or a polypeptide, respectively, comprising the nucleic acid SEQ ID NO. 7467 or polypeptide SEQ ID NO. 7468, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7467 or polypeptide SEQ ID NO. 7468, respectively, is increased or generated or if the activity "B3410-protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 7468, or encoded by a nucleic acid molecule comprising the nucleic acid SEQ ID NO. 7467, or a homolog of said nucleic acid molecule or polypeptide, e.g. in case the activity of the *Escherichia coli* nucleic acid molecule or a polypeptide comprising the nucleic acid SEQ ID NO. 7467 or polypeptide SEQ ID NO. 7468, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7467 or polypeptide SEQ ID NO. 7468, respectively, is increased or generated or if the activity "B3410-protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.420-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 7468, or encoded by a nucleic acid molecule comprising the nucleic acid SEQ ID NO. 7467, or a homolog of said nucleic acid molecule or polypeptide, e.g. in case the activity of the *Escherichia coli* nucleic acid molecule or a polypeptide comprising the nucleic acid SEQ ID NO. 7467 or polypeptide SEQ ID NO. 7468, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7467 or polypeptide SEQ ID NO. 7468, respectively, is increased or generated or if the activity "B3410-protein" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.286-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 7468, or encoded by a nucleic acid molecule comprising the nucleic acid SEQ ID NO. 7467, or a homolog of said nucleic acid molecule or polypeptide, e.g. in case the activity of the *Escherichia coli* nucleic acid molecule or a polypeptide comprising the nucleic acid SEQ ID NO. 7467 or polypeptide SEQ ID NO. 7468, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7467 or polypeptide SEQ ID NO. 7468, respectively, is increased or generated or if the activity "B3410-protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.167-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 7493, or encoded by a nucleic acid molecule comprising the nucleic acid SEQ ID NO. 7492, or a homolog of said nucleic acid molecule or polypeptide, e.g. in case the activity of the *Escherichia coli* nucleic acid molecule or a polypeptide, respectively, comprising the nucleic acid SEQ ID NO. 7492 or polypeptide SEQ ID NO. 7493, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7492 or polypeptide SEQ ID NO. 7493, respectively, is increased or generated or if the activity "Regulator of cell morphogenesis and NO signaling" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 7493, or encoded by a nucleic acid molecule comprising the nucleic acid SEQ ID NO. 7492, or a homolog of said nucleic acid molecule or polypeptide, e.g. in case the activity of the *Escherichia coli* nucleic acid molecule or a polypeptide comprising the nucleic acid SEQ ID NO. 7492 or polypeptide SEQ ID NO. 7493, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7492 or polypeptide SEQ ID NO. 7493, respectively, is increased or generated or if the activity "Regulator of cell morphogenesis and NO signaling" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.489-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 7493, or encoded by a nucleic acid molecule comprising the nucleic acid SEQ ID NO. 7492, or a homolog of said nucleic acid molecule or polypeptide, e.g. in case the activity of the

*Escherichia coli* nucleic acid molecule or a polypeptide comprising the nucleic acid SEQ ID NO. 7492 or polypeptide SEQ ID NO. 7493, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7492 or polypeptide SEQ ID NO. 7493, respectively, is increased or generated or if the activity "Regulator of cell morphogenesis and NO signaling" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.232-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 7493, or encoded by a nucleic acid molecule comprising the nucleic acid SEQ ID NO. 7492, or a homolog of said nucleic acid molecule or polypeptide, e.g. in case the activity of the *Escherichia coli* nucleic acid molecule or a polypeptide comprising the nucleic acid SEQ ID NO. 7492 or polypeptide SEQ ID NO. 7493, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7492 or polypeptide SEQ ID NO. 7493, respectively, is increased or generated or if the activity "Regulator of cell morphogenesis and NO signaling" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.137-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 7592, or encoded by a nucleic acid molecule comprising the nucleic acid SEQ ID NO. 7591, or a homolog of said nucleic acid molecule or polypeptide, e.g. in case the activity of the *Synechocystis* sp. nucleic acid molecule or a polypeptide, respectively, comprising the nucleic acid SEQ ID NO. 7591 or polypeptide SEQ ID NO. 7592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7591 or polypeptide SEQ ID NO. 7592, respectively, is increased or generated or if the activity "glutathione S-transferase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 7592, or encoded by a nucleic acid molecule comprising the nucleic acid SEQ ID NO. 7591, or a homolog of said nucleic acid molecule or polypeptide, e.g. in case the activity of the *Synechocystis* sp. nucleic acid molecule or a polypeptide comprising the nucleic acid SEQ ID NO. 7591 or polypeptide SEQ ID NO. 7592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7591 or polypeptide SEQ ID NO. 7592, respectively, is increased or generated or if the activity "glutathione S-transferase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.293-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 7592, or encoded by a nucleic acid molecule comprising the nucleic acid SEQ ID NO. 7591, or a homolog of said nucleic acid molecule or polypeptide, e.g. in case the activity of the *Synechocystis* sp. nucleic acid molecule or a polypeptide comprising the nucleic acid SEQ ID NO. 7591 or polypeptide SEQ ID NO. 7592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7591 or polypeptide SEQ ID NO. 7592, respectively, is increased or generated or if the activity "glutathione S-transferase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.406-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 7592, or encoded by a nucleic acid molecule comprising the nucleic acid SEQ ID NO. 7591, or a homolog of said nucleic acid molecule or polypeptide, e.g. in case the activity of the *Synechocystis* sp. nucleic acid molecule or a polypeptide comprising the nucleic acid SEQ ID NO. 7591 or polypeptide SEQ ID NO. 7592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7591 or polypeptide SEQ ID NO.

7592, respectively, is increased or generated or if the activity "glutathione S-transferase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.208-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 7671, or encoded by a nucleic acid molecule comprising the nucleic acid SEQ ID NO. 7670, or a homolog of said nucleic acid molecule or polypeptide, e.g. in case the activity of the *Synechocystis* sp. nucleic acid molecule or a polypeptide, respectively, comprising the nucleic acid SEQ ID NO. 7670 or polypeptide SEQ ID NO. 7671, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7670 or polypeptide SEQ ID NO. 7671, respectively, is increased or generated or if the activity "serine acetyltransferase" is increased or generated in a plant cell, plant or part thereof, especially if localized Mitochondric, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 7671, or encoded by a nucleic acid molecule comprising the nucleic acid SEQ ID NO. 7670, or a homolog of said nucleic acid molecule or polypeptide, e.g. in case the activity of the *Synechocystis* sp. nucleic acid molecule or a polypeptide comprising the nucleic acid SEQ ID NO. 7670 or polypeptide SEQ ID NO. 7671, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7670 or polypeptide SEQ ID NO. 7671, respectively, is increased or generated or if the activity "serine acetyltransferase" is increased or generated in a plant cell, plant or part thereof, especially, if the polypeptide is Mitochondric localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.413-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 7671, or encoded by a nucleic acid molecule comprising the nucleic acid SEQ ID NO. 7670, or a homolog of said nucleic acid molecule or polypeptide, e.g. in case the activity of the *Synechocystis* sp. nucleic acid molecule or a polypeptide comprising the nucleic acid SEQ ID NO. 7670 or polypeptide SEQ ID NO. 7671, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7670 or polypeptide SEQ ID NO. 7671, respectively, is increased or generated or if the activity "serine acetyltransferase" is increased or generated in a plant cell, plant or part thereof, especially if the polypeptide is Mitochondric localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.268-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 7671, or encoded by a nucleic acid molecule comprising the nucleic acid SEQ ID NO. 7670, or a homolog of said nucleic acid molecule or polypeptide, e.g. in case the activity of the *Synechocystis* sp. nucleic acid molecule or a polypeptide comprising the nucleic acid SEQ ID NO. 7670 or polypeptide SEQ ID NO. 7671, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 7670 or polypeptide SEQ ID NO. 7671, respectively, is increased or generated or if the activity "serine acetyltransferase" is increased or generated in a plant cell, plant or part thereof, especially if the polypeptide is Mitochondric localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.376-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 8237, or encoded by a nucleic acid molecule comprising the nucleic acid SEQ ID NO. 8236, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 8236 or polypeptide SEQ ID NO. 8237, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8236 or polypeptide SEQ ID NO. 8237, respectively, is increased or generated or if the activity "amino acid permease" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 8237, or encoded by a nucleic acid molecule comprising the nucleic acid SEQ ID NO. 8236, or a homolog of said nucleic acid molecule or polypeptide, e.g. in case the activity of the *Saccharomyces cerevisiae* nucleic acid molecule or a polypeptide comprising the nucleic acid SEQ ID NO. 8236 or polypeptide SEQ ID NO. 8237, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8236 or polypeptide SEQ ID NO. 8237, respectively, is increased or generated or if the activity "amino acid permease" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.298-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 8237, or encoded by a nucleic acid molecule comprising the nucleic acid SEQ ID NO. 8236, or a homolog of said nucleic acid molecule or polypeptide, e.g. in case the activity of the *Saccharomyces cerevisiae* nucleic acid molecule or a polypeptide comprising the nucleic acid SEQ ID NO. 8236 or polypeptide SEQ ID NO. 8237, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8236 or polypeptide SEQ ID NO. 8237, respectively, is increased or generated or if the activity "amino acid permease" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.156-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 8564, or encoded by a nucleic acid molecule comprising the nucleic acid SEQ ID NO. 8563, or a homolog of said nucleic acid molecule or polypeptide, e.g. in case the activity of the *Arabidopsis thaliana* nucleic acid molecule or a polypeptide, respectively, comprising the nucleic acid SEQ ID NO. 8563 or polypeptide SEQ ID NO. 8564, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8563 or polypeptide SEQ ID NO. 8564, respectively, is increased or generated or if the activity "signalosome complex subunit" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 8564, or encoded by a nucleic acid molecule comprising the nucleic acid SEQ ID NO. 8563, or a homolog of said nucleic acid molecule or polypeptide, e.g. in case the activity of the *Arabidopsis thaliana* nucleic acid molecule or a polypeptide comprising the nucleic acid SEQ ID NO. 8563 or polypeptide SEQ ID NO. 8564, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8563 or polypeptide SEQ ID NO. 8564, respectively, is increased or generated or if the activity "signalosome complex subunit" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.610-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 8564, or encoded by a nucleic acid molecule comprising the nucleic acid SEQ ID NO. 8563, or a homolog of said nucleic acid molecule or polypeptide, e.g. in case the activity of the *Arabidopsis thaliana* nucleic acid molecule or a polypeptide comprising the nucleic acid SEQ ID NO. 8563 or polypeptide SEQ ID NO. 8564, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8563 or polypeptide SEQ ID NO. 8564, respectively, is increased or generated or if the activity "signalosome complex subunit" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.385-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 8649, or encoded by a nucleic acid molecule comprising the nucleic acid SEQ ID NO. 8648, or a homolog of said nucleic acid molecule or polypeptide, e.g. in case the activity of the *Escherichia coli* nucleic acid molecule or a polypeptide, respectively, comprising the nucleic acid SEQ ID NO. 8648 or polypeptide SEQ ID NO. 8649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8648 or polypeptide SEQ ID NO. 8649, respectively, is increased or generated or if the activity "multidrug resistance protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 8649, or encoded by a nucleic acid molecule comprising the nucleic acid SEQ ID NO. 8648, or a homolog of said nucleic acid molecule or polypeptide, e.g. in case the activity of the *Escherichia coli* nucleic acid molecule or a polypeptide comprising the nucleic acid SEQ ID NO. 8648 or polypeptide SEQ ID NO. 8649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8648 or polypeptide SEQ ID NO. 8649, respectively, is increased or generated or if the activity "multidrug resistance protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.293-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 8649, or encoded by a nucleic acid molecule comprising the nucleic acid SEQ ID NO. 8648, or a homolog of said nucleic acid molecule or polypeptide, e.g. in case the activity of the *Escherichia coli* nucleic acid molecule or a polypeptide comprising the nucleic acid SEQ ID NO. 8648 or polypeptide SEQ ID NO. 8649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8648 or polypeptide SEQ ID NO. 8649, respectively, is increased or generated or if the activity "multidrug resistance protein" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.616-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 8649, or encoded by a nucleic acid molecule comprising the nucleic acid SEQ ID NO. 8648, or a homolog of said nucleic acid molecule or polypeptide, e.g. in case the activity of the *Escherichia coli* nucleic acid molecule or a polypeptide comprising the nucleic acid SEQ ID NO. 8648 or polypeptide SEQ ID NO. 8649, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8648 or polypeptide SEQ ID NO. 8649, respectively, is increased or generated or if the activity "multidrug resistance protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.401-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 8761, or encoded by a nucleic acid molecule comprising the nucleic acid SEQ ID NO. 8760, or a homolog of said nucleic acid molecule or polypeptide, e.g. in case the activity of the *Escherichia coli* nucleic acid molecule or a polypeptide, respectively, comprising the nucleic acid SEQ ID NO. 8760 or polypeptide SEQ ID NO. 8761, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8760 or polypeptide SEQ ID NO. 8761, respectively, is increased or generated or if the activity "Arabinose transport system ATP-binding protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 8761, or encoded by a nucleic acid molecule comprising the nucleic acid SEQ ID NO. 8760, or a homolog of said nucleic acid molecule or polypeptide, e.g. in case the activity of the *Escherichia coli* nucleic acid molecule or a polypeptide comprising the nucleic acid SEQ ID NO. 8760 or polypeptide SEQ ID NO. 8761, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8760 or polypeptide SEQ ID NO. 8761, respectively, is increased or generated or if the activity "Arabinose transport system ATP-binding protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.341-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 8761, or encoded by a nucleic acid molecule comprising the nucleic acid SEQ ID NO. 8760, or a homolog of said nucleic acid molecule or polypeptide, e.g. in case the activity of the *Escherichia coli* nucleic acid molecule or a polypeptide comprising the nucleic acid SEQ ID NO. 8760 or polypeptide SEQ ID NO. 8761, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8760 or polypeptide SEQ ID NO. 8761, respectively, is increased or generated or if the activity "Arabinose transport system ATP-binding protein" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.318-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 8761, or encoded by a nucleic acid molecule comprising the nucleic acid SEQ ID NO. 8760, or a homolog of said nucleic acid molecule or polypeptide, e.g. in case the activity of the *Escherichia coli* nucleic acid molecule or a polypeptide comprising the nucleic acid SEQ ID NO. 8760 or polypeptide SEQ ID NO. 8761, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8760 or polypeptide SEQ ID NO. 8761, respectively, is increased or generated or if the activity "Arabinose transport system ATP-binding protein" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.136-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 8862, or encoded by a nucleic acid molecule comprising the nucleic acid SEQ ID NO. 8861, or a homolog of said nucleic acid molecule or polypeptide, e.g. in case the activity of the *Synechocystis* sp. nucleic acid molecule or a polypeptide, respectively, comprising the nucleic acid SEQ ID NO. 8861 or polypeptide SEQ ID NO. 8862, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8861 or polypeptide SEQ ID NO. 8862, respectively, is increased or generated or if the activity "precorrin-6y methylase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 8862, or encoded by a nucleic acid molecule comprising the nucleic acid SEQ ID NO. 8861, or a homolog of said nucleic acid molecule or polypeptide, e.g. in case the activity of the *Synechocystis* sp. nucleic acid molecule or a polypeptide comprising the nucleic acid SEQ ID NO. 8861 or polypeptide SEQ ID NO. 8862, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8861 or polypeptide SEQ ID NO. 8862, respectively, is increased or generated or if the activity "precorrin-6y methylase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.310-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 8862, or encoded by a nucleic acid molecule comprising the nucleic acid SEQ ID NO. 8861, or a homolog of said nucleic acid molecule or polypeptide, e.g. in case the activity of the *Synechocystis* sp. nucleic acid molecule or a polypeptide comprising the nucleic acid SEQ ID NO. 8861 or polypeptide SEQ ID NO. 8862, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8861 or polypeptide SEQ ID NO. 8862, respectively, is increased or generated or if the activity "precorrin-6y methylase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.582-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 8862, or encoded by a nucleic acid molecule comprising the nucleic acid SEQ ID NO. 8861, or a homolog of said nucleic acid molecule or polypeptide, e.g. in case the activity of the *Synechocystis* sp. nucleic acid molecule or a polypeptide comprising the nucleic acid SEQ ID NO. 8861 or polypeptide SEQ ID NO. 8862, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 8861 or polypeptide SEQ ID NO. 8862, respectively, is increased or generated or if the activity "precorrin-6y methylase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.178-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9047, or encoded by a nucleic acid molecule comprising the nucleic acid SEQ ID NO. 9046, or a homolog of said nucleic acid molecule or polypeptide, e.g. in case the activity of the *Synechocystis* sp. nucleic acid molecule or a polypeptide, respectively, comprising the nucleic acid SEQ ID NO. 9046 or polypeptide SEQ ID NO. 9047, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9046 or polypeptide SEQ ID NO. 9047, respectively, is increased or generated or if the activity "cobalt transport protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9047, or encoded by a nucleic acid molecule comprising the nucleic acid SEQ ID NO. 9046, or a homolog of said nucleic acid molecule or polypeptide, e.g. in case the activity of the *Synechocystis* sp. nucleic acid molecule or a polypeptide comprising the nucleic acid SEQ ID NO. 9046 or polypeptide SEQ ID NO. 9047, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9046 or polypeptide SEQ ID NO. 9047, respectively, is increased or generated or if the activity "cobalt transport protein" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.415-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9047, or encoded by a nucleic acid molecule comprising the nucleic acid SEQ ID NO. 9046, or a homolog of said nucleic acid molecule or polypeptide, e.g. in case the activity of the *Synechocystis* sp. nucleic acid molecule or a polypeptide comprising the nucleic acid SEQ ID NO. 9046 or polypeptide SEQ ID NO. 9047, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9046 or polypeptide SEQ ID NO. 9047, respectively, is increased or generated or if the activity "cobalt transport protein" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.432-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 9047, or encoded by a nucleic acid molecule comprising the nucleic acid SEQ ID NO. 9046, or a homolog of said nucleic acid molecule or polypeptide, e.g. in case the activity of the *Synechocystis* sp. nucleic acid molecule or a polypeptide comprising the nucleic acid SEQ ID NO. 9046 or polypeptide SEQ ID NO. 9047, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9046 or polypeptide SEQ ID NO. 9047, respectively, is increased or generated or if the activity "cobalt transport protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.383-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9281, or encoded by a nucleic acid molecule comprising the nucleic acid SEQ ID NO. 9280, or a homolog of said nucleic acid molecule or polypeptide, e.g. in case the activity of the *Synechocystis* sp. nucleic acid molecule or a polypeptide, respectively, comprising the nucleic acid SEQ ID NO. 9280 or polypeptide SEQ ID NO. 9281, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9280 or polypeptide SEQ ID NO. 9281, respectively, is increased or generated or if the activity "SLR1094-protein" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9281, or encoded by a nucleic acid molecule comprising the nucleic acid SEQ ID NO. 9280, or a homolog of said nucleic acid molecule or polypeptide, e.g. in case the activity of the *Synechocystis* sp. nucleic acid molecule or a polypeptide comprising the nucleic acid SEQ ID NO. 9280 or polypeptide SEQ ID NO. 9281, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9280 or polypeptide SEQ ID NO. 9281, respectively, is increased or generated or if the activity "SLR1094-protein" is increased or generated in a plant cell, plant or part thereof, especially if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.352-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9281, or encoded by a nucleic acid molecule comprising the nucleic acid SEQ ID NO. 9280, or a homolog of said nucleic acid molecule or polypeptide, e.g. in case the activity of the *Synechocystis* sp. nucleic acid molecule or a polypeptide comprising the nucleic acid SEQ ID NO. 9280 or polypeptide SEQ ID NO. 9281, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9280 or polypeptide SEQ ID NO. 9281, respectively, is increased or generated or if the activity "SLR1094-protein" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.104-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9308, or encoded by a nucleic acid molecule comprising the nucleic acid SEQ ID NO. 9307, or a homolog of said nucleic acid molecule or polypeptide, e.g. in case the activity of the *Synechocystis* sp. nucleic acid molecule or a polypeptide, respectively, comprising the nucleic acid SEQ ID NO. 9307 or polypeptide SEQ ID NO. 9308, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9307 or polypeptide SEQ ID NO. 9308, respectively, is increased or generated or if the activity "oxidoreductase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9308, or encoded by a nucleic acid molecule comprising the nucleic acid SEQ ID NO. 9307, or a homolog of said nucleic acid molecule or polypeptide, e.g. in case the activity of the *Synechocystis* sp. nucleic acid molecule or a polypeptide comprising the nucleic acid SEQ ID NO. 9307 or polypeptide SEQ ID NO. 9308, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9307 or polypeptide SEQ ID NO. 9308, respectively, is increased or generated or if the activity "oxidoreductase" is increased or generated in a plant cell, plant or part thereof, especially if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.361-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9308, or encoded by a nucleic acid molecule comprising the nucleic acid SEQ ID NO. 9307, or a homolog of said nucleic acid molecule or polypeptide, e.g. in case the activity of the *Synechocystis* sp. nucleic acid molecule or a polypeptide comprising the nucleic acid SEQ ID NO. 9307 or polypeptide SEQ ID NO. 9308, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9307 or polypeptide SEQ ID NO. 9308, respectively, is increased or generated or if the activity "oxidoreductase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.441-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 9308, or encoded by a nucleic acid molecule comprising the nucleic acid SEQ ID NO. 9307, or a homolog of said nucleic acid molecule or polypeptide, e.g. in case the activity of the *Synechocystis* sp. nucleic acid molecule or a polypeptide comprising the nucleic acid SEQ ID NO. 9307 or polypeptide SEQ ID NO. 9308, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9307 or polypeptide SEQ ID NO. 9308, respectively, is increased or generated or if the activity "oxidoreductase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.103-fold, for example plus at least 100% thereof, under standard conditions (intrinsic yield), e.g. in the absence of nutrient deficiency as well as stress conditions, is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9431, or encoded by a nucleic acid molecule comprising the nucleic acid SEQ ID NO. 9430, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 9430 or polypeptide SEQ ID NO. 9431, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9430 or polypeptide SEQ ID NO. 9431, respectively, is increased or generated or if the activity "cardiolipin synthetase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9431, or encoded by a nucleic acid molecule comprising the nucleic acid SEQ ID NO. 9430, or a homolog of said nucleic acid molecule or polypeptide, e.g. in case the activity of the *Saccharomyces cerevisiae* nucleic acid molecule or a polypeptide comprising the nucleic acid SEQ ID NO. 9430 or polypeptide SEQ ID NO. 9431, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9430 or polypeptide SEQ ID NO. 9431, respectively, is increased or generated or if the activity "cardiolipin synthetase" is increased or generated in a plant cell, plant or part thereof, especially if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.503-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9431, or encoded by a nucleic acid molecule comprising the nucleic acid SEQ ID NO. 9430, or a homolog of said nucleic acid molecule or polypeptide, e.g. in case the activity of the *Saccharomyces cerevisiae* nucleic acid molecule or a polypeptide comprising the nucleic acid SEQ ID NO. 9430 or polypeptide SEQ ID NO. 9431, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9430 or polypeptide SEQ ID NO. 9431, respectively, is increased or generated or if the activity "cardiolipin synthetase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.200-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9480, or encoded by a nucleic acid molecule comprising the nucleic acid SEQ ID NO. 9479, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 9479 or polypeptide SEQ ID NO. 9480, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9479 or polypeptide SEQ ID NO. 9480, respectively, is increased or generated or if the activity "ethanolamine kinase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9480, or encoded by a nucleic acid molecule comprising the nucleic acid SEQ ID NO. 9479, or a homolog of said nucleic acid molecule or polypeptide, e.g. in case the activity of the *Saccharomyces cerevisiae* nucleic acid molecule or a polypeptide comprising the nucleic acid SEQ ID NO. 9479 or polypeptide SEQ ID NO. 9480, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9479 or polypeptide SEQ ID NO. 9480, respectively, is increased or generated or if the activity "ethanolamine kinase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.167-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9480, or encoded by a nucleic acid molecule comprising the nucleic acid SEQ ID NO. 9479, or a homolog of said nucleic acid molecule or polypeptide, e.g. in case the activity of the *Saccharomyces cerevisiae* nucleic acid molecule or a polypeptide comprising the nucleic acid SEQ ID NO. 9479 or polypeptide SEQ ID NO. 9480, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9479 or polypeptide SEQ ID NO. 9480, respectively, is increased or generated or if the activity "ethanolamine kinase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.117-fold, for example plus at least 100% thereof, under conditions of nitrogen deficiency is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9501, or encoded by a nucleic acid molecule comprising the nucleic acid SEQ ID NO. 9500, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 9500 or polypeptide SEQ ID NO. 9501, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9500 or polypeptide SEQ ID NO. 9501, respectively, is increased or generated or if the activity "enoyl-CoA isomerase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9501, or encoded by a nucleic acid molecule comprising the nucleic acid SEQ ID NO. 9500, or a homolog of said nucleic acid molecule or polypeptide, e.g. in case the activity of the *Saccharomyces cerevisiae* nucleic acid molecule or a polypeptide comprising the nucleic acid SEQ ID NO. 9500 or polypeptide SEQ ID NO. 9501, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9500 or polypeptide SEQ ID NO. 9501, respectively, is increased or generated or if the activity "enoyl-CoA isomerase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.306-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9501, or encoded by a nucleic acid molecule comprising the nucleic acid SEQ ID NO. 9500, or a homolog of said nucleic acid molecule or polypeptide, e.g. in case the activity of the *Saccharomyces cerevisiae* nucleic acid molecule or a polypeptide comprising the nucleic acid SEQ ID NO. 9500 or polypeptide SEQ ID NO. 9501, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9500 or polypeptide SEQ ID NO. 9501, respectively, is increased or generated or if the activity "enoyl-CoA isomerase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.229-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9554, or encoded by a nucleic acid molecule comprising the nucleic acid SEQ ID NO. 9553, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 9553 or polypeptide SEQ ID NO. 9554, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9553 or polypeptide SEQ ID NO. 9554, respectively, is increased or generated or if the activity "holo-[acyl-carrier-protein] synthase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9554, or encoded by a nucleic acid molecule comprising the nucleic acid SEQ ID NO. 9553, or a homolog of said nucleic acid molecule or polypeptide, e.g. in case the activity of the *Saccharomyces cerevisiae* nucleic acid molecule or a polypeptide comprising the nucleic acid SEQ ID NO. 9553 or polypeptide SEQ ID NO. 9554, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9553 or polypeptide SEQ ID NO. 9554, respectively, is increased or generated or if the activity "holo-[acyl-carrier-protein] synthase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.276-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9554, or encoded by a nucleic acid molecule comprising the nucleic acid SEQ ID NO. 9553, or a homolog of said nucleic acid molecule or polypeptide, e.g. in case the activity of the *Saccharomyces cerevisiae* nucleic acid molecule or a polypeptide comprising the nucleic acid SEQ ID NO. 9553 or polypeptide SEQ ID NO. 9554, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9553 or polypeptide SEQ ID NO. 9554, respectively, is increased or generated or if the activity "holo-[acyl-carrier-protein] synthase" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.226-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 9554, or encoded by a nucleic acid molecule comprising the nucleic acid SEQ ID NO. 9553, or a homolog of said nucleic acid molecule or polypeptide, e.g. in case the activity of the *Saccharomyces cerevisiae* nucleic acid molecule or a polypeptide comprising the nucleic acid SEQ ID NO. 9553 or polypeptide SEQ ID NO. 9554, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9553 or polypeptide SEQ ID NO. 9554, respectively, is increased or generated or if the activity "holo-[acyl-carrier-protein] synthase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.276-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 9575, or encoded by a nucleic acid molecule comprising the nucleic acid SEQ ID NO. 9574, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 9574 or polypeptide SEQ ID NO. 9575, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9574 or polypeptide SEQ ID NO. 9575, respectively, is increased or generated or if the activity "transketolase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 9575, or encoded by a nucleic acid molecule comprising the nucleic acid SEQ ID NO. 9574, or a homolog of said nucleic acid molecule or polypeptide, e.g. in case the activity of the *Saccharomyces cerevisiae* nucleic acid molecule or a polypeptide comprising the nucleic acid SEQ ID NO. 9574 or polypeptide SEQ ID NO. 9575, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9574 or polypeptide SEQ ID NO. 9575, respectively, is increased or generated or if the activity "transketolase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.287-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 9575, or encoded by a nucleic acid molecule comprising the nucleic acid SEQ ID NO. 9574, or a homolog of said nucleic acid molecule or polypeptide, e.g. in case the activity of the *Saccharomyces cerevisiae* nucleic acid molecule or a polypeptide comprising the nucleic acid SEQ ID NO. 9574 or polypeptide SEQ ID NO. 9575, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 9574 or polypeptide SEQ ID NO. 9575, respectively, is increased or generated or if the activity "transketolase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.245-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 10405, or encoded by a nucleic acid molecule comprising the nucleic acid SEQ ID NO. 10404, or a homolog of said nucleic acid molecule or polypeptide, e.g. in case the activity of the *Escherichia coli* nucleic acid molecule or a polypeptide, respectively, comprising the nucleic acid SEQ ID NO. 10404 or polypeptide SEQ ID NO. 10405, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10404 or polypeptide SEQ ID NO. 10405, respectively, is increased or generated or if the activity "NADH dehydrogenase/NAD(P)H nitroreductase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 10405, or encoded by a nucleic acid molecule comprising the nucleic acid SEQ ID NO. 10404, or a homolog of said nucleic acid molecule or polypeptide, e.g. in case the activity of the *Escherichia coli* nucleic acid molecule or a polypeptide comprising the nucleic acid SEQ ID NO. 10404 or polypeptide SEQ ID NO. 10405, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10404 or polypeptide SEQ ID NO. 10405, respectively, is increased or generated or if the activity "NADH dehydrogenase/NAD(P)H nitroreductase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.585-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 10405, or encoded by a nucleic acid molecule comprising the nucleic acid SEQ ID NO. 10404, or a homolog of said nucleic acid molecule or polypeptide, e.g. in case the activity of the *Escherichia coli* nucleic acid molecule or a polypeptide comprising the nucleic acid SEQ ID NO. 10404 or polypeptide SEQ ID NO. 10405, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10404 or polypeptide SEQ ID NO. 10405, respectively, is increased or generated or if the activity "NADH dehydrogenase/NAD(P)H nitroreductase" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.166-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 10405, or encoded by a nucleic acid molecule comprising the nucleic acid SEQ ID NO. 10404, or a homolog of said nucleic acid molecule or polypeptide, e.g. in case the activity of the *Escherichia coli* nucleic acid molecule or a polypeptide comprising the nucleic acid SEQ ID NO. 10404 or polypeptide SEQ ID NO. 10405, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10404 or polypeptide SEQ ID NO. 10405, respectively, is increased or generated or if the activity "NADH dehydrogenase/NAD(P)H nitroreductase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.200-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 10504, or encoded by a nucleic acid molecule comprising the nucleic acid SEQ ID NO. 10503, or a homolog of said nucleic acid molecule or polypeptide, e.g. in case the activity of the *Escherichia coli* nucleic acid molecule or a polypeptide, respectively, comprising the nucleic acid SEQ ID NO. 10503 or polypeptide SEQ ID NO. 10504, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10503 or polypeptide SEQ ID NO. 10504, respectively, is increased or generated or if the activity "multiple drug resistance protein" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 10504, or encoded by a nucleic acid molecule comprising the nucleic acid SEQ ID NO. 10503, or a homolog of said nucleic acid molecule or polypeptide, e.g. in case the activity of the *Escherichia coli* nucleic acid molecule or a polypeptide comprising the nucleic acid SEQ ID NO. 10503 or polypeptide SEQ ID NO. 10504, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10503 or polypeptide SEQ ID NO. 10504, respectively, is increased or generated or if the activity "multiple drug resistance protein" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.426-fold, for example plus at least 100% thereof, under conditions of low temperature is conferred compared to a corresponding non-modified, e.g. non-transformed, wild type plant cell, a plant or a part thereof.

Accordingly, in one embodiment, in case the activity of a polypeptide according to the polypeptide SEQ ID NO. 10592, or encoded by a nucleic acid molecule comprising the nucleic acid SEQ ID NO. 10591, or a homolog of said nucleic acid molecule or polypeptide, e.g. in case the activity of the *Escherichia coli* nucleic acid molecule or a polypeptide, respectively, comprising the nucleic acid SEQ ID NO. 10591 or polypeptide SEQ ID NO. 10592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10591 or polypeptide SEQ ID NO. 10592, respectively, is increased or generated or if the activity "peptidyl-prolyl cis-trans isomerase" is increased or generated in a plant cell, plant or part thereof, especially if localized plastidic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 10592, or encoded by a nucleic acid molecule comprising the nucleic acid SEQ ID NO. 10591, or a homolog of said nucleic acid molecule or polypeptide, e.g. in case the activity of the *Escherichia coli* nucleic acid molecule or a polypeptide comprising the nucleic acid SEQ ID NO. 10591 or polypeptide SEQ ID NO. 10592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10591 or polypeptide SEQ ID NO. 10592, respectively, is increased or generated or if the activity "peptidyl-prolyl cis-trans isomerase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.480-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 10592, or encoded by a nucleic acid molecule comprising the nucleic acid SEQ ID NO. 10591, or a homolog of said nucleic acid molecule or polypeptide, e.g. in case the activity of the *Escherichia coli* nucleic acid molecule or a polypeptide comprising the nucleic acid SEQ ID NO. 10591 or polypeptide SEQ ID NO. 10592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10591 or polypeptide SEQ ID NO. 10592, respectively, is increased or generated or if the activity "peptidyl-prolyl cis-trans isomerase" is increased or generated in a plant cell, plant or part thereof, especially if the polypeptide is plastidic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.339-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 10592, or encoded by a nucleic acid molecule comprising the nucleic acid SEQ ID NO. 10591, or a homolog of said nucleic acid molecule or polypeptide, e.g. in case the activity of the *Escherichia coli* nucleic acid molecule or a polypeptide comprising the nucleic acid SEQ ID NO. 10591 or polypeptide SEQ ID NO. 10592, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10591 or polypeptide SEQ ID NO. 10592, respectively, is increased or generated or if the activity "peptidyl-prolyl cis-trans isomerase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.188-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 10935, or encoded by a nucleic acid molecule comprising the nucleic acid SEQ ID NO. 10934, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 10934 or polypeptide SEQ ID NO. 10935, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10934 or polypeptide SEQ ID NO. 10935, respectively, is increased or generated or if the activity "3-methyl-2-oxobutanoate hydroxymethyltransferase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 10935, or encoded by a nucleic acid molecule comprising the nucleic acid SEQ ID NO. 10934, or a homolog of said nucleic acid molecule or polypeptide, e.g. in case the activity of the *Saccharomyces cerevisiae* nucleic acid molecule or a polypeptide comprising the nucleic acid SEQ ID NO. 10934 or polypeptide SEQ ID NO. 10935, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 10934 or polypeptide SEQ ID NO. 10935, respectively, is increased or generated or if the activity "3-methyl-2-oxobutanoate hydroxymethyltransferase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.429-fold, for example plus at least 100% thereof, under conditions of low temperature is conferred compared to a corresponding non-modified, e.g. non-transformed, wild type plant cell, a plant or a part thereof.

Accordingly, in one embodiment, in case the activity of a polypeptide according to the polypeptide SEQ ID NO. 11462, or encoded by a nucleic acid molecule comprising the nucleic acid SEQ ID NO. 11461, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 11461 or polypeptide SEQ ID NO. 11462, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11461 or polypeptide SEQ ID NO. 11462, respectively, is increased or generated or if the activity "alcohol acetyltransferase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 11462, or encoded by a nucleic acid molecule comprising the nucleic acid SEQ ID NO. 11461, or a homolog of said nucleic acid molecule or polypeptide, e.g. in case the activity of the *Saccharomyces cerevisiae* nucleic acid molecule or a polypeptide comprising the nucleic acid SEQ ID NO. 11461 or polypeptide SEQ ID NO. 11462, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11461 or polypeptide SEQ ID NO. 11462, respectively, is increased or generated or if the activity "alcohol acetyltransferase" is increased or generated in a plant cell, plant or part thereof, especially if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.416-fold, for example plus at least 100% thereof, under conditions of low temperature is conferred compared to a corresponding non-modified, e.g. non-transformed, wild type plant cell, a plant or a part thereof.

Accordingly, in one embodiment, in case the activity of a polypeptide according to the polypeptide SEQ ID NO. 11502, or encoded by a nucleic acid molecule comprising the nucleic acid SEQ ID NO. 11501, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 11501 or polypeptide SEQ ID NO. 11502, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11501 or polypeptide SEQ ID NO. 11502, respectively, is increased or generated or if the activity "thiol-specific monooxygenase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 11502, or encoded by a nucleic acid molecule comprising the nucleic acid SEQ ID NO. 11501, or a homolog of said nucleic acid molecule or polypeptide, e.g. in case the activity of the *Saccharomyces cerevisiae* nucleic acid molecule or a polypeptide comprising the nucleic acid SEQ ID NO. 11501 or polypeptide SEQ ID NO. 11502, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11501 or polypeptide SEQ ID NO. 11502, respectively, is increased or generated or if the activity "thiol-specific monooxygenase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.621-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 11502, or encoded by a nucleic acid molecule comprising the nucleic acid SEQ ID NO. 11501, or a homolog of said nucleic acid molecule or polypeptide, e.g. in case the activity of the *Saccharomyces cerevisiae* nucleic acid molecule or a polypeptide comprising the nucleic acid SEQ ID NO. 11501 or polypeptide SEQ ID NO. 11502, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11501 or polypeptide SEQ ID NO. 11502, respectively, is increased or generated or if the activity "thiol-specific monooxygenase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.330-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 11502, or encoded by a nucleic acid molecule comprising the nucleic acid SEQ ID NO. 11501, or a homolog of said nucleic acid molecule or polypeptide, e.g. in case the activity of the *Saccharomyces cerevisiae* nucleic acid molecule or a polypeptide comprising the nucleic acid SEQ ID NO. 11501 or polypeptide SEQ ID NO. 11502, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11501 or polypeptide SEQ ID NO. 11502, respectively, is increased or generated or if the activity "thiol-specific monooxygenase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.258-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 11565, or encoded by a nucleic acid molecule comprising the nucleic acid SEQ ID NO. 11564, or a homolog of said nucleic acid molecule or polypeptide, e.g. in case the activity of the *Escherichia coli* nucleic acid molecule or a polypeptide, respectively, comprising the nucleic acid SEQ ID NO. 11564 or polypeptide SEQ ID NO. 11565, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11564 or polypeptide SEQ ID NO. 11565, respectively, is increased or generated or if the activity "Molybdenum-binding subunit of aldehyde oxidases and xanthine dehydrogenases" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 11565, or encoded by a nucleic acid molecule comprising the nucleic acid SEQ ID NO. 11564, or a homolog of said nucleic acid molecule or polypeptide, e.g. in case the activity of the *Escherichia coli* nucleic acid molecule or a polypeptide comprising the nucleic acid SEQ ID NO. 11564 or polypeptide SEQ ID NO. 11565, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11564 or polypeptide SEQ ID NO. 11565, respectively, is increased or generated or if the activity "Molybdenum-binding subunit of aldehyde oxidases and xanthine dehydrogenases" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.230-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 11565, or encoded by a nucleic acid molecule comprising the nucleic acid SEQ ID NO. 11564, or a homolog of said nucleic acid molecule or polypeptide, e.g. in case the activity of the *Escherichia coli* nucleic acid molecule or a polypeptide comprising the nucleic acid SEQ ID NO. 11564 or polypeptide SEQ ID NO. 11565, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11564 or polypeptide SEQ ID NO. 11565, respectively, is increased or generated or if the activity "Molybdenum-binding subunit of aldehyde oxidases and xanthine dehydrogenases" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.202-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 11565, or encoded by a nucleic acid molecule comprising the nucleic acid SEQ ID NO. 11564, or a homolog of said nucleic acid molecule or polypeptide, e.g. in case the activity of the *Escherichia coli* nucleic acid molecule or a polypeptide comprising the nucleic acid SEQ ID NO. 11564 or polypeptide SEQ ID NO. 11565, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11564 or polypeptide SEQ ID NO. 11565, respectively, is increased or generated or if the activity "Molybdenum-binding subunit of aldehyde oxidases and xanthine dehydrogenases" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.074-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 11696, or encoded by a nucleic acid molecule comprising the nucleic acid SEQ ID NO. 11695, or a homolog of said nucleic acid molecule or polypeptide, e.g. in case the activity of the *Escherichia coli* nucleic acid molecule or a polypeptide, respectively, comprising the nucleic acid SEQ ID NO. 11695 or polypeptide SEQ ID NO. 11696, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11695 or polypeptide SEQ ID NO. 11696, respectively, is increased or generated or if the activity "glycerol dehydrogenase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 11696, or encoded by a nucleic acid molecule comprising the nucleic acid SEQ ID NO. 11695, or a homolog of said nucleic acid molecule or polypeptide, e.g. in case the activity of the *Escherichia coli* nucleic acid molecule or a polypeptide comprising the nucleic acid SEQ ID NO. 11695 or polypeptide SEQ ID NO. 11696, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11695 or polypeptide SEQ ID NO. 11696, respectively, is increased or generated or if the activity "glycerol dehydrogenase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.353-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 11696, or encoded by a nucleic acid molecule comprising the nucleic acid SEQ ID NO. 11695, or a homolog of said nucleic acid molecule or polypeptide, e.g. in case the activity of the *Escherichia coli* nucleic acid molecule or a polypeptide comprising the nucleic acid SEQ ID NO. 11695 or polypeptide SEQ ID NO. 11696, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11695 or polypeptide SEQ ID NO. 11696, respectively, is increased or generated or if the activity "glycerol dehydrogenase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.457-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 11696, or encoded by a nucleic acid molecule comprising the nucleic acid SEQ ID NO. 11695, or a homolog of said nucleic acid molecule or polypeptide, e.g. in case the activity of the *Escherichia coli* nucleic acid molecule or a polypeptide comprising the nucleic acid SEQ ID NO. 11695 or polypeptide SEQ ID NO. 11696, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11695 or polypeptide SEQ ID NO. 11696, respectively, is increased or generated or if the activity "glycerol dehydrogenase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.191-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 11908, or encoded by a nucleic acid molecule comprising the nucleic acid SEQ ID NO. 11907, or a homolog of said nucleic acid molecule or polypeptide, e.g. in case the activity of the *Sac-*

*charomyces cerevisiae* nucleic acid molecule or a polypeptide, respectively, comprising the nucleic acid SEQ ID NO. 11907 or polypeptide SEQ ID NO. 11908, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11907 or polypeptide SEQ ID NO. 11908, respectively, is increased or generated or if the activity "protein required for degradation of glycoproteins" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 11908, or encoded by a nucleic acid molecule comprising the nucleic acid SEQ ID NO. 11907, or a homolog of said nucleic acid molecule or polypeptide, e.g. in case the activity of the *Saccharomyces cerevisiae* nucleic acid molecule or a polypeptide comprising the nucleic acid SEQ ID NO. 11907 or polypeptide SEQ ID NO. 11908, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11907 or polypeptide SEQ ID NO. 11908, respectively, is increased or generated or if the activity "protein required for degradation of glycoproteins" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.697-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 11908, or encoded by a nucleic acid molecule comprising the nucleic acid SEQ ID NO. 11907, or a homolog of said nucleic acid molecule or polypeptide, e.g. in case the activity of the *Saccharomyces cerevisiae* nucleic acid molecule or a polypeptide comprising the nucleic acid SEQ ID NO. 11907 or polypeptide SEQ ID NO. 11908, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11907 or polypeptide SEQ ID NO. 11908, respectively, is increased or generated or if the activity "protein required for degradation of glycoproteins" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.469-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 11908, or encoded by a nucleic acid molecule comprising the nucleic acid SEQ ID NO. 11907, or a homolog of said nucleic acid molecule or polypeptide, e.g. in case the activity of the *Saccharomyces cerevisiae* nucleic acid molecule or a polypeptide comprising the nucleic acid SEQ ID NO. 11907 or polypeptide SEQ ID NO. 11908, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11907 or polypeptide SEQ ID NO. 11908, respectively, is increased or generated or if the activity "protein required for degradation of glycoproteins" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.369-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 11945, or encoded by a nucleic acid molecule comprising the nucleic acid SEQ ID NO. 11944, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 11944 or polypeptide SEQ ID NO. 11945, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11944 or polypeptide SEQ ID NO. 11945, respectively, is increased or generated or if the activity "ammonium transporter" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 11945, or encoded by a nucleic acid molecule comprising the nucleic acid SEQ ID NO. 11944, or a homolog of said nucleic acid molecule or polypeptide, e.g. in case the activity of the *Saccharomyces cerevisiae* nucleic acid molecule or a polypeptide comprising the nucleic acid SEQ ID NO. 11944 or polypeptide SEQ ID NO. 11945, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11944 or polypeptide SEQ ID NO. 11945, respectively, is increased or generated or if the activity "ammonium transporter" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.808-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 11945, or encoded by a nucleic acid molecule comprising the nucleic acid SEQ ID NO. 11944, or a homolog of said nucleic acid molecule or polypeptide, e.g. in case the activity of the *Saccharomyces cerevisiae* nucleic acid molecule or a polypeptide comprising the nucleic acid SEQ ID NO. 11944 or polypeptide SEQ ID NO. 11945, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11944 or polypeptide SEQ ID NO. 11945, respectively, is increased or generated or if the activity "ammonium transporter" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.593-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 11945, or encoded by a nucleic acid molecule comprising the nucleic acid SEQ ID NO. 11944, or a homolog of said nucleic acid molecule or polypeptide, e.g. in case the activity of the *Saccharomyces cerevisiae* nucleic acid molecule or a polypeptide comprising the nucleic acid SEQ ID NO. 11944 or polypeptide SEQ ID NO. 11945, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 11944 or polypeptide SEQ ID NO. 11945, respectively, is increased or generated or if the activity "ammonium transporter" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.214-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 12358, or encoded by a nucleic acid molecule comprising the nucleic acid SEQ ID NO. 12357, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 12357 or polypeptide SEQ ID NO. 12358, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12357 or polypeptide SEQ ID NO. 12358, respectively, is increased or generated or if the activity "Argininosuccinate synthase" is increased or generated in a plant cell, plant or part thereof, especially if localized plastidic and/or cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 12358, or encoded by a nucleic acid molecule comprising the nucleic acid SEQ ID NO. 12357, or a homolog of said nucleic acid molecule or polypeptide, e.g. in case the activity of the *Saccharomyces cerevisiae* nucleic acid molecule or a polypeptide comprising the nucleic acid SEQ ID NO. 12357 or polypeptide SEQ ID NO. 12358, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12357 or polypeptide SEQ ID NO. 12358, respectively, is increased or generated or if the activity "Argininosuccinate synthase" is increased or generated in a plant cell, plant or part thereof, especially, if the polypeptide is plastidic localized, an increased tolerance to abiotic environmental stress, in particular increased low temperature tolerance, compared to a corresponding non-modified, e.g. a non-transformed, wild type plant cell, a plant or a part thereof is conferred.

Particularly, expressing under the control of a plastidic signal sequence, an increase of yield from 1.1-fold to 1.300-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 12358, or encoded by a nucleic acid molecule comprising the nucleic acid SEQ ID NO. 12357, or a homolog of said nucleic acid molecule or polypeptide, e.g. in case the activity of the *Saccharomyces cerevisiae* nucleic acid molecule or a polypeptide comprising the nucleic acid SEQ ID NO. 12357 or polypeptide SEQ ID NO. 12358, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12357 or polypeptide SEQ ID NO. 12358, respectively, is increased or generated or if the activity "Argininosuccinate synthase" is increased or generated in a plant cell, plant or part thereof, especially if the polypeptide iscytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred. Expressing without combining said sequence or molecule with a further targeting or signal sequence, e.g. without a further heterologous target sequence or signal sequence as described herein an increase of yield from 1.05-fold to 1.172-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 12358, or encoded by a nucleic acid molecule comprising the nucleic acid SEQ ID NO. 12357, or a homolog of said nucleic acid molecule or polypeptide, e.g. in case the activity of the *Saccharomyces cerevisiae* nucleic acid molecule or a polypeptide comprising the nucleic acid SEQ ID NO. 12357 or polypeptide SEQ ID NO. 12358, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12357 or polypeptide SEQ ID NO. 12358, respectively, is increased or generated or if the activity "Argininosuccinate synthase" is increased or generated in a plant cell, plant or part thereof, especially if the polypeptide is plastidic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, expressing under the control of a plastidic signal sequence, an increase of yield from 1.05-fold to 1.091-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

Accordingly, in one embodiment, in case the activity of a polypeptide according to the polypeptide SEQ ID NO. 12937, or encoded by a nucleic acid molecule comprising the nucleic acid SEQ ID NO. 12936, or a homolog of said nucleic acid molecule or polypeptide, e.g. in case the activity of the *Saccharomyces cerevisiae* nucleic acid molecule or a polypeptide, respectively, comprising the nucleic acid SEQ ID NO. 12936 or polypeptide SEQ ID NO. 12937, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12936 or polypeptide SEQ ID NO. 12937, respectively, is increased or generated or if the activity "glutamine synthetase" is increased or generated in a plant cell, plant or part thereof, especially if localized cytoplasmic, an increased yield as compared to a corresponding non-modified, e.g. a non-transformed, wild type plant cell, a plant or a part thereof is conferred.

In a further embodiment, in case the activity of a polypeptide according to the polypeptide SEQ ID NO. 12937, or encoded by a nucleic acid molecule comprising the nucleic acid SEQ ID NO. 12936, or a homolog of said nucleic acid molecule or polypeptide, e.g. in case the activity of the *Saccharomyces cerevisiae* nucleic acid molecule or a polypeptide comprising the nucleic acid SEQ ID NO. 12936 or polypeptide SEQ ID NO. 12937, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12936 or polypeptide SEQ ID NO. 12937, respectively, is increased or generated or if the activity "glutamine synthetase" is increased or generated in a plant cell, plant or part thereof, especially, if the polypeptide is cytoplasmic localized, an increased tolerance to abiotic environmental stress, in particular increased low temperature tolerance, compared to a corresponding non-modified, e.g. a non-transformed, wild type plant cell, a plant or a part thereof is conferred.

Particularly, an increase of yield from 1.1-fold to 1.451-fold, for example plus at least 100% thereof, under conditions of low temperature is conferred compared to a corresponding non-modified, e.g. non-transformed, wild type plant cell, a plant or a part thereof.

In a further embodiment, in case the activity of a polypeptide according to the polypeptide SEQ ID NO. 12937, or encoded by a nucleic acid molecule comprising the nucleic acid SEQ ID NO. 12936, or a homolog of said nucleic acid molecule or polypeptide, e.g. in case the activity of the *Saccharomyces cerevisiae* nucleic acid molecule or a polypeptide comprising the nucleic acid SEQ ID NO. 12936 or polypeptide SEQ ID NO. 12937, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12936 or polypeptide SEQ ID NO. 12937, respectively, is increased or generated or if the activity "glutamine synthetase" is increased or generated in a plant cell, plant or part thereof, especially if the polypeptide is cytoplasmic localized, an increased nutrient use efficiency as compared to a corresponding non-modified, e.g. a non-transformed, wild type plant cell, a plant or a part thereof is conferred. In one embodiment an increased nitrogen use efficiency is conferred.

Particularly, an increase of yield from 1.05-fold to 1.237-fold, for example plus at least 100% thereof, under conditions of nitrogen deficiency is conferred compared to a corresponding non-modified, e.g. non-transformed, wild type plant cell, a plant or a part thereof.

In a further embodiment, in case the activity of a polypeptide according to the polypeptide SEQ ID NO. 12937, or encoded by a nucleic acid molecule comprising the nucleic acid SEQ ID NO. 12936, or a homolog of said nucleic acid molecule or polypeptide, e.g. in case the activity of the *Saccharomyces cerevisiae* nucleic acid molecule or a polypeptide comprising the nucleic acid SEQ ID NO. 12936 or polypeptide SEQ ID NO. 12937, respectively, is increased or generated, e.g. if the activity of a nucleic acid molecule or a polypeptide comprising the nucleic acid or polypeptide or the consensus sequence or the polypeptide motif, as depicted in table I, II or IV, column 7 in the respective same line as the nucleic acid molecule SEQ ID NO. 12936 or polypeptide SEQ ID NO. 12937, respectively, is increased or generated or if the activity "glutamine synthetase" is increased or generated in a plant cell, plant or part thereof, especially if the polypeptide is cytoplasmic localized, an increased intrinsic yield as compared to a corresponding non-modified, e.g. a non-transformed, wild type plant cell, a plant or a part thereof is conferred. In one embodiment an increased yield under standard conditions (intrinsic yield), e.g. in the absence of nutrient deficiency as well as stress conditions, is conferred.

Particularly, an increase of yield from 1.05-fold to 1.236-fold, for example plus at least 100% thereof, under standard conditions (intrinsic yield), e.g. in the absence of nutrient deficiency as well as stress conditions is conferred compared to a corresponding non-modified, e.g. non-transformed, wild type plant cell, a plant or a part thereof.

The ratios indicated above particularly refer to an increased yield actually measured as increase of biomass, especially as fresh weight biomass of aerial parts.

For the purposes of the invention, as a rule the plural is intended to encompass the singular and vice versa.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and single-stranded DNA and/or RNA. They also include known types of modifications, for example, methylation, "caps", substitutions of one or more of the naturally occurring nucleotides with an analog. Preferably, the DNA or RNA sequence comprises a coding sequence encoding the herein defined polypeptide.

A "coding sequence" is a nucleotide sequence, which is transcribed into an RNA, e.g. a regulatory RNA, such as a miRNA, a ta-siRNA, cosuppression molecule, an RNAi, a ribozyme, etc. or into a mRNA which is translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

As used in the present context a nucleic acid molecule may also encompass the untranslated sequence located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. In the event for example the antisense, RNAi, snRNA, dsRNA, siRNA, miRNA, ta-siRNA, co-suppression molecule, ribozyme etc. technology is used coding regions as well as the 5'- and/or 3'-regions can advantageously be used.

However, it is often advantageous only to choose the coding region for cloning and expression purposes.

"Polypeptide" refers to a polymer of amino acid (amino acid sequence) and does not refer to a specific length of the molecule. Thus, peptides and oligopeptides are included within the definition of polypeptide. This term does also refer to or include post-translational modifications of the polypeptide, for example, glycosylations, acetylations, phosphorylations and the like. Included within the definition are, for example, polypeptides containing one or more analogs of an amino acid (including, for example, unnatural amino acids, etc.), polypeptides with substituted linkages, as well as other modifications known in the art, both naturally occurring and non-naturally occurring.

The term "table I" used in this specification is to be taken to specify the content of table I A and table I B. The term "table II" used in this specification is to be taken to specify the content of table II A and table II B. The term "table I A" used in this specification is to be taken to specify the content of table I A. The term "table I B" used in this specification is to be taken to specify the content of table I B. The term "table II A" used in this specification is to be taken to specify the content of table II A. The term "table II B" used in this specification is to be taken to specify the content of table II B. In one preferred embodiment, the term "table I" means table I B. In one preferred embodiment, the term "table II" means table II B.

The terms "comprise" or "comprising" and grammatical variations thereof when used in this specification are to be taken to specify the presence of stated features, integers, steps or components or groups thereof, but not to preclude the presence or addition of one or more other features, integers, steps, components or groups thereof.

In accordance with the invention, a protein or polypeptide has the "activity of an protein as shown in table II, column 3" if its de novo activity, or its increased expression directly or indirectly leads to and confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, plant or part thereof and the protein has the above mentioned activities of a protein as shown in table II, column 3. Throughout the specification the activity or preferably the biological activity of such a protein or polypeptide or an nucleic acid molecule or sequence encoding such protein or polypeptide is identical or similar if it still has the biological or enzymatic activity of a protein as shown in table II, column 3, or which has at least 10% of the original enzymatic activity, preferably 20%, 30%, 40%, 50%, particularly preferably 60%, 70%, 80% most particularly preferably 90%, 95%, 98%, 99% in comparison to a protein as shown in table II, column 3 of *S. cerevisiae* or *E. coli* or *Synechocystis* sp. or *A. thaliana*. In another embodiment the biological or enzymatic activity of a protein as shown in table II, column 3, has at least 101% of the original enzymatic activity, preferably 110%, 120%, %, 150%, particularly preferably 150%, 200%, 300% in comparison to a protein as shown in table II, column 3 of *S. cerevisiae* or *E. coli* or *Synechocystis* sp. or *A. thaliana*.

The terms "increased", "raised", "extended", "enhanced", "improved" or "amplified" relate to a corresponding change of a property in a plant, an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced.

The terms "increase" relate to a corresponding change of a property an organism or in a part of a plant, an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" include the change of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested.

Accordingly, the term "increase" means that the specific activity of an enzyme as well as the amount of a compound or metabolite, e.g. of a polypeptide, a nucleic acid molecule of the invention or an encoding mRNA or DNA, can be increased in a volume.

The terms "wild type", "control" or "reference" are exchangeable and can be a cell or a part of organisms such as an organelle like a chloroplast or a tissue, or an organism, in particular a plant, which was not modified or treated according to the herein described process according to the invention. Accordingly, the cell or a part of organisms such as an organelle like a chloroplast or a tissue, or an organism, in particular a plant used as wild type, control or reference corresponds to the cell, organism, plant or part thereof as much as possible and is in any other property but in the result of the process of the invention as identical to the subject matter of the invention as possible. Thus, the wild type, control or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, soil, nutrient, water content of the soil, temperature, humidity or surrounding air or soil, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant, which was not modified or treated according to the herein described process of the invention and is in any other property as similar to the subject matter of the invention as possible. The reference, control or wild type is in its genome, transcriptome, proteome or metabolome as similar as possible to the subject of the present invention. Preferably, the term "reference-" "control-" or "wild type-"-organelle, -cell, -tissue or -organism, in particular plant, relates to an organelle, cell, tissue or organism, in particular plant, which is nearly genetically identical to the organelle, cell, tissue or organism, in particular plant, of the present invention or a part thereof preferably 95%, more preferred are 98%, even more preferred are 99,00%, in particular 99,10%, 99,30%, 99,50%, 99,70%, 99,90%, 99,99%, 99,999% or more. Most preferable the "reference", "control", or "wild type" is a subject, e.g. an organelle, a cell, a tissue, an organism, in particular a plant, which is genetically identical to the organism, in particular plant, cell, a tissue or organelle used according to the process of the invention except that the responsible or activity conferring nucleic acid molecules or the gene product encoded by them are amended, manipulated, exchanged or introduced according to the inventive process.

In case, a control, reference or wild type differing from the subject of the present invention only by not being subject of the process of the invention can not be provided, a control, reference or wild type can be an organism in which the cause for the modulation of an activity conferring the enhanced tolerance to abiotic environmental stress and/or increased yield as compared to a corresponding, e.g. non-transformed, wild type plant cell, plant or part thereof or expression of the nucleic acid molecule of the invention as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or protein or activity or expression of reference genes, like housekeeping genes, such as ubiquitin, actin or ribosomal proteins.

The increase or modulation according to this invention can be constitutive, e.g. due to a stable permanent transgenic expression or to a stable mutation in the corresponding endogenous gene encoding the nucleic acid molecule of the invention or to a modulation of the expression or of the behavior of a gene conferring the expression of the polypeptide of the invention, or transient, e.g. due to an transient transformation or temporary addition of a modulator such as a agonist or antagonist or inducible, e.g. after transformation with a inducible construct carrying the nucleic acid molecule of the invention under control of a inducible promoter and adding the inducer, e.g. tetracycline or as described herein below.

The increase in activity of the polypeptide amounts in a cell, a tissue, an organelle, an organ or an organism, preferably a plant, or a part thereof preferably to at least 5%, preferably to at least 20% or at to least 50%, especially preferably to at least 70%, 80%, 90% or more, very especially preferably are to at least 100%, 150% or 200%, most preferably are to at least 250% or more in comparison to the control, reference or wild type. In one embodiment the term increase means the increase in amount in relation to the weight of the organism or part thereof (w/w).

In one embodiment the increase in activity of the polypeptide amounts in an organelle such as a plastid. In another embodiment the increase in activity of the polypeptide amounts in the cytoplasm.

The specific activity of a polypeptide encoded by a nucleic acid molecule of the present invention or of the polypeptide of the present invention can be tested as described in the examples. In particular, the expression of a protein in question in a cell, e.g. a plant cell in comparison to a control is an easy test and can be performed as described in the state of the art.

The term "increase" includes, that a compound or an activity, especially an activity, is introduced into a cell, the cytoplasm or a sub-cellular compartment or organelle de novo or that the compound or the activity, especially an activity, has not been detected before, in other words it is "generated".

Accordingly, in the following, the term "increasing" also comprises the term "generating" or "stimulating". The increased activity manifests itself in increased yield, e.g. an increased yield-related trait, for example enhanced tolerance to abiotic environmental stress, for example an increased drought tolerance and/or low temperature tolerance and/or an increased nutrient use efficiency, intrinsic yield and/or another increased yield-related trait as compared to a corresponding, e.g. non-transformed, wild type plant cell, plant or part thereof.

The sequence of B0414 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as pyrimidine deaminase/reductase.

Accordingly, in one embodiment, the process of the present invention comprises increasing or generating the activity of a gene product with the activity "pyrimidine deaminase/reductase" from *Escherichia coli* or its functional equivalent or its homolog, e.g. the increase of
(a) a gene product of a gene comprising the nucleic acid molecule as shown in column 5 of table I, and being depicted in the same respective line as said B0414 or a functional equivalent or a homologue thereof as shown depicted in column 7 of table I, preferably a homologue or functional equivalent as shown depicted in column 7 of table I B, and being depicted in the same respective line as said B0414; or
(b) a polypeptide comprising a polypeptide, a consensus sequence or a polypeptide motif as shown depicted in column 5 of table II and column 7 of table IV, respectively, and being depicted in the same respective line as said B0414 or a functional equivalent or a homologue thereof as depicted in column 7 of table II, preferably a homologue or functional equivalent as depicted in column 7 of table II B, and being depicted in the same respective line as said B0414, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "pyrimidine deaminase/reductase", preferably it is the molecule of section (a) or (b) of this paragraph.

In one embodiment, said molecule, which activity is to be increased in the process of the invention and which is the gene product with an activity as described as a "pyrimidine deaminase/reductase", is increased cytoplasmic.

The sequence of B2931 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as oxidoreductase.

Accordingly, in one embodiment, the process of the present invention comprises increasing or generating the activity of a gene product with the activity "oxidoreductase" from *Escherichia coli* or its functional equivalent or its homolog, e.g. the increase of
(a) a gene product of a gene comprising the nucleic acid molecule as shown in column 5 of table I, and being depicted in the same respective line as said B2931 or a functional equivalent or a homologue thereof as shown depicted in column 7 of table I, preferably a homologue or functional equivalent as shown depicted in column 7 of table I B, and being depicted in the same respective line as said B2931; or
(b) a polypeptide comprising a polypeptide, a consensus sequence or a polypeptide motif as shown depicted in column 5 of table II and column 7 of table IV, respectively, and being depicted in the same respective line as said B2931 or a functional equivalent or a homologue thereof as depicted in column 7 of table II, preferably a homologue or functional equivalent as depicted in column 7 of table II B, and being depicted in the same respective line as said B2931, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "oxidoreductase", preferably it is the molecule of section (a) or (b) of this paragraph.

In one embodiment, said molecule, which activity is to be increased in the process of the invention and which is the gene product with an activity as described as a "oxidoreductase", is increased cytoplasmic.

The sequence of B3945 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as glycerol dehydrogenase.

Accordingly, in one embodiment, the process of the present invention comprises increasing or generating the activity of a gene product with the activity "glycerol dehydrogenase" from *Escherichia coli* or its functional equivalent or its homolog, e.g. the increase of
(a) a gene product of a gene comprising the nucleic acid molecule as shown in column 5 of table I, and being depicted in the same respective line as said B3945 or a functional equivalent or a homologue thereof as shown depicted in column 7 of table I, preferably a homologue or functional equivalent as shown depicted in column 7 of table I B, and being depicted in the same respective line as said B3945; or
(b) a polypeptide comprising a polypeptide, a consensus sequence or a polypeptide motif as shown depicted in column 5 of table II and column 7 of table IV, respectively, and being depicted in the same respective line as said B3945 or a functional equivalent or a homologue thereof as depicted in column 7 of table II, preferably a homologue or functional equivalent as depicted in column 7 of table II B, and being depicted in the same respective line as said B3945, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "glycerol dehydrogenase", preferably it is the molecule of section (a) or (b) of this paragraph.

In one embodiment, said molecule, which activity is to be increased in the process of the invention and which is the gene product with an activity as described as a "glycerol dehydrogenase", is increased cytoplasmic.

The sequence of Yel004w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as uridine diphosphate-N-acetylglucosamine transporter.

Accordingly, in one embodiment, the process of the present invention comprises increasing or generating the activity of a gene product with the activity "uridine diphosphate-N-acetylglucosamine transporter" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yel004w or a functional equivalent or a homologue thereof as shown depicted in column 7 of table I, preferably a homologue or functional equivalent as shown depicted in column 7 of table I B, and being depicted in the same respective line as said Yel004w; or
(b) a polypeptide comprising a polypeptide, a consensus sequence or a polypeptide motif as shown depicted in column 5 of table II and column 7 of table IV, respectively, and being depicted in the same respective line as said Yel004w or a functional equivalent or a homologue thereof as depicted in column 7 of table II, preferably a homologue or functional equivalent as depicted in column 7 of table II B, and being depicted in the same respective line as said Yel004w,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "uridine diphosphate-N-acetylglucosamine transporter", preferably it is the molecule of section (a) or (b) of this paragraph.

In one embodiment, said molecule, which activity is to be increased in the process of the invention and which is the gene product with an activity as described as a "uridine diphosphate-N-acetylglucosamine transporter", is increased cytoplasmic.

The sequence of Yer177w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as DNA and protein binding protein for controling the proteome at post-transcriptional level.

Accordingly, in one embodiment, the process of the present invention comprises increasing or generating the activity of a gene product with the activity "DNA and protein binding protein for controling the proteome at post-transcriptional level" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yer177w or a functional equivalent or a homologue thereof as shown depicted in column 7 of table I, preferably a homologue or functional equivalent as shown depicted in column 7 of table I B, and being depicted in the same respective line as said Yer177w; or
(b) a polypeptide comprising a polypeptide, a consensus sequence or a polypeptide motif as shown depicted in column 5 of table II and column 7 of table IV, respectively, and being depicted in the same respective line as said Yer177w or a functional equivalent or a homologue thereof as depicted in column 7 of table II, preferably a homologue or functional equivalent as depicted in column 7 of table II B, and being depicted in the same respective line as said Yer177w,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "DNA and protein binding protein for controling the proteome at post-transcriptional level", preferably it is the molecule of section (a) or (b) of this paragraph.

In one embodiment, said molecule, which activity is to be increased in the process of the invention and which is the gene product with an activity as described as a "DNA and protein binding protein for controling the proteome at post-transcriptional level", is increased cytoplasmic.

The sequence of Yhr204w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as protein required for degradation of glycoproteins.

Accordingly, in one embodiment, the process of the present invention comprises increasing or generating the activity of a gene product with the activity "protein required for degradation of glycoproteins" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yhr204w or a functional equivalent or a homologue thereof as shown depicted in column 7 of table I, preferably a homologue or functional equivalent as shown depicted in column 7 of table I B, and being depicted in the same respective line as said Yhr204w; or
(b) a polypeptide comprising a polypeptide, a consensus sequence or a polypeptide motif as shown depicted in column 5 of table II and column 7 of table IV, respectively, and being depicted in the same respective line as said Yhr204w or a functional equivalent or a homologue thereof as depicted in column 7 of table II, preferably a homologue or functional equivalent as depicted in column 7 of table II B, and being depicted in the same respective line as said Yhr204w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "protein required for degradation of glycoproteins", preferably it is the molecule of section (a) or (b) of this paragraph. In one embodiment, said molecule, which activity is to be increased in the process of the invention and which is the gene product with an activity as described as a "protein required for degradation of glycoproteins", is increased cytoplasmic.

The sequence of Yll053c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as aquaporin.

Accordingly, in one embodiment, the process of the present invention comprises increasing or generating the activity of a gene product with the activity "aquaporin" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yll053c or a functional equivalent or a homologue thereof as shown depicted in column 7 of table I, preferably a homologue or functional equivalent as shown depicted in column 7 of table I B, and being depicted in the same respective line as said Yll053c; or
(b) a polypeptide comprising a polypeptide, a consensus sequence or a polypeptide motif as shown depicted in column 5 of table II and column 7 of table IV, respectively, and being depicted in the same respective line as said Yll053c or a functional equivalent or a homologue thereof as depicted in column 7 of table II, preferably a homologue or functional equivalent as depicted in column 7 of table II B, and being depicted in the same respective line as said Yll053c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "aquaporin", preferably it is the molecule of section (a) or (b) of this paragraph.

In one embodiment, said molecule, which activity is to be increased in the process of the invention and which is the gene product with an activity as described as a "aquaporin", is increased cytoplasmic.

The sequence of Yml123c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as inorganic phosphate transporter.

Accordingly, in one embodiment, the process of the present invention comprises increasing or generating the activity of a gene product with the activity "inorganic phosphate transporter" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yml123c or a functional equivalent or a homologue thereof as shown depicted in column 7 of table I, preferably a homologue or functional equivalent as shown depicted in column 7 of table I B, and being depicted in the same respective line as said Yml123c; or
(b) a polypeptide comprising a polypeptide, a consensus sequence or a polypeptide motif as shown depicted in column 5 of table II and column 7 of table IV, respectively, and being depicted in the same respective line as said Yml123c or a functional equivalent or a homologue thereof as depicted in column 7 of table II, preferably a homologue or functional equivalent as depicted in column 7 of table II B, and being depicted in the same respective line as said Yml123c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "inorganic phosphate transporter", preferably it is the molecule of section (a) or (b) of this paragraph.

In one embodiment, said molecule, which activity is to be increased in the process of the invention and which is the gene product with an activity as described as a "inorganic phosphate transporter", is increased cytoplasmic.

The sequence of Ynl142w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as ammonium transporter.

Accordingly, in one embodiment, the process of the present invention comprises increasing or generating the activity of a gene product with the activity "ammonium transporter" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Ynl142w or a functional equivalent or a homologue thereof as shown depicted in column 7 of table I, preferably a homologue or functional equivalent as shown depicted in column 7 of table I B, and being depicted in the same respective line as said Ynl142w; or
(b) a polypeptide comprising a polypeptide, a consensus sequence or a polypeptide motif as shown depicted in column 5 of table II and column 7 of table IV, respectively, and being depicted in the same respective line as said Ynl142w or a functional equivalent or a homologue thereof as depicted in column 7 of table II, preferably a homologue or functional equivalent as depicted in column 7 of table II B, and being depicted in the same respective line as said Ynl142w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "ammonium transporter", preferably it is the molecule of section (a) or (b) of this paragraph.

In one embodiment, said molecule, which activity is to be increased in the process of the invention and which is the gene product with an activity as described as a "ammonium transporter", is increased cytoplasmic.

The sequence of Ynr040w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as YNR040W-protein.

Accordingly, in one embodiment, the process of the present invention comprises increasing or generating the activity of a gene product with the activity "YNR040W-protein" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Ynr040w or a functional equivalent or a homologue thereof as shown depicted in column 7 of table I, preferably a homologue or functional equivalent as shown depicted in column 7 of table I B, and being depicted in the same respective line as said Ynr040w; or
(b) a polypeptide comprising a polypeptide, a consensus sequence or a polypeptide motif as shown depicted in column 5 of table II and column 7 of table IV, respectively, and being depicted in the same respective line as said Ynr040w or a functional equivalent or a homologue thereof as depicted in column 7 of table II, preferably a homologue or functional equivalent as depicted in column 7 of table II B, and being depicted in the same respective line as said Ynr040w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "YNR040W-protein", preferably it is the molecule of section (a) or (b) of this paragraph.

In one embodiment, said molecule, which activity is to be increased in the process of the invention and which is the gene product with an activity as described as a "YNR040W-protein", is increased cytoplasmic.

The sequence of Ypr035w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as glutamine synthetase.

Accordingly, in one embodiment, the process of the present invention comprises increasing or generating the activity of a gene product with the activity "glutamine synthetase" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Ypr035w or a functional equivalent or a homologue thereof as shown depicted in column 7 of table I, preferably a homologue or functional equivalent as shown depicted in column 7 of table I B, and being depicted in the same respective line as said Ypr035w; or
(b) a polypeptide comprising a polypeptide, a consensus sequence or a polypeptide motif as shown depicted in column 5 of table II and column 7 of table IV, respectively, and being depicted in the same respective line as said Ypr035w or a functional equivalent or a homologue thereof as depicted in column 7 of table II, preferably a homologue or functional equivalent as depicted in column 7 of table II B, and being depicted in the same respective line as said Ypr035w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "glutamine synthetase", preferably it is the molecule of section (a) or (b) of this paragraph.

In one embodiment, said molecule, which activity is to be increased in the process of the invention and which is the gene product with an activity as described as a "glutamine synthetase", is increased cytoplasmic.

The sequence of B0903 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as formate acetyltransferase 1.

Accordingly, in one embodiment, the process of the present invention comprises increasing or generating the activity of a gene product with the activity "formate acetyltransferase 1" from *Escherichia coli* or its functional equivalent or its homolog, e.g. the increase of
(a) a gene product of a gene comprising the nucleic acid molecule as shown in column 5 of table I, and being depicted in the same respective line as said B0903 or a functional equivalent or a homologue thereof as shown depicted in column 7 of table I, preferably a homologue or functional equivalent as shown depicted in column 7 of table I B, and being depicted in the same respective line as said B0903; or
(b) a polypeptide comprising a polypeptide, a consensus sequence or a polypeptide motif as shown depicted in column 5 of table II and column 7 of table IV, respectively, and being depicted in the same respective line as said B0903 or a functional equivalent or a homologue thereof as depicted in column 7 of table II, preferably a homologue or functional equivalent as depicted in column 7 of table II B, and being depicted in the same respective line as said B0903, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "formate acetyltransferase 1", preferably it is the molecule of section (a) or (b) of this paragraph.

In one embodiment, said molecule, which activity is to be increased in the process of the invention and which is the gene product with an activity as described as a "formate acetyltransferase 1", is increased as indicated in column 6 of table I, e.g. plastidic or plastidic and/or cytoplasmic.

The sequence of B1393 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as enoyl-CoA hydratase.

Accordingly, in one embodiment, the process of the present invention comprises increasing or generating the activity of a gene product with the activity "enoyl-CoA hydratase" from *Escherichia coli* or its functional equivalent or its homolog, e.g. the increase of
(a) a gene product of a gene comprising the nucleic acid molecule as shown in column 5 of table I, and being depicted in the same respective line as said B1393 or a functional equivalent or a homologue thereof as shown depicted in column 7 of table I, preferably a homologue or functional equivalent as shown depicted in column 7 of table I B, and being depicted in the same respective line as said B1393; or
(b) a polypeptide comprising a polypeptide, a consensus sequence or a polypeptide motif as shown depicted in column 5 of table II and column 7 of table IV, respectively, and being depicted in the same respective line as said B1393 or a functional equivalent or a homologue thereof as depicted in column 7 of table II, preferably a homologue or functional equivalent as depicted in column 7 of table II B, and being depicted in the same respective line as said B1393, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "enoyl-CoA hydratase", preferably it is the molecule of section (a) or (b) of this paragraph.

In one embodiment, said molecule, which activity is to be increased in the process of the invention and which is the gene product with an activity as described as a "enoyl-CoA hydratase", is increased cytoplasmic.

The sequence of B2704 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as glucitol/sorbitol-specific enzyme IIA component protein.

Accordingly, in one embodiment, the process of the present invention comprises increasing or generating the activity of a gene product with the activity "glucitol/sorbitol-specific enzyme IIA component protein" from *Escherichia coli* or its functional equivalent or its homolog, e.g. the increase of
(a) a gene product of a gene comprising the nucleic acid molecule as shown in column 5 of table I, and being depicted in the same respective line as said B2704 or a functional equivalent or a homologue thereof as shown depicted in column 7 of table I, preferably a homologue or functional equivalent as shown depicted in column 7 of table I B, and being depicted in the same respective line as said B2704; or
(b) a polypeptide comprising a polypeptide, a consensus sequence or a polypeptide motif as shown depicted in column 5 of table II and column 7 of table IV, respectively, and being depicted in the same respective line as said B2704 or a functional equivalent or a homologue thereof as depicted in column 7 of table II, preferably a homologue or functional equivalent as depicted in column 7 of table II B, and being depicted in the same respective line as said B2704, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "glucitol/sorbitol-specific enzyme IIA component protein", preferably it is the molecule of section (a) or (b) of this paragraph.

In one embodiment, said molecule, which activity is to be increased in the process of the invention and which is the gene product with an activity as described as a "glucitol/sorbitol-specific enzyme IIA component protein", is increased plastidic.

The sequence of B2905 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as aminomethyltransferase.

Accordingly, in one embodiment, the process of the present invention comprises increasing or generating the activity of a gene product with the activity "aminomethyltransferase" from *Escherichia coli* or its functional equivalent or its homolog, e.g. the increase of
(a) a gene product of a gene comprising the nucleic acid molecule as shown in column 5 of table I, and being depicted in the same respective line as said B2905 or a functional equivalent or a homologue thereof as shown depicted in column 7 of table I, preferably a homologue or functional equivalent as shown depicted in column 7 of table I B, and being depicted in the same respective line as said B2905; or
(b) a polypeptide comprising a polypeptide, a consensus sequence or a polypeptide motif as shown depicted in column 5 of table II and column 7 of table IV, respectively, and being depicted in the same respective line as said B2905 or a functional equivalent or a homologue thereof as depicted in column 7 of table II, preferably a homologue or functional equivalent as depicted in column 7 of table II B, and being depicted in the same respective line as said B2905, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "aminomethyltransferase", preferably it is the molecule of section (a) or (b) of this paragraph.

In one embodiment, said molecule, which activity is to be increased in the process of the invention and which is the gene product with an activity as described as a "aminomethyltransferase", is increased cytoplasmic.

The sequence of B3206 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Phosphocarrier protein.

Accordingly, in one embodiment, the process of the present invention comprises increasing or generating the activity of a gene product with the activity "Phosphocarrier protein" from *Escherichia coli* or its functional equivalent or its homolog, e.g. the increase of
(a) a gene product of a gene comprising the nucleic acid molecule as shown in column 5 of table I, and being depicted in the same respective line as said B3206 or a functional equivalent or a homologue thereof as shown depicted in column 7 of table I, preferably a homologue or functional equivalent as shown depicted in column 7 of table I B, and being depicted in the same respective line as said B3206; or
(b) a polypeptide comprising a polypeptide, a consensus sequence or a polypeptide motif as shown depicted in column 5 of table II and column 7 of table IV, respectively, and being depicted in the same respective line as said B3206 or a functional equivalent or a homologue thereof as depicted in column 7 of table II, preferably a homologue or functional equivalent as depicted in column 7 of table II B, and being depicted in the same respective line as said B3206, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Phosphocarrier protein", preferably it is the molecule of section (a) or (b) of this paragraph.

In one embodiment, said molecule, which activity is to be increased in the process of the invention and which is the gene product with an activity as described as a "Phosphocarrier protein", is increased plastidic.

The sequence of B3659 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as two-module transport protein.

Accordingly, in one embodiment, the process of the present invention comprises increasing or generating the activity of a gene product with the activity "two-module transport protein" from *Escherichia coli* or its functional equivalent or its homolog, e.g. the increase of
(a) a gene product of a gene comprising the nucleic acid molecule as shown in column 5 of table I, and being depicted in the same respective line as said B3659 or a functional equivalent or a homologue thereof as shown depicted in column 7 of table I, preferably a homologue or functional equivalent as shown depicted in column 7 of table I B, and being depicted in the same respective line as said B3659; or (b) a polypeptide comprising a polypeptide, a consensus sequence or a polypeptide motif as shown depicted in column 5 of table II and column 7 of table IV, respectively, and being depicted in the same respective line as said B3659 or a functional equivalent or a homologue thereof as depicted in column 7 of table II, preferably a homologue or functional equivalent as depicted in column 7 of table II B, and being depicted in the same respective line as said B3659, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "two-module transport protein", preferably it is the molecule of section (a) or (b) of this paragraph.

In one embodiment, said molecule, which activity is to be increased in the process of the invention and which is the gene product with an activity as described as a "two-module transport protein", is increased cytoplasmic.

The sequence of B3871 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as GTP-binding protein.

Accordingly, in one embodiment, the process of the present invention comprises increasing or generating the activity of a gene product with the activity "GTP-binding protein" from *Escherichia coli* or its functional equivalent or its homolog, e.g. the increase of (a) a gene product of a gene comprising the nucleic acid molecule as shown in column 5 of table I, and being depicted in the same respective line as said B3871 or a functional equivalent or a homologue thereof as shown depicted in column 7 of table I, preferably a homologue or functional equivalent as shown depicted in column 7 of table I B, and being depicted in the same respective line as said B3871; or (b) a polypeptide comprising a polypeptide, a consensus sequence or a polypeptide motif as shown depicted in column 5 of table II and column 7 of table IV, respectively, and being depicted in the same respective line as said B3871 or a functional equivalent or a homologue thereof as depicted in column 7 of table II, preferably a homologue or functional equivalent as depicted in column 7 of table II B, and being depicted in the same respective line as said B3871, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "GTP-binding protein", preferably it is the molecule of section (a) or (b) of this paragraph.

In one embodiment, said molecule, which activity is to be increased in the process of the invention and which is the gene product with an activity as described as a "GTP-binding protein", is increased cytoplasmic.

The sequence of Ydr142c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Peroxisomal targeting signal 2 receptor.

Accordingly, in one embodiment, the process of the present invention comprises increasing or generating the activity of a gene product with the activity "Peroxisomal targeting signal 2 receptor" from *Saccharomyces cerevisiae* or its functional equivalent or its homolog, e.g. the increase of (a) a gene product of a gene comprising the nucleic acid molecule as shown in column 5 of table I, and being depicted in the same respective line as said Ydr142c or a functional equivalent or a homologue thereof as shown depicted in column 7 of table I, preferably a homologue or functional equivalent as shown depicted in column 7 of table I B, and being depicted in the same respective line as said Ydr142c; or (b) a polypeptide comprising a polypeptide, a consensus sequence or a polypeptide motif as shown depicted in column 5 of table II and column 7 of table IV, respectively, and being depicted in the same respective line as said Ydr142c or a functional equivalent or a homologue thereof as depicted in column 7 of table II, preferably a homologue or functional equivalent as depicted in column 7 of table II B, and being depicted in the same respective line as said Ydr142c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Peroxisomal targeting signal 2 receptor", preferably it is the molecule of section (a) or (b) of this paragraph.

In one embodiment, said molecule, which activity is to be increased in the process of the invention and which is the gene product with an activity as described as a "Peroxisomal targeting signal 2 receptor", is increased plastidic.

The sequence of Yer175w-a from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as yer175w-a-protein.

Accordingly, in one embodiment, the process of the present invention comprises increasing or generating the activity of a gene product with the activity "yer175w-a-protein" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yer175w-a or a functional equivalent or a homologue thereof as shown depicted in column 7 of table I, preferably a homologue or functional equivalent as shown depicted in column 7 of table I B, and being depicted in the same respective line as said Yer175w-a; or
(b) a polypeptide comprising a polypeptide, a consensus sequence or a polypeptide motif as shown depicted in column 5 of table II and column 7 of table IV, respectively, and being depicted in the same respective line as said Yer175w-a or a functional equivalent or a homologue thereof as depicted in column 7 of table II, preferably a homologue or functional equivalent as depicted in column 7 of table II B, and being depicted in the same respective line as said Yer175w-a,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "yer175w-a-protein", preferably it is the molecule of section (a) or (b) of this paragraph.

In one embodiment, said molecule, which activity is to be increased in the process of the invention and which is the gene product with an activity as described as a "yer175w-a-protein", is increased cytoplasmic.

The sequence of Ygr289c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as hexose transporter.

Accordingly, in one embodiment, the process of the present invention comprises increasing or generating the activity of a gene product with the activity "hexose transporter" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Ygr289c or a functional equivalent or a homologue thereof as shown depicted in column 7 of table I, preferably a homologue or functional equivalent as shown depicted in column 7 of table I B, and being depicted in the same respective line as said Ygr289c; or
(b) a polypeptide comprising a polypeptide, a consensus sequence or a polypeptide motif as shown depicted in column 5 of table II and column 7 of table IV, respectively, and being depicted in the same respective line as said Ygr289c or a functional equivalent or a homologue thereof as depicted in column 7 of table II, preferably a homologue or functional equivalent as depicted in column 7 of table II B, and being depicted in the same respective line as said Ygr289c,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "hexose transporter", preferably it is the molecule of section (a) or (b) of this paragraph.

In one embodiment, said molecule, which activity is to be increased in the process of the invention and which is the gene product with an activity as described as a "hexose transporter", is increased plastidic.

The sequence of Yhr044c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as 2-deoxyglucose-6-phosphate phosphatase.

Accordingly, in one embodiment, the process of the present invention comprises increasing or generating the activity of a gene product with the activity "2-deoxyglucose-6-phosphate phosphatase" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yhr044c or a functional equivalent or a homologue thereof as shown depicted in column 7 of table I, preferably a homologue or functional equivalent as shown depicted in column 7 of table I B, and being depicted in the same respective line as said Yhr044c; or
(b) a polypeptide comprising a polypeptide, a consensus sequence or a polypeptide motif as shown depicted in column 5 of table II and column 7 of table IV, respectively, and being depicted in the same respective line as said Yhr044c or a functional equivalent or a homologue thereof as depicted in column 7 of table II, preferably a homologue or functional equivalent as depicted in column 7 of table II B, and being depicted in the same respective line as said Yhr044c,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "2-deoxyglucose-6-phosphate phosphatase", preferably it is the molecule of section (a) or (b) of this paragraph.

In one embodiment, said molecule, which activity is to be increased in the process of the invention and which is the gene product with an activity as described as a "2-deoxyglucose-6-phosphate phosphatase", is increased plastidic.

The sequence of YHR072W from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as lanosterol synthase.

Accordingly, in one embodiment, the process of the present invention comprises increasing or generating the activity of a gene product with the activity "lanosterol synthase" from *Saccharomyces cerevisiae* or its functional equivalent or its homolog, e.g. the increase of
(a) a gene product of a gene comprising the nucleic acid molecule as shown in column 5 of table I, and being depicted in the same respective line as said YHR072W or a functional equivalent or a homologue thereof as shown depicted in column 7 of table I, preferably a homologue or functional equivalent as shown depicted in column 7 of table I B, and being depicted in the same respective line as said YHR072W; or
(b) a polypeptide comprising a polypeptide, a consensus sequence or a polypeptide motif as shown depicted in column 5 of table II and column 7 of table IV, respectively, and being depicted in the same respective line as said YHR072W or a functional equivalent or a homologue thereof as depicted in column 7 of table II, preferably a homologue or functional equivalent as depicted in column 7 of table II B, and being depicted in the same respective line as said YHR072W, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "lanosterol synthase", preferably it is the molecule of section (a) or (b) of this paragraph.

In one embodiment, said molecule, which activity is to be increased in the process of the invention and which is the gene product with an activity as described as a "lanosterol synthase", is increased cytoplasmic.

The sequence of Yhr213w-a from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as yhr213w-a-protein.

Accordingly, in one embodiment, the process of the present invention comprises increasing or generating the activity of a gene product with the activity "yhr213w-a-protein" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yhr213w-a or a functional equivalent or a homologue thereof as shown depicted in column 7 of table I, preferably a homologue or functional equivalent as shown depicted in column 7 of table I B, and being depicted in the same respective line as said Yhr213w-a; or
(b) a polypeptide comprising a polypeptide, a consensus sequence or a polypeptide motif as shown depicted in column 5 of table II and column 7 of table IV, respectively, and being depicted in the same respective line as said Yhr213w-a or a functional equivalent or a homologue thereof as depicted in column 7 of table II, preferably a homologue or functional equivalent as depicted in column 7 of table II B, and being depicted in the same respective line as said Yhr213w-a, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "yhr213w-a-protein", preferably it is the molecule of section (a) or (b) of this paragraph.

In one embodiment, said molecule, which activity is to be increased in the process of the invention and which is the gene product with an activity as described as a "yhr213w-a-protein", is increased cytoplasmic.

The sequence of Yil053w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as (DL)-glycerol-3-phosphatase. Accordingly, in one embodiment, the process of the present invention comprises increasing or generating the activity of a gene product with the activity "(DL)-glycerol-3-phosphatase" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Yil053w or a functional equivalent or a homologue thereof as shown depicted in column 7 of table I, preferably a homologue or functional equivalent as shown depicted in column 7 of table I B, and being depicted in the same respective line as said Yil053w; or
(b) a polypeptide comprising a polypeptide, a consensus sequence or a polypeptide motif as shown depicted in column 5 of table II and column 7 of table IV, respectively, and being depicted in the same respective line as said Yil053w or a functional equivalent or a homologue thereof as depicted in column 7 of table II, preferably a homologue or functional equivalent as depicted in column 7 of table II B, and being depicted in the same respective line as said Yil053w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "(DL)-glycerol-3-phosphatase", preferably it is the molecule of section (a) or (b) of this paragraph.

In one embodiment, said molecule, which activity is to be increased in the process of the invention and which is the gene product with an activity as described as a "(DL)-glycerol-3-phosphatase", is increased cytoplasmic.

The sequence of Yjl103c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as transcriptional regulatory protein.

Accordingly, in one embodiment, the process of the present invention comprises increasing or generating the activity of a gene product with the activity "transcriptional regulatory protein" from *Saccharomyces cerevisiae* or its functional equivalent or its homolog, e.g. the increase of (a) a gene product of a gene comprising the nucleic acid molecule as shown in column 5 of table I, and being depicted in the same respective line as said Yjl103c or a functional equivalent or a homologue thereof as shown depicted in column 7 of table I, preferably a homologue or functional equivalent as shown depicted in column 7 of table I B, and being depicted in the same respective line as said Yjl103c; or (b) a polypeptide comprising a polypeptide, a consensus sequence or a polypeptide motif as shown depicted in column 5 of table II and column 7 of table IV, respectively, and being depicted in the same respective line as said Yjl103c or a functional equivalent or a homologue thereof as depicted in column 7 of table II, preferably a homologue or functional equivalent as depicted in column 7 of table II B, and being depicted in the same respective line as said Yjl103c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "transcriptional regulatory protein", preferably it is the molecule of section (a) or (b) of this paragraph.

In one embodiment, said molecule, which activity is to be increased in the process of the invention and which is the gene product with an activity as described as a "transcriptional regulatory protein", is increased plastidic.

The sequence of Yjl137c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Glycogen synthesis initiator protein. Accordingly, in one embodiment, the process of the present invention comprises increasing or generating the activity of a gene product with the activity "Glycogen synthesis initiator protein" from *Saccharomyces cerevisiae* or its functional equivalent or its homolog, e.g. the increase of (a) a gene product of a gene comprising the nucleic acid molecule as shown in column 5 of table I, and being depicted in the same respective line as said Yjl137c or a functional equivalent or a homologue thereof as shown depicted in column 7 of table I, preferably a homologue or functional equivalent as shown depicted in column 7 of table I B, and being depicted in the same respective line as said Yjl137c; or (b) a polypeptide comprising a polypeptide, a consensus sequence or a polypeptide motif as shown depicted in column 5 of table II and column 7 of table IV, respectively, and being depicted in the same respective line as said Yjl137c or a functional equivalent or a homologue thereof as depicted in column 7 of table II, preferably a homologue or functional equivalent as depicted in column 7 of table II B, and being depicted in the same respective line as said Yjl137c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Glycogen synthesis initiator protein", preferably it is the molecule of section (a) or (b) of this paragraph.

In one embodiment, said molecule, which activity is to be increased in the process of the invention and which is the gene product with an activity as described as a "Glycogen synthesis initiator protein", is increased plastidic.

The sequence of Ylr027c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as aspartate aminotransferase.

Accordingly, in one embodiment, the process of the present invention comprises increasing or generating the activity of a gene product with the activity "aspartate aminotransferase" from *Saccharomyces cerevisiae* or its functional equivalent or its homolog, e.g. the increase of (a) a gene product of a gene comprising the nucleic acid molecule as shown in column 5 of table I, and being depicted in the same respective line as said Ylr027c or a functional equivalent or a homologue thereof as shown depicted in column 7 of table I, preferably a homologue or functional equivalent as shown depicted in column 7 of table I B, and being depicted in the same respective line as said Ylr027c; or (b) a polypeptide comprising a polypeptide, a consensus sequence or a polypeptide motif as shown depicted in column 5 of table II and column 7 of table IV, respectively, and being depicted in the same respective line as said Ylr027c or a functional equivalent or a homologue thereof as depicted in column 7 of table II, preferably a homologue or functional equivalent as depicted in column 7 of table II B, and being depicted in the same respective line as said Ylr027c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "aspartate aminotransferase", preferably it is the molecule of section (a) or (b) of this paragraph.

In one embodiment, said molecule, which activity is to be increased in the process of the invention and which is the gene product with an activity as described as a "aspartate aminotransferase", is increased cytoplasmic.

The sequence of Yml079w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as YML079W-protein.

Accordingly, in one embodiment, the process of the present invention comprises increasing or generating the activity of a gene product with the activity "YML079W-protein" from *Saccharomyces cerevisiae* or its functional equivalent or its homolog, e.g. the increase of (a) a gene product of a gene comprising the nucleic acid molecule as shown in column 5 of table I, and being depicted in the same respective line as said Yml079w or a functional equivalent or a homologue thereof as shown depicted in column 7 of table I, preferably a homologue or functional equivalent as shown depicted in column 7 of table I B, and being depicted in the same respective line as said Yml079w; or (b) a polypeptide comprising a polypeptide, a consensus sequence or a polypeptide motif as shown depicted in column 5 of table II and column 7 of table IV, respectively, and being depicted in the same respective line as said Yml079w or a functional equivalent or a homologue thereof as depicted in column 7 of table II, preferably a homologue or functional equivalent as depicted in column 7 of table II B, and being depicted in the same respective line as said Yml079w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "YML079W-protein", preferably it is the molecule of section (a) or (b) of this paragraph.

In one embodiment, said molecule, which activity is to be increased in the process of the invention and which is the gene product with an activity as described as a "YML079W-protein", is increased as indicated in column 6 of table I, e.g. plastidic or cytoplasmic.

The sequence of Ymr157c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as YMR157C-protein.

Accordingly, in one embodiment, the process of the present invention comprises increasing or generating the activity of a gene product with the activity "YMR157C-protein" from *Saccharomyces cerevisiae* or its functional equivalent or its homolog, e.g. the increase of (a) a gene product of a gene comprising the nucleic acid molecule as shown in column 5 of table I, and being depicted in the same respective line as said Ymr157c or a functional equivalent or a homologue thereof as shown depicted in column 7 of table I, preferably a homologue or functional equivalent as shown depicted in column 7 of table I B, and being depicted in the same respective line as said Ymr157c; or (b) a polypeptide comprising a polypeptide, a consensus sequence or a polypeptide motif as shown depicted in column 5 of table II and column 7 of table IV, respectively, and being depicted in the same respective line as said Ymr157c or a functional equivalent or a homologue thereof as depicted in column 7 of table II, preferably a homologue or functional equivalent as depicted in column 7 of table II B, and being depicted in the same respective line as said Ymr157c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "YMR157C-protein", preferably it is the molecule of section (a) or (b) of this paragraph.

In one embodiment, said molecule, which activity is to be increased in the process of the invention and which is the gene product with an activity as described as a "YMR157C-protein", is increased plastidic.

The sequence of Ynl024c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as YNL024C-protein.

Accordingly, in one embodiment, the process of the present invention comprises increasing or generating the activity of a gene product with the activity "YNL024C-protein" from *Saccharomyces cerevisiae* or its functional equivalent or its homolog, e.g. the increase of (a) a gene product of a gene comprising the nucleic acid molecule as shown in column 5 of table I, and being depicted in the same respective line as said Ynl024c or a functional equivalent or a homologue thereof as shown depicted in column 7 of table I, preferably a homologue or functional equivalent as shown depicted in column 7 of table I B, and being depicted in the same respective line as said Ynl024c; or (b) a polypeptide comprising a polypeptide, a consensus sequence or a polypeptide motif as shown depicted in column 5 of table II and column 7 of table IV, respectively, and being depicted in the same respective line as said Ynl024c or a functional equivalent or a homologue thereof as depicted in column 7 of table II, preferably a homologue or functional equivalent as depicted in column 7 of table II B, and being depicted in the same respective line as said Ynl024c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "YNL024C-protein", preferably it is the molecule of section (a) or (b) of this paragraph.

In one embodiment, said molecule, which activity is to be increased in the process of the invention and which is the gene product with an activity as described as a "YNL024C-protein", is increased plastidic.

The sequence of Yol058w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Argininosuccinate synthase.

Accordingly, in one embodiment, the process of the present invention comprises increasing or generating the activity of a gene product with the activity "Argininosuccinate synthase" from *Saccharomyces cerevisiae* or its functional equivalent or its homolog, e.g. the increase of (a) a gene product of a gene comprising the nucleic acid molecule as shown in column 5 of table I, and being depicted in the same respective line as said Yol058w or a functional equivalent or a homologue thereof as shown depicted in column 7 of table I, preferably a homologue or functional equivalent as shown depicted in column 7 of table I B, and being depicted in the same respective line as said Yol058w; or (b) a polypeptide comprising a polypeptide, a consensus sequence or a polypeptide motif as shown depicted in column 5 of table II and column 7 of table IV, respectively, and being depicted in the same respective line as said Yol058w or a functional equivalent or a homologue thereof as depicted in column 7 of table II, preferably a homologue or functional equivalent as depicted in column 7 of table II B, and being depicted in the same respective line as said Yol058w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Argininosuccinate synthase", preferably it is the molecule of section (a) or (b) of this paragraph.

In one embodiment, said molecule, which activity is to be increased in the process of the invention and which is the gene product with an activity as described as a "Argininosuccinate synthase", is increased as indicated in column 6 of table I, e.g. plastidic or cytoplasmic.

The sequence of Ypl180w from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as subunit of TORC1.

Accordingly, in one embodiment, the process of the present invention comprises increasing or generating the activity of a gene product with the activity "subunit of TORC1" from *Saccharomyces cerevisiae* or its functional equivalent or its homolog, e.g. the increase of (a) a gene product of a gene comprising the nucleic acid molecule as shown in column 5 of table I, and being depicted in the same respective line as said Ypl180w or a functional equivalent or a homologue thereof as shown depicted in column 7 of table I, preferably a homologue or functional equivalent as shown depicted in column 7 of table I B, and being depicted in the same respective line as said Ypl180w; or (b) a polypeptide comprising a polypeptide, a consensus sequence or a polypeptide motif as shown depicted in column 5 of table II and column 7 of table IV, respectively, and being depicted in the same respective line as said Ypl180w or a functional equivalent or a homologue thereof as depicted in column 7 of table II, preferably a homologue or functional equivalent as depicted in column 7 of table II B, and being depicted in the same respective line as said Ypl180w, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "subunit of TORC1", preferably it is the molecule of section (a) or (b) of this paragraph.

In one embodiment, said molecule, which activity is to be increased in the process of the invention and which is the gene product with an activity as described as a "subunit of TORC1", is increased cytoplasmic.

The sequence of Ypr167c from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Phosphoadenosine phosphosulfate reductase.

Accordingly, in one embodiment, the process of the present invention comprises increasing or generating the activity of a gene product with the activity "Phosphoadenosine phosphosulfate reductase" from *Saccharomyces cerevisiae* or its functional equivalent or its homolog, e.g. the increase of
(a) a gene product of a gene comprising the nucleic acid molecule as shown in column 5 of table I, and being depicted in the same respective line as said Ypr167c or a functional equivalent or a homologue thereof as shown depicted in column 7 of table I, preferably a homologue or functional equivalent as shown depicted in column 7 of table I B, and being depicted in the same respective line as said Ypr167c; or
(b) a polypeptide comprising a polypeptide, a consensus sequence or a polypeptide motif as shown depicted in column 5 of table II and column 7 of table IV, respectively, and being depicted in the same respective line as said Ypr167c or a functional equivalent or a homologue thereof as depicted in column 7 of table II, preferably a homologue or functional equivalent as depicted in column 7 of table II B, and being depicted in the same respective line as said Ypr167c, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Phosphoadenosine phosphosulfate reductase", preferably it is the molecule of section (a) or (b) of this paragraph.

In one embodiment, said molecule, which activity is to be increased in the process of the invention and which is the gene product with an activity as described as a "Phosphoadenosine phosphosulfate reductase", is increased plastidic.

The sequence of B0036 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Enoyl CoA hydratase.

Accordingly, in one embodiment, the process of the present invention comprises increasing or generating the activity of a gene product with the activity "Enoyl CoA hydratase" from *Escherichia coli* or its functional equivalent or its homolog, e.g. the increase of
(a) a gene product of a gene comprising the nucleic acid molecule as shown in column 5 of table I, and being depicted in the same respective line as said B0036 or a functional equivalent or a homologue thereof as shown depicted in column 7 of table I, preferably a homologue or functional equivalent as shown depicted in column 7 of table I B, and being depicted in the same respective line as said B0036; or
(b) a polypeptide comprising a polypeptide, a consensus sequence or a polypeptide motif as shown depicted in column 5 of table II and column 7 of table IV, respectively, and being depicted in the same respective line as said B0036 or a functional equivalent or a homologue thereof as depicted in column 7 of table II, preferably a homologue or functional equivalent as depicted in column 7 of table II B, and being depicted in the same respective line as said B0036, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Enoyl CoA hydratase", preferably it is the molecule of section (a) or (b) of this paragraph.

In one embodiment, said molecule, which activity is to be increased in the process of the invention and which is the gene product with an activity as described as a "Enoyl CoA hydratase", is increased plastidic.

The sequence of B1906 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as B1906-protein.

Accordingly, in one embodiment, the process of the present invention comprises increasing or generating the activity of a gene product with the activity "B1906-protein" from *Escherichia coli* or its functional equivalent or its homolog, e.g. the increase of
(a) a gene product of a gene comprising the nucleic acid molecule as shown in column 5 of table I, and being depicted in the same respective line as said B1906 or a functional equivalent or a homologue thereof as shown depicted in column 7 of table I, preferably a homologue or functional equivalent as shown depicted in column 7 of table I B, and being depicted in the same respective line as said B1906; or
(b) a polypeptide comprising a polypeptide, a consensus sequence or a polypeptide motif as shown depicted in column 5 of table II and column 7 of table IV, respectively, and being depicted in the same respective line as said B1906 or a functional equivalent or a homologue thereof as depicted in column 7 of table II, preferably a homologue or functional equivalent as depicted in column 7 of table II B, and being depicted in the same respective line as said B1906, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "B1906-protein", preferably it is the molecule of section (a) or (b) of this paragraph.

In one embodiment, said molecule, which activity is to be increased in the process of the invention and which is the gene product with an activity as described as a "B1906-protein", is increased cytoplasmic.

The sequence of B2371 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as CoA-transferase-like protein (NAD(P)-binding). Accordingly, in one embodiment, the process of the present invention comprises increasing or generating the activity of a gene product with the activity "CoA-transferase-like protein (NAD(P)-binding)" from *Escherichia coli* or its functional equivalent or its homolog, e.g. the increase of
(a) a gene product of a gene comprising the nucleic acid molecule as shown in column 5 of table I, and being depicted in the same respective line as said B2371 or a functional equivalent or a homologue thereof as shown depicted in column 7 of table I, preferably a homologue or functional equivalent as shown depicted in column 7 of table I B, and being depicted in the same respective line as said B2371; or
(b) a polypeptide comprising a polypeptide, a consensus sequence or a polypeptide motif as shown depicted in column 5 of table II and column 7 of table IV, respectively, and being depicted in the same respective line as said B2371 or a functional equivalent or a homologue thereof as depicted in column 7 of table II, preferably a homologue or functional equivalent as depicted in column 7 of table II B, and being depicted in the same respective line as said B2371,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "CoA-transferase-like protein (NAD(P)-binding)", preferably it is the molecule of section (a) or (b) of this paragraph.

In one embodiment, said molecule, which activity is to be increased in the process of the invention and which is the gene product with an activity as described as a "CoA-transferase-like protein (NAD(P)-binding)", is increased cytoplasmic.

The sequence of B2881 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Molybdenum-binding subunit of aldehyde oxidases and xanthine dehydrogenases.

Accordingly, in one embodiment, the process of the present invention comprises increasing or generating the activity of a gene product with the activity "Molybdenum-binding subunit of aldehyde oxidases and xanthine dehydrogenases" from *Escherichia coli* or its functional equivalent or its homolog, e.g. the increase of
(a) a gene product of a gene comprising the nucleic acid molecule as shown in column 5 of table I, and being depicted in the same respective line as said B2881 or a functional equivalent or a homologue thereof as shown depicted in column 7 of table I, preferably a homologue or functional equivalent as shown depicted in column 7 of table I B, and being depicted in the same respective line as said B2881; or
(b) a polypeptide comprising a polypeptide, a consensus sequence or a polypeptide motif as shown depicted in column 5 of table II and column 7 of table IV, respectively, and being depicted in the same respective line as said B2881 or a functional equivalent or a homologue thereof as depicted in column 7 of table II, preferably a homologue or functional equivalent as depicted in column 7 of table II B, and being depicted in the same respective line as said B2881,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Molybdenum-binding subunit of aldehyde oxidases and xanthine dehydrogenases", preferably it is the molecule of section (a) or (b) of this paragraph.

In one embodiment, said molecule, which activity is to be increased in the process of the invention and which is the gene product with an activity as described as a "Molybdenum-binding subunit of aldehyde oxidases and xanthine dehydrogenases", is increased cytoplasmic.

The sequence of B3106 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Pirin-like protein.

Accordingly, in one embodiment, the process of the present invention comprises increasing or generating the activity of a gene product with the activity "Pirin-like protein" from *Escherichia coli* or its functional equivalent or its homolog, e.g. the increase of
(a) a gene product of a gene comprising the nucleic acid molecule as shown in column 5 of table I, and being depicted in the same respective line as said B3106 or a functional equivalent or a homologue thereof as shown depicted in column 7 of table I, preferably a homologue or functional equivalent as shown depicted in column 7 of table I B, and being depicted in the same respective line as said B3106; or
(b) a polypeptide comprising a polypeptide, a consensus sequence or a polypeptide motif as shown depicted in column 5 of table II and column 7 of table IV, respectively, and being depicted in the same respective line as said B3106 or a functional equivalent or a homologue thereof as depicted in column 7 of table II, preferably a homologue or functional equivalent as depicted in column 7 of table II B, and being depicted in the same respective line as said B3106,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Pirin-like protein", preferably it is the molecule of section (a) or (b) of this paragraph.

In one embodiment, said molecule, which activity is to be increased in the process of the invention and which is the gene product with an activity as described as a "Pirin-like protein", is increased cytoplasmic.

The sequence of B3400 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Heat shock protein.

Accordingly, in one embodiment, the process of the present invention comprises increasing or generating the activity of a gene product with the activity "Heat shock protein" from *Escherichia coli* or its functional equivalent or its homolog, e.g. the increase of (a) a gene product of a gene comprising the nucleic acid molecule as shown in column 5 of table I, and being depicted in the same respective line as said B3400 or a functional equivalent or a homologue thereof as shown depicted in column 7 of table I, preferably a homologue or functional equivalent as shown depicted in column 7 of table I B, and being depicted in the same respective line as said B3400; or (b) a polypeptide comprising a polypeptide, a consensus sequence or a polypeptide motif as shown depicted in column 5 of table II and column 7 of table IV, respectively, and being depicted in the same respective line as said B3400 or a functional equivalent or a homologue thereof as depicted in column 7 of table II, preferably a homologue or functional equivalent as depicted in column 7 of table II B, and being depicted in the same respective line as said B3400, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Heat shock protein", preferably it is the molecule of section (a) or (b) of this paragraph.

In one embodiment, said molecule, which activity is to be increased in the process of the invention and which is the gene product with an activity as described as a "Heat shock protein", is increased plastidic.

The sequence of B3410 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as B3410-protein.

Accordingly, in one embodiment, the process of the present invention comprises increasing or generating the activity of a gene product with the activity "B3410-protein" from *Escherichia coli* or its functional equivalent or its homolog, e.g. the increase of (a) a gene product of a gene comprising the nucleic acid molecule as shown in column 5 of table I, and being depicted in the same respective line as said B3410 or a functional equivalent or a homologue thereof as shown depicted in column 7 of table I, preferably a homologue or functional equivalent as shown depicted in column 7 of table I B, and being depicted in the same respective line as said B3410; or (b) a polypeptide comprising a polypeptide, a consensus sequence or a polypeptide motif as shown depicted in column 5 of table II and column 7 of table IV, respectively, and being depicted in the same respective line as said B3410 or a functional equivalent or a homologue thereof as depicted in column 7 of table II, preferably a homologue or functional equivalent as depicted in column 7 of table II B, and being depicted in the same respective line as said B3410, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "B3410-protein", preferably it is the molecule of section (a) or (b) of this paragraph.

In one embodiment, said molecule, which activity is to be increased in the process of the invention and which is the gene product with an activity as described as a "B3410-protein", is increased cytoplasmic.

The sequence of B4209 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Regulator of cell morphogenesis and NO signaling.

Accordingly, in one embodiment, the process of the present invention comprises increasing or generating the activity of a gene product with the activity "Regulator of cell morphogenesis and NO signaling" from *Escherichia coli* or its functional equivalent or its homolog, e.g. the increase of (a) a gene product of a gene comprising the nucleic acid molecule as shown in column 5 of table I, and being depicted in the same respective line as said B4209 or a functional equivalent or a homologue thereof as shown depicted in column 7 of table I, preferably a homologue or functional equivalent as shown depicted in column 7 of table I B, and being depicted in the same respective line as said B4209; or (b) a polypeptide comprising a polypeptide, a consensus sequence or a polypeptide motif as shown depicted in column 5 of table II and column 7 of table IV, respectively, and being depicted in the same respective line as said B4209 or a functional equivalent or a homologue thereof as depicted in column 7 of table II, preferably a homologue or functional equivalent as depicted in column 7 of table II B, and being depicted in the same respective line as said B4209, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Regulator of cell morphogenesis and NO signaling", preferably it is the molecule of section (a) or (b) of this paragraph.

In one embodiment, said molecule, which activity is to be increased in the process of the invention and which is the gene product with an activity as described as a "Regulator of cell morphogenesis and NO signaling", is increased plastidic.

The sequence of SLL1545 from *Synechocystis* sp., e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as glutathione S-transferase.

Accordingly, in one embodiment, the process of the present invention comprises increasing or generating the activity of a gene product with the activity "glutathione S-transferase" from *Synechocystis* sp. or its functional equivalent or its homolog, e.g. the increase of (a) a gene product of a gene comprising the nucleic acid molecule as shown in column 5 of table I, and being depicted in the same respective line as said SLL1545 or a functional equivalent or a homologue thereof as shown depicted in column 7 of table I, preferably a homologue or functional equivalent as shown depicted in column 7 of table I B, and being depicted in the same respective line as said SLL1545; or (b) a polypeptide comprising a polypeptide, a consensus sequence or a polypeptide motif as shown depicted in column 5 of table II and column 7 of table IV, respectively, and being depicted in the same respective line as said SLL1545 or a functional equivalent or a homologue thereof as depicted in column 7 of table II, preferably a homologue or functional equivalent as depicted in column 7 of table II B, and being depicted in the same respective line as said SLL1545, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "glutathione S-transferase", preferably it is the molecule of section (a) or (b) of this paragraph.

In one embodiment, said molecule, which activity is to be increased in the process of the invention and which is the gene product with an activity as described as a "glutathione S-transferase", is increased cytoplasmic.

The sequence of SLR1348 from *Synechocystis* sp., e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as serine acetyltransferase.

Accordingly, in one embodiment, the process of the present invention comprises increasing or generating the activity of a gene product with the activity "serine acetyltransferase" from *Synechocystis* sp. or its functional equivalent or its homolog, e.g. the increase of (a) a gene product of a gene comprising the nucleic acid molecule as shown in column 5 of table I, and being depicted in the same respective line as said SLR1348 or a functional equivalent or a homologue thereof as shown depicted in column 7 of table I, preferably a homologue or functional equivalent as shown depicted in column 7 of table I B, and being depicted in the same respective line as said SLR1348; or (b) a polypeptide comprising a polypeptide, a consensus sequence or a polypeptide motif as shown depicted in column 5 of table II and column 7 of table IV, respectively, and being depicted in the same respective line as said SLR1348 or a functional equivalent or a homologue thereof as depicted in column 7 of table II, preferably a homologue or functional equivalent as depicted in column 7 of table II B, and being depicted in the same respective line as said SLR1348, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "serine acetyltransferase", preferably it is the molecule of section (a) or (b) of this paragraph.

In one embodiment, said molecule, which activity is to be increased in the process of the invention and which is the gene product with an activity as described as a "serine acetyltransferase", is increased Mitochondric.

The sequence of YGR191W from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as amino acid permease.

Accordingly, in one embodiment, the process of the present invention comprises increasing or generating the activity of a gene product with the activity "amino acid permease" from *Saccharomyces cerevisiae* or its functional equivalent or its homolog, e.g. the increase of
(a) a gene product of a gene comprising the nucleic acid molecule as shown in column 5 of table I, and being depicted in the same respective line as said YGR191W or a functional equivalent or a homologue thereof as shown depicted in column 7 of table I, preferably a homologue or functional equivalent as shown depicted in column 7 of table I B, and being depicted in the same respective line as said YGR191W; or
(b) a polypeptide comprising a polypeptide, a consensus sequence or a polypeptide motif as shown depicted in column 5 of table II and column 7 of table IV, respectively, and being depicted in the same respective line as said YGR191W or a functional equivalent or a homologue thereof as depicted in column 7 of table II, preferably a homologue or functional equivalent as depicted in column 7 of table II B, and being depicted in the same respective line as said YGR191W, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "amino acid permease", preferably it is the molecule of section (a) or (b) of this paragraph.

In one embodiment, said molecule, which activity is to be increased in the process of the invention and which is the gene product with an activity as described as a "amino acid permease", is increased plastidic.

The sequence of AT1G22920 from *Arabidopsis thaliana*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as signalosome complex subunit.

Accordingly, in one embodiment, the process of the present invention comprises increasing or generating the activity of a gene product with the activity "signalosome complex subunit" from *Arabidopsis thaliana* or its functional equivalent or its homolog, e.g. the increase of
(a) a gene product of a gene comprising the nucleic acid molecule as shown in column 5 of table I, and being depicted in the same respective line as said AT1G22920 or a functional equivalent or a homologue thereof as shown depicted in column 7 of table I, preferably a homologue or functional equivalent as shown depicted in column 7 of table I B, and being depicted in the same respective line as said AT1G22920; or
(b) a polypeptide comprising a polypeptide, a consensus sequence or a polypeptide motif as shown depicted in column 5 of table II and column 7 of table IV, respectively, and being depicted in the same respective line as said AT1G22920 or a functional equivalent or a homologue thereof as depicted in column 7 of table II, preferably a homologue or functional equivalent as depicted in column 7 of table II B, and being depicted in the same respective line as said AT1G22920, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "signalosome complex subunit", preferably it is the molecule of section (a) or (b) of this paragraph.

In one embodiment, said molecule, which activity is to be increased in the process of the invention and which is the gene product with an activity as described as a "signalosome complex subunit", is increased cytoplasmic.

The sequence of B1600 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as multidrug resistance protein.

Accordingly, in one embodiment, the process of the present invention comprises increasing or generating the activity of a gene product with the activity "multidrug resistance protein" from *Escherichia coli* or its functional equivalent or its homolog, e.g. the increase of
(a) a gene product of a gene comprising the nucleic acid molecule as shown in column 5 of table I, and being depicted in the same respective line as said B1600 or a functional equivalent or a homologue thereof as shown depicted in column 7 of table I, preferably a homologue or functional equivalent as shown depicted in column 7 of table I B, and being depicted in the same respective line as said B1600; or
(b) a polypeptide comprising a polypeptide, a consensus sequence or a polypeptide motif as shown depicted in column 5 of table II and column 7 of table IV, respectively, and being depicted in the same respective line as said B1600 or a functional equivalent or a homologue thereof as depicted in column 7 of table II, preferably a homologue or functional equivalent as depicted in column 7 of table II B, and being depicted in the same respective line as said B1600, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "multidrug resistance protein", preferably it is the molecule of section (a) or (b) of this paragraph.

In one embodiment, said molecule, which activity is to be increased in the process of the invention and which is the gene product with an activity as described as a "multidrug resistance protein", is increased plastidic.

The sequence of B1900 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Arabinose transport system ATP-binding protein.

Accordingly, in one embodiment, the process of the present invention comprises increasing or generating the activity of a gene product with the activity "Arabinose transport system ATP-binding protein" from *Escherichia coli* or its functional equivalent or its homolog, e.g. the increase of (a) a gene product of a gene comprising the nucleic acid molecule as shown in column 5 of table I, and being depicted in the same respective line as said B1900 or a functional equivalent or a homologue thereof as shown depicted in column 7 of table I, preferably a homologue or functional equivalent as shown depicted in column 7 of table I B, and being depicted in the same respective line as said B1900; or (b) a polypeptide comprising a polypeptide, a consensus sequence or a polypeptide motif as shown depicted in column 5 of table II and column 7 of table IV, respectively, and being depicted in the same respective line as said B1900 or a functional equivalent or a homologue thereof as depicted in column 7 of table II, preferably a homologue or functional equivalent as depicted in column 7 of table II B, and being depicted in the same respective line as said B1900, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Arabinose transport system ATP-binding protein", preferably it is the molecule of section (a) or (b) of this paragraph.

In one embodiment, said molecule, which activity is to be increased in the process of the invention and which is the gene product with an activity as described as a "Arabinose transport system ATP-binding protein", is increased plastidic.

The sequence of SLL0099 from *Synechocystis* sp., e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as precorrin-6y methylase.

Accordingly, in one embodiment, the process of the present invention comprises increasing or generating the activity of a gene product with the activity "precorrin-6y methylase" from *Synechocystis* sp. or its functional equivalent or its homolog, e.g. the increase of (a) a gene product of a gene comprising the nucleic acid molecule as shown in column 5 of table I, and being depicted in the same respective line as said SLL0099 or a functional equivalent or a homologue thereof as shown depicted in column 7 of table I, preferably a homologue or functional equivalent as shown depicted in column 7 of table I B, and being depicted in the same respective line as said SLL0099; or (b) a polypeptide comprising a polypeptide, a consensus sequence or a polypeptide motif as shown depicted in column 5 of table II and column 7 of table IV, respectively, and being depicted in the same respective line as said SLL0099 or a functional equivalent or a homologue thereof as depicted in column 7 of table II, preferably a homologue or functional equivalent as depicted in column 7 of table II B, and being depicted in the same respective line as said SLL0099, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "precorrin-6y methylase", preferably it is the molecule of section (a) or (b) of this paragraph.

In one embodiment, said molecule, which activity is to be increased in the process of the invention and which is the gene product with an activity as described as a "precorrin-6y methylase", is increased cytoplasmic.

The sequence of SLL0383 from *Synechocystis* sp., e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as cobalt transport protein.

Accordingly, in one embodiment, the process of the present invention comprises increasing or generating the activity of a gene product with the activity "cobalt transport protein" from *Synechocystis* sp. or its functional equivalent or its homolog, e.g. the increase of (a) a gene product of a gene comprising the nucleic acid molecule as shown in column 5 of table I, and being depicted in the same respective line as said SLL0383 or a functional equivalent or a homologue thereof as shown depicted in column 7 of table I, preferably a homologue or functional equivalent as shown depicted in column 7 of table I B, and being depicted in the same respective line as said SLL0383; or (b) a polypeptide comprising a polypeptide, a consensus sequence or a polypeptide motif as shown depicted in column 5 of table II and column 7 of table IV, respectively, and being depicted in the same respective line as said SLL0383 or a functional equivalent or a homologue thereof as depicted in column 7 of table II, preferably a homologue or functional equivalent as depicted in column 7 of table II B, and being depicted in the same respective line as said SLL0383, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "cobalt transport protein", preferably it is the molecule of section (a) or (b) of this paragraph.

In one embodiment, said molecule, which activity is to be increased in the process of the invention and which is the gene product with an activity as described as a "cobalt transport protein", is increased cytoplasmic.

The sequence of SLR1094 from *Synechocystis* sp., e.g. as shown in column 5 of table I, is published, and its activity is described as SLR1094-protein.

Accordingly, in one embodiment, the process of the present invention comprises increasing or generating the activity of a gene product with the activity "SLR1094-protein" from *Synechocystis* sp. or its functional equivalent or its homolog, e.g. the increase of
(a) a gene product of a gene comprising the nucleic acid molecule as shown in column 5 of table I, and being depicted in the same respective line as said SLR1094 or a functional equivalent or a homologue thereof as shown depicted in column 7 of table I, preferably a homologue or functional equivalent as shown depicted in column 7 of table I B, and being depicted in the same respective line as said SLR1094; or
(b) a polypeptide comprising a polypeptide, a consensus sequence or a polypeptide motif as shown depicted in column 5 of table II and column 7 of table IV, respectively, and being depicted in the same respective line as said SLR1094 or a functional equivalent or a homologue thereof as depicted in column 7 of table II, preferably a homologue or functional equivalent as depicted in column 7 of table II B, and being depicted in the same respective line as said SLR1094,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "SLR1094-protein", preferably it is the molecule of section (a) or (b) of this paragraph.

In one embodiment, said molecule, which activity is to be increased in the process of the invention and which is the gene product with an activity as described as a "SLR1094-protein", is increased cytoplasmic.

The sequence of SLR1520 from *Synechocystis* sp., e.g. as shown in column 5 of table I, is published, and/or its activity is described as oxidoreductase.

Accordingly, in one embodiment, the process of the present invention comprises increasing or generating the activity of a gene product with the activity "oxidoreductase" from *Synechocystis* sp. or its functional equivalent or its homolog, e.g. the increase of
(a) a gene product of a gene comprising the nucleic acid molecule as shown in column 5 of table I, and being depicted in the same respective line as said SLR1520 or a functional equivalent or a homologue thereof as shown depicted in column 7 of table I, preferably a homologue or functional equivalent as shown depicted in column 7 of table I B, and being depicted in the same respective line as said SLR1520; or
(b) a polypeptide comprising a polypeptide, a consensus sequence or a polypeptide motif as shown depicted in column 5 of table II and column 7 of table IV, respectively, and being depicted in the same respective line as said SLR1520 or a functional equivalent or a homologue thereof as depicted in column 7 of table II, preferably a homologue or functional equivalent as depicted in column 7 of table II B, and being depicted in the same respective line as said SLR1520,
as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "oxidoreductase", preferably it is the molecule of section (a) or (b) of this paragraph.

In one embodiment, said molecule, which activity is to be increased in the process of the invention and which is the gene product with an activity as described as a "oxidoreductase", is increased cytoplasmic.

The sequence of YDL142C from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as cardiolipin synthetase.

Accordingly, in one embodiment, the process of the present invention comprises increasing or generating the activity of a gene product with the activity "cardiolipin synthetase" from *Saccharomyces cerevisiae* or its functional equivalent or its homolog, e.g. the increase of
(a) a gene product of a gene comprising the nucleic acid molecule as shown in column 5 of table I, and being depicted in the same respective line as said YDL142C or a functional equivalent or a homologue thereof as shown depicted in column 7 of table I, preferably a homologue or functional equivalent as shown depicted in column 7 of table I B, and being depicted in the same respective line as said YDL142C; or
(b) a polypeptide comprising a polypeptide, a consensus sequence or a polypeptide motif as shown depicted in column 5 of table II and column 7 of table IV, respectively, and being depicted in the same respective line as said YDL142C or a functional equivalent or a homologue thereof as depicted in column 7 of table II, preferably a homologue or functional equivalent as depicted in column 7 of table II B, and being depicted in the same respective line as said YDL142C, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "cardiolipin synthetase", preferably it is the molecule of section (a) or (b) of this paragraph.

In one embodiment, said molecule, which activity is to be increased in the process of the invention and which is the gene product with an activity as described as a "cardiolipin synthetase", is increased cytoplasmic.

The sequence of YDR147W from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as ethanolamine kinase.

Accordingly, in one embodiment, the process of the present invention comprises increasing or generating the activity of a gene product with the activity "ethanolamine kinase" from *Saccharomyces cerevisiae* or its functional equivalent or its homolog, e.g. the increase of (a) a gene product of a gene comprising the nucleic acid molecule as shown in column 5 of table I, and being depicted in the same respective line as said YDR147W or a functional equivalent or a homologue thereof as shown depicted in column 7 of table I, preferably a homologue or functional equivalent as shown depicted in column 7 of table I B, and being depicted in the same respective line as said YDR147W; or (b) a polypeptide comprising a polypeptide, a consensus sequence or a polypeptide motif as shown depicted in column 5 of table II and column 7 of table IV, respectively, and being depicted in the same respective line as said YDR147W or a functional equivalent or a homologue thereof as depicted in column 7 of table II, preferably a homologue or functional equivalent as depicted in column 7 of table II B, and being depicted in the same respective line as said YDR147W, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "ethanolamine kinase", preferably it is the molecule of section (a) or (b) of this paragraph.

In one embodiment, said molecule, which activity is to be increased in the process of the invention and which is the gene product with an activity as described as a "ethanolamine kinase", is increased cytoplasmic.

The sequence of YLR284C from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as enoyl-CoA isomerase.

Accordingly, in one embodiment, the process of the present invention comprises increasing or generating the activity of a gene product with the activity "enoyl-CoA isomerase" from *Saccharomyces cerevisiae* or its functional equivalent or its homolog, e.g. the increase of (a) a gene product of a gene comprising the nucleic acid molecule as shown in column 5 of table I, and being depicted in the same respective line as said YLR284C or a functional equivalent or a homologue thereof as shown depicted in column 7 of table I, preferably a homologue or functional equivalent as shown depicted in column 7 of table I B, and being depicted in the same respective line as said YLR284C; or (b) a polypeptide comprising a polypeptide, a consensus sequence or a polypeptide motif as shown depicted in column 5 of table II and column 7 of table IV, respectively, and being depicted in the same respective line as said YLR284C or a functional equivalent or a homologue thereof as depicted in column 7 of table II, preferably a homologue or functional equivalent as depicted in column 7 of table II B, and being depicted in the same respective line as said YLR284C, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "enoyl-CoA isomerase", preferably it is the molecule of section (a) or (b) of this paragraph.

In one embodiment, said molecule, which activity is to be increased in the process of the invention and which is the gene product with an activity as described as a "enoyl-CoA isomerase", is increased plastidic.

The sequence of YPL148C from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as holo-[acyl-carrier-protein] synthase.

Accordingly, in one embodiment, the process of the present invention comprises increasing or generating the activity of a gene product with the activity "holo-[acyl-carrier-protein] synthase" from *Saccharomyces cerevisiae* or its functional equivalent or its homolog, e.g. the increase of (a) a gene product of a gene comprising the nucleic acid molecule as shown in column 5 of table I, and being depicted in the same respective line as said YPL148C or a functional equivalent or a homologue thereof as shown depicted in column 7 of table I, preferably a homologue or functional equivalent as shown depicted in column 7 of table I B, and being depicted in the same respective line as said YPL148C; or (b) a polypeptide comprising a polypeptide, a consensus sequence or a polypeptide motif as shown depicted in column 5 of table II and column 7 of table IV, respectively, and being depicted in the same respective line as said YPL148C or a functional equivalent or a homologue thereof as depicted in column 7 of table II, preferably a homologue or functional equivalent as depicted in column 7 of table II B, and being depicted in the same respective line as said YPL148C, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "holo-[acyl-carrier-protein] synthase", preferably it is the molecule of section (a) or (b) of this paragraph.

In one embodiment, said molecule, which activity is to be increased in the process of the invention and which is the gene product with an activity as described as a "holo-[acyl-carrier-protein] synthase", is increased plastidic.

The sequence of YPR074C from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as transketolase.

Accordingly, in one embodiment, the process of the present invention comprises increasing or generating the activity of a gene product with the activity "transketolase" from *Saccharomyces cerevisiae* or its functional equivalent or its homolog, e.g. the increase of (a) a gene product of a gene comprising the nucleic acid molecule as shown in column 5 of table I, and being depicted in the same respective line as said YPR074C or a functional equivalent or a homologue thereof as shown depicted in column 7 of table I, preferably a homologue or functional equivalent as shown depicted in column 7 of table I B, and being depicted in the same respective line as said YPR074C; or (b) a polypeptide comprising a polypeptide, a consensus sequence or a polypeptide motif as shown depicted in column 5 of table II and column 7 of table IV, respectively, and being depicted in the same respective line as said YPR074C or a functional equivalent or a homologue thereof as depicted in column 7 of table II, preferably a homologue or functional equivalent as depicted in column 7 of table II B, and being depicted in the same respective line as said YPR074C, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "transketolase", preferably it is the molecule of section (a) or (b) of this paragraph.

In one embodiment, said molecule, which activity is to be increased in the process of the invention and which is the gene product with an activity as described as a "transketolase", is increased plastidic.

The sequence of B1008 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as NADH dehydrogenase/NAD(P)H nitroreductase.

Accordingly, in one embodiment, the process of the present invention comprises increasing or generating the activity of a gene product with the activity "NADH dehydrogenase/NAD(P)H nitroreductase" from *Escherichia coli* or its functional equivalent or its homolog, e.g. the increase of (a) a gene product of a gene comprising the nucleic acid molecule as shown in column 5 of table I, and being depicted in the same respective line as said B1008 or a functional equivalent or a homologue thereof as shown depicted in column 7 of table I, preferably a homologue or functional equivalent as shown depicted in column 7 of table I B, and being depicted in the same respective line as said B1008; or (b) a polypeptide comprising a polypeptide, a consensus sequence or a polypeptide motif as shown depicted in column 5 of table II and column 7 of table IV, respectively, and being depicted in the same respective line as said B1008 or a functional equivalent or a homologue thereof as depicted in column 7 of table II, preferably a homologue or functional equivalent as depicted in column 7 of table II B, and being depicted in the same respective line as said B1008, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "NADH dehydrogenase/NAD(P)H nitroreductase", preferably it is the molecule of section (a) or (b) of this paragraph.

In one embodiment, said molecule, which activity is to be increased in the process of the invention and which is the gene product with an activity as described as a "NADH dehydrogenase/NAD(P)H nitroreductase", is increased plastidic.

The sequence of B1529 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as multiple drug resistance protein.

Accordingly, in one embodiment, the process of the present invention comprises increasing or generating the activity of a gene product with the activity "multiple drug resistance protein" from *Escherichia coli* or its functional equivalent or its homolog, e.g. the increase of (a) a gene product of a gene comprising the nucleic acid molecule as shown in column 5 of table I, and being depicted in the same respective line as said B1529 or a functional equivalent or a homologue thereof as shown depicted in column 7 of table I, preferably a homologue or functional equivalent as shown depicted in column 7 of table I B, and being depicted in the same respective line as said B1529; or (b) a polypeptide comprising a polypeptide, a consensus sequence or a polypeptide motif as shown depicted in column 5 of table II and column 7 of table IV, respectively, and being depicted in the same respective line as said B1529 or a functional equivalent or a homologue thereof as depicted in column 7 of table II, preferably a homologue or functional equivalent as depicted in column 7 of table II B, and being depicted in the same respective line as said B1529, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "multiple drug resistance protein", preferably it is the molecule of section (a) or (b) of this paragraph.

In one embodiment, said molecule, which activity is to be increased in the process of the invention and which is the gene product with an activity as described as a "multiple drug resistance protein", is increased plastidic.

The sequence of B3347 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as peptidyl-prolyl cis-trans isomerase.

Accordingly, in one embodiment, the process of the present invention comprises increasing or generating the activity of a gene product with the activity "peptidyl-prolyl cis-trans isomerase" from *Escherichia coli* or its functional equivalent or its homolog, e.g. the increase of (a) a gene product of a gene comprising the nucleic acid molecule as shown in column 5 of table I, and being depicted in the same respective line as said B3347 or a functional equivalent or a homologue thereof as shown depicted in column 7 of table I, preferably a homologue or functional equivalent as shown depicted in column 7 of table I B, and being depicted in the same respective line as said B3347; or (b) a polypeptide comprising a polypeptide, a consensus sequence or a polypeptide motif as shown depicted in column 5 of table II and column 7 of table IV, respectively, and being depicted in the same respective line as said B3347 or a functional equivalent or a homologue thereof as depicted in column 7 of table II, preferably a homologue or functional equivalent as depicted in column 7 of table II B, and being depicted in the same respective line as said B3347, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "peptidyl-prolyl cis-trans isomerase", preferably it is the molecule of section (a) or (b) of this paragraph.

In one embodiment, said molecule, which activity is to be increased in the process of the invention and which is the gene product with an activity as described as a "peptidyl-prolyl cis-trans isomerase", is increased plastidic.

The sequence of YBR176W from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as 3-methyl-2-oxobutanoate hydroxymethyltransferase.

Accordingly, in one embodiment, the process of the present invention comprises increasing or generating the activity of a gene product with the activity "3-methyl-2-oxobutanoate hydroxymethyltransferase" from *Saccharomyces cerevisiae* or its functional equivalent or its homolog, e.g. the increase of (a) a gene product of a gene comprising the nucleic acid molecule as shown in column 5 of table I, and being depicted in the same respective line as said YBR176W or a functional equivalent or a homologue thereof as shown depicted in column 7 of table I, preferably a homologue or functional equivalent as shown depicted in column 7 of table I B, and being depicted in the same respective line as said YBR176W; or (b) a polypeptide comprising a polypeptide, a consensus sequence or a polypeptide motif as shown depicted in column 5 of table II and column 7 of table IV, respectively, and being depicted in the same respective line as said YBR176W or a functional equivalent or a homologue thereof as depicted in column 7 of table II, preferably a homologue or functional equivalent as depicted in column 7 of table II B, and being depicted in the same respective line as said YBR176W, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "3-methyl-2-oxobutanoate hydroxymethyltransferase", preferably it is the molecule of section (a) or (b) of this paragraph. In one embodiment, said molecule, which activity is to be increased in the process of the invention and which is the gene product with an activity as described as a "3-methyl-2-oxobutanoate hydroxymethyltransferase", is increased cytoplasmic.

The sequence of YGR177C from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as alcohol acetyltransferase. Accordingly, in one embodiment, the process of the present invention comprises increasing or generating the activity of a gene product with the activity "alcohol acetyltransferase" from *Saccharomyces cerevisiae* or its functional equivalent or its homolog, e.g. the increase of (a) a gene product of a gene comprising the nucleic acid molecule as shown in column 5 of table I, and being depicted in the same respective line as said YGR177C or a functional equivalent or a homologue thereof as shown depicted in column 7 of table I, preferably a homologue or functional equivalent as shown depicted in column 7 of table I B, and being depicted in the same respective line as said YGR177C; or (b) a polypeptide comprising a polypeptide, a consensus sequence or a polypeptide motif as shown depicted in column 5 of table II and column 7 of table IV, respectively, and being depicted in the same respective line as said YGR177C or a functional equivalent or a homologue thereof as depicted in column 7 of table II, preferably a homologue or functional equivalent as depicted in column 7 of table II B, and being depicted in the same respective line as said YGR177C, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "alcohol acetyltransferase", preferably it is the molecule of section (a) or (b) of this paragraph.

In one embodiment, said molecule, which activity is to be increased in the process of the invention and which is the gene product with an activity as described as a "alcohol acetyltransferase", is increased cytoplasmic.

The sequence of YHR176W from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as thiol-specific monooxygenase.

Accordingly, in one embodiment, the process of the present invention comprises increasing or generating the activity of a gene product with the activity "thiol-specific monooxygenase" from *Saccharomyces cerevisiae* or its functional equivalent or its homolog, e.g. the increase of (a) a gene product of a gene comprising the nucleic acid molecule as shown in column 5 of table I, and being depicted in the same respective line as said YHR176W or a functional equivalent or a homologue thereof as shown depicted in column 7 of table I, preferably a homologue or functional equivalent as shown depicted in column 7 of table I B, and being depicted in the same respective line as said YHR176W; or (b) a polypeptide comprising a polypeptide, a consensus sequence or a polypeptide motif as shown depicted in column 5 of table II and column 7 of table IV, respectively, and being depicted in the same respective line as said YHR176W or a functional equivalent or a homologue thereof as depicted in column 7 of table II, preferably a homologue or functional equivalent as depicted in column 7 of table II B, and being depicted in the same respective line as said YHR176W, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "thiol-specific monooxygenase", preferably it is the molecule of section (a) or (b) of this paragraph.

In one embodiment, said molecule, which activity is to be increased in the process of the invention and which is the gene product with an activity as described as a "thiol-specific monooxygenase", is increased cytoplasmic.

The sequence of B2881_2 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Molybdenum-binding subunit of aldehyde oxidases and xanthine dehydrogenases.

Accordingly, in one embodiment, the process of the present invention comprises increasing or generating the activity of a gene product with the activity "Molybdenum-binding subunit of aldehyde oxidases and xanthine dehydrogenases" from *Escherichia coli* or its functional equivalent or its homolog, e.g. the increase of (a) a gene product of a gene comprising the nucleic acid molecule as shown in column 5 of table I, and being depicted in the same respective line as said B2881_2 or a functional equivalent or a homologue thereof as shown depicted in column 7 of table I, preferably a homologue or functional equivalent as shown depicted in column 7 of table I B, and being depicted in the same respective line as said B2881_2; or (b) a polypeptide comprising a polypeptide, a consensus sequence or a polypeptide motif as shown depicted in column 5 of table II and column 7 of table IV, respectively, and being depicted in the same respective line as said B2881_2 or a functional equivalent or a homologue thereof as depicted in column 7 of table II, preferably a homologue or functional equivalent as depicted in column 7 of table II B, and being depicted in the same respective line as said B2881_2, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Molybdenum-binding subunit of aldehyde oxidases and xanthine dehydrogenases", preferably it is the molecule of section (a) or (b) of this paragraph.

In one embodiment, said molecule, which activity is to be increased in the process of the invention and which is the gene product with an activity as described as a "Molybdenum-binding subunit of aldehyde oxidases and xanthine dehydrogenases", is increased cytoplasmic.

The sequence of B3945__2 from *Escherichia coli*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as glycerol dehydrogenase.

Accordingly, in one embodiment, the process of the present invention comprises increasing or generating the activity of a gene product with the activity "glycerol dehydrogenase" from *Escherichia coli* or its functional equivalent or its homolog, e.g. the increase of (a) a gene product of a gene comprising the nucleic acid molecule as shown in column 5 of table I, and being depicted in the same respective line as said B3945__2 or a functional equivalent or a homologue thereof as shown depicted in column 7 of table I, preferably a homologue or functional equivalent as shown depicted in column 7 of table I B, and being depicted in the same respective line as said B3945__2; or (b) a polypeptide comprising a polypeptide, a consensus sequence or a polypeptide motif as shown depicted in column 5 of table II and column 7 of table IV, respectively, and being depicted in the same respective line as said B3945__2 or a functional equivalent or a homologue thereof as depicted in column 7 of table II, preferably a homologue or functional equivalent as depicted in column 7 of table II B, and being depicted in the same respective line as said B3945__2, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "glycerol dehydrogenase", preferably it is the molecule of section (a) or (b) of this paragraph.

In one embodiment, said molecule, which activity is to be increased in the process of the invention and which is the gene product with an activity as described as a "glycerol dehydrogenase", is increased cytoplasmic.

The sequence of Yhr204w__2 from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as protein required for degradation of glycoproteins.

Accordingly, in one embodiment, the process of the present invention comprises increasing or generating the activity of a gene product with the activity "protein required for degradation of glycoproteins" from *Saccharomyces cerevisiae* or its functional equivalent or its homolog, e.g. the increase of (a) a gene product of a gene comprising the nucleic acid molecule as shown in column 5 of table I, and being depicted in the same respective line as said Yhr204w__2 or a functional equivalent or a homologue thereof as shown depicted in column 7 of table I, preferably a homologue or functional equivalent as shown depicted in column 7 of table I B, and being depicted in the same respective line as said Yhr204w__2; or (b) a polypeptide comprising a polypeptide, a consensus sequence or a polypeptide motif as shown depicted in column 5 of table II and column 7 of table IV, respectively, and being depicted in the same respective line as said Yhr204w__2 or a functional equivalent or a homologue thereof as depicted in column 7 of table II, preferably a homologue or functional equivalent as depicted in column 7 of table II B, and being depicted in the same respective line as said Yhr204w__2, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "protein required for degradation of glycoproteins", preferably it is the molecule of section (a) or (b) of this paragraph.

In one embodiment, said molecule, which activity is to be increased in the process of the invention and which is the gene product with an activity as described as a "protein required for degradation of glycoproteins", is increased cytoplasmic.

The sequence of Ynl142w__2 from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as ammonium transporter.

Accordingly, in one embodiment, the process of the present invention comprises increasing or generating the activity of a gene product with the activity "ammonium transporter" from *Saccharomyces cerevisiae* or its functional equivalent or its homolog, e.g. the increase of (a) a gene product of a gene comprising the nucleic acid molecule as shown in column 5 of table I, and being depicted in the same respective line as said Ynl142w__2 or a functional equivalent or a homologue thereof as shown depicted in column 7 of table I, preferably a homologue or functional equivalent as shown depicted in column 7 of table I B, and being depicted in the same respective line as said Ynl142w__2; or (b) a polypeptide comprising a polypeptide, a consensus sequence or a polypeptide motif as shown depicted in column 5 of table II and column 7 of table IV, respectively, and being depicted in the same respective line as said Ynl142w__2 or a functional equivalent or a homologue thereof as depicted in column 7 of table II, preferably a homologue or functional equivalent as depicted in column 7 of table II B, and being depicted in the same respective line as said Ynl142w__2, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "ammonium transporter", preferably it is the molecule of section (a) or (b) of this paragraph.

In one embodiment, said molecule, which activity is to be increased in the process of the invention and which is the gene product with an activity as described as a "ammonium transporter", is increased cytoplasmic.

The sequence of Yol058w__2 from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as Argininosuccinate synthase.

Accordingly, in one embodiment, the process of the present invention comprises increasing or generating the activity of a gene product with the activity "Argininosuccinate synthase" from *Saccharomyces cerevisiae* or its functional equivalent or its homolog, e.g. the increase of (a) a gene product of a gene comprising the nucleic acid molecule as shown in column 5 of table I, and being depicted in the same respective line as said Yol058w__2 or a functional equivalent or a homologue thereof as shown depicted in column 7 of table I, preferably a homologue or functional equivalent as shown depicted in column 7 of table I B, and being depicted in the same respective line as said Yol058w__2; or (b) a polypeptide comprising a polypeptide, a consensus sequence or a polypeptide motif as shown depicted in column 5 of table II and column 7 of table IV, respectively, and being depicted in the same respective line as said Yol058w__2 or a functional equivalent or a homologue thereof as depicted in column 7 of table II, preferably a homologue or functional equivalent as depicted in column 7 of table II B, and being depicted in the same respective line as said Yol058w__2, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "Argininosuccinate synthase", preferably it is the molecule of section (a) or (b) of this paragraph.

In one embodiment, said molecule, which activity is to be increased in the process of the invention and which is the gene product with an activity as described as a "Argininosuccinate synthase", is increased as indicated in column 6 of table I, e.g. plastidic or cytoplasmic.

The sequence of Ypr035w__2 from *Saccharomyces cerevisiae*, e.g. as shown in column 5 of table I, is published (e.g. sequences from *S. cerevisiae* have been published in Goffeau et al., Science 274 (5287), 546 (1996), sequences from *E. coli* have been published in Blattner et al., Science 277 (5331), 1453 (1997)), and/or its activity is described as glutamine synthetase.

Accordingly, in one embodiment, the process of the present invention comprises increasing or generating the activity of a gene product with the activity "glutamine synthetase" from *Saccharomyces cerevisiae* or its functional equivalent or its homolog, e.g. the increase of (a) a gene product of a gene comprising the nucleic acid molecule as shown in column 5 of table I, and being depicted in the same respective line as said Ypr035w__2 or a functional equivalent or a homologue thereof as shown depicted in column 7 of table I, preferably a homologue or functional equivalent as shown depicted in column 7 of table I B, and being depicted in the same respective line as said Ypr035w__2; or (b) a polypeptide comprising a polypeptide, a consensus sequence or a polypeptide motif as shown depicted in column 5 of table II and column 7 of table IV, respectively, and being depicted in the same respective line as said Ypr035w__2 or a functional equivalent or a homologue thereof as depicted in column 7 of table II, preferably a homologue or functional equivalent as depicted in column 7 of table II B, and being depicted in the same respective line as said Ypr035w__2, as mentioned herein, for increasing yield, e.g. increasing one or more yield-related trait, for example enhanced tolerance to abiotic environmental stress, for example increasing drought tolerance and/or low temperature tolerance and/or increasing nutrient use efficiency, and/as compared to a corresponding, e.g. non-transformed, wild type plant cell, plant or part thereof in plant cell, plant or part thereof, as mentioned, especially for an enhanced tolerance to abiotic environmental stress, or increased yield, or an enhanced tolerance to abiotic environmental stress and increased yield.

Accordingly, in one embodiment, the molecule which activity is to be increased in the process of the invention is the gene product with an activity of described as a "glutamine synthetase", preferably it is the molecule of section (a) or (b) of this paragraph.

In one embodiment, said molecule, which activity is to be increased in the process of the invention and which is the gene product with an activity as described as a "glutamine synthetase", is increased cytoplasmic.

Surprisingly, it was observed that an increasing or generating of at least one gene conferring an activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein or of a gene comprising a nucleic acid sequence described in column 5 of table I, in a plant, e.g. *A. thaliana*, conferred with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait in the transformed plants as compared to a corresponding, e.g. non-transformed, wild type plant, especially an enhanced tolerance to abiotic environmental stress, or an increased yield, or an enhanced tolerance to abiotic environmental stress and increased yield In particular, it was observed that increasing or generating the activity of a gene product being encoded by a gene comprising the nucleic acid sequence SEQ ID NO.: 38 in *A. thaliana*, for example with the activity of a "pyrimidine deaminase/reductase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "pyrimidine deaminase/reductase" and being encoded by a gene comprising the nucleic acid sequence SEQ ID NO.: 38 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 38 localized as indicated in table I, column 6, e.g. cytoplasmic in *A. thaliana*, for example with the activity of a "pyrimidine deaminase/reductase", conferred an increased yield, for example a low temperature tolerance.

In particular, it was observed that increasing or generating the activity of a gene product being encoded by a gene comprising the nucleic acid sequence SEQ ID NO.: 147 in *A. thaliana*, for example with the activity of a "oxidoreductase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "oxidoreductase" and being encoded by a gene comprising the nucleic acid sequence SEQ ID NO.: 147 in *A. thaliana* conferred an tolerance to abiotic environmental stress, e.g. increase low temperature tolerance compared with the wild type control.

In particular, it was observed that increasing or generating the activity of a gene product being encoded by a gene comprising the nucleic acid sequence SEQ ID NO.: 147 localized as indicated in table I, column 6, e.g. cytoplasmic in *A. thaliana*, for example with the activity of a "oxidoreductase", conferred an increased yield, for example a low temperature tolerance.

In particular, it was observed that increasing or generating the activity of a gene product being encoded by a gene comprising the nucleic acid sequence SEQ ID NO.: 172 in *A. thaliana*, for example with the activity of a "glycerol dehydrogenase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "glycerol dehydrogenase" and being encoded by a gene comprising the nucleic acid sequence SEQ ID NO.: 172 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 172 localized as indicated in table I, column 6, e.g. cytoplasmic in *A. thaliana*, for example with the activity of a "glycerol dehydrogenase", conferred an increased yield, for example a low temperature tolerance.

In particular, it was observed that increasing or generating the activity of a gene product being encoded by a gene comprising the nucleic acid sequence SEQ ID NO.: 382 in *A. thaliana*, for example with the activity of a "uridine diphosphate-N-acetylglucosamine transporter", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "uridine diphosphate-N-acetylglucosamine transporter" and being encoded by a gene comprising the nucleic acid sequence SEQ ID NO.: 382 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 382 localized as indicated in table I, column 6, e.g. cytoplasmic in *A. thaliana*, for example with the activity of a "uridine diphosphate-N-acetylglucosamine transporter", conferred an increased yield, for example a low temperature tolerance.

In particular, it was observed that increasing or generating the activity of a gene product being encoded by a gene comprising the nucleic acid sequence SEQ ID NO.: 406 in *A. thaliana*, for example with the activity of a "DNA and protein binding protein for controlling the proteome at post-transcriptional level", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "DNA and protein binding protein for controlling the proteome at post-transcriptional level" and being encoded by a gene comprising the nucleic acid sequence SEQ ID NO.: 406 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 406 localized as indicated in table I, column 6, e.g. cytoplasmic in *A. thaliana*, for example with the activity of a "DNA and protein binding protein for controlling the proteome at post-transcriptional level", conferred an increased yield, for example a low temperature tolerance.

In particular, it was observed that increasing or generating the activity of a gene product being encoded by a gene comprising the nucleic acid sequence SEQ ID NO.: 917 in *A. thaliana*, for example with the activity of a "protein required for degradation of glycoproteins", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "protein required for degradation of glycoproteins" and being encoded by a gene comprising the nucleic acid sequence SEQ ID NO.: 917 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 917 localized as indicated in table I, column 6, e.g. cytoplasmic in *A. thaliana*, for example with the activity of a "protein required for degradation of glycoproteins", conferred an increased yield, for example a low temperature tolerance.

In particular, it was observed that increasing or generating the activity of a gene product being encoded by a gene comprising the nucleic acid sequence SEQ ID NO.: 952 in *A. thaliana*, for example with the activity of a "aquaporin", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "aquaporin" and being encoded by a gene comprising the nucleic acid sequence SEQ ID NO.: 952 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 952 localized as indicated in table I, column 6, e.g. cytoplasmic in *A. thaliana*, for example with the activity of a "aquaporin", conferred an increased yield, for example a low temperature tolerance.

In particular, it was observed that increasing or generating the activity of a gene product being encoded by a gene comprising the nucleic acid sequence SEQ ID NO.: 1320 in *A. thaliana*, for example with the activity of a "inorganic phosphate transporter", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "inorganic phosphate transporter" and being encoded by a gene comprising the nucleic acid sequence SEQ ID NO.: 1320 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 1320 localized as indicated in table I, column 6, e.g. cytoplasmic in *A. thaliana*, for example with the activity of a "inorganic phosphate transporter", conferred an increased yield, for example a low temperature tolerance.

In particular, it was observed that increasing or generating the activity of a gene product being encoded by a gene comprising the nucleic acid sequence SEQ ID NO.: 1648 in *A. thaliana*, for example with the activity of a "ammonium transporter", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "ammonium transporter" and being encoded by a gene comprising the nucleic acid sequence SEQ ID NO.: 1648 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 1648 localized as indicated in table I, column 6, e.g. cytoplasmic in *A. thaliana*, for example with the activity of a "ammonium transporter", conferred an increased yield, for example a low temperature tolerance.

In particular, it was observed that increasing or generating the activity of a gene product being encoded by a gene comprising the nucleic acid sequence SEQ ID NO.: 2065 in *A. thaliana*, for example with the activity of a "YNR040W-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "YNR040W-protein" and being encoded by a gene comprising the nucleic acid sequence SEQ ID NO.: 2065 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 2065 localized as indicated in table I, column 6, e.g. cytoplasmic in *A. thaliana*, for example with the activity of a "YNR040W-protein", conferred an increased yield, for example a low temperature tolerance.

In particular, it was observed that increasing or generating the activity of a gene product being encoded by a gene comprising the nucleic acid sequence SEQ ID NO.: 2081 in *A. thaliana*, for example with the activity of a "glutamine synthetase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "glutamine synthetase" and being encoded by a gene comprising the nucleic acid sequence SEQ ID NO.: 2081 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 2081 localized as indicated in table I, column 6, e.g. cytoplasmic in *A. thaliana*, for example with the activity of a "glutamine synthetase", conferred an increased yield, for example a low temperature tolerance.

In particular, it was observed that increasing or generating the activity of a gene product being encoded by a gene comprising the nucleic acid sequence SEQ ID NO.: 2406 in *A. thaliana*, for example with the activity of a "formate acetyltransferase 1", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "formate acetyltransferase 1" and being encoded by a gene comprising the nucleic acid sequence SEQ ID NO.: 2406 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 2406 localized as indicated in table I, column 6, e.g. plastidic or plastidic and/or cytoplasmic in *A. thaliana*, for example with the activity of a "formate acetyltransferase 1", conferred an increased yield, for example a low temperature tolerance. In particular, it was observed that increasing or generating the activity of a gene product being encoded by a gene comprising the nucleic acid sequence SEQ ID NO.: 2564 in *A. thaliana*, for example with the activity of a "enoyl-CoA hydratase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "enoyl-CoA hydratase" and being encoded by a gene comprising the nucleic acid sequence SEQ ID NO.: 2564 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 2564 localized as indicated in table I, column 6, e.g. cytoplasmic in *A. thaliana*, for example with the activity of a "enoyl-CoA hydratase", conferred an increased yield, for example a low temperature tolerance.

In particular, it was observed that increasing or generating the activity of a gene product being encoded by a gene comprising the nucleic acid sequence SEQ ID NO.: 2841 in *A. thaliana*, for example with the activity of a "glucitol/sorbitol-specific enzyme IIA component protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "glucitol/sorbitol-specific enzyme IIA component protein" and being encoded by a gene comprising the nucleic acid sequence SEQ ID NO.: 2841 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 2841 localized as indicated in table I, column 6, e.g. plastidic in *A. thaliana*, for example with the activity of a "glucitol/sorbitol-specific enzyme IIA component protein", conferred an increased yield, for example a low temperature tolerance.

In particular, it was observed that increasing or generating the activity of a gene product being encoded by a gene comprising the nucleic acid sequence SEQ ID NO.: 2879 in *A. thaliana*, for example with the activity of a "aminomethyltransferase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "aminomethyltransferase" and being encoded by a gene comprising the nucleic acid sequence SEQ ID NO.: 2879 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 2879 localized as indicated in table I, column 6, e.g. cytoplasmic in *A. thaliana*, for example with the activity of a "aminomethyltransferase", conferred an increased yield, for example a low temperature tolerance.

In particular, it was observed that increasing or generating the activity of a gene product being encoded by a gene comprising the nucleic acid sequence SEQ ID NO.: 3109 in *A. thaliana*, for example with the activity of a "Phosphocarrier protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Phosphocarrier protein" and being encoded by a gene comprising the nucleic acid sequence SEQ ID NO.: 3109 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 3109 localized as indicated in table I, column 6, e.g. plastidic in *A. thaliana*, for example with the activity of a "Phosphocarrier protein", conferred an increased yield, for example a low temperature tolerance.

In particular, it was observed that increasing or generating the activity of a gene product being encoded by a gene comprising the nucleic acid sequence SEQ ID NO.: 3403 in *A. thaliana*, for example with the activity of a "two-module transport protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "two-module transport protein" and being encoded by a gene comprising the nucleic acid sequence SEQ ID NO.: 3403 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 3403 localized as indicated in table I, column 6, e.g. cytoplasmic in *A. thaliana*, for example with the activity of a "two-module transport protein", conferred an increased yield, for example a low temperature tolerance.

In particular, it was observed that increasing or generating the activity of a gene product being encoded by a gene comprising the nucleic acid sequence SEQ ID NO.: 3441 in *A. thaliana*, for example with the activity of a "GTP-binding protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "GTP-binding protein" and being encoded by a gene comprising the nucleic acid sequence SEQ ID NO.: 3441 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 3441 localized as indicated in table I, column 6, e.g. cytoplasmic in *A. thaliana*, for example with the activity of a "GTP-binding protein", conferred an increased yield, for example a low temperature tolerance.

In particular, it was observed that increasing or generating the activity of a gene product being encoded by a gene comprising the nucleic acid sequence SEQ ID NO.: 3978 in *A. thaliana*, for example with the activity of a "Peroxisomal targeting signal 2 receptor", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Peroxisomal targeting signal 2 receptor" and being encoded by a gene comprising the nucleic acid sequence SEQ ID NO.: 3978 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 3978 localized as indicated in table I, column 6, e.g. plastidic in *A. thaliana*, for example with the activity of a "Peroxisomal targeting signal 2 receptor", conferred an increased yield, for example a low temperature tolerance.

In particular, it was observed that increasing or generating the activity of a gene product being encoded by a gene comprising the nucleic acid sequence SEQ ID NO.: 4047 in *A. thaliana*, for example with the activity of a "yer175w-a-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "yer175w-a-protein" and being encoded by a gene comprising the nucleic acid sequence SEQ ID NO.: 4047 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4047 localized as indicated in table I, column 6, e.g. cytoplasmic in *A. thaliana*, for example with the activity of a "yer175w-a-protein", conferred an increased yield, for example a low temperature tolerance.

In particular, it was observed that increasing or generating the activity of a gene product being encoded by a gene comprising the nucleic acid sequence SEQ ID NO.: 4051 in *A. thaliana*, for example with the activity of a "hexose transporter", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "hexose transporter" and being encoded by a gene comprising the nucleic acid sequence SEQ ID NO.: 4051 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4051 localized as indicated in table I, column 6, e.g. plastidic in *A. thaliana*, for example with the activity of a "hexose transporter", conferred an increased yield, for example a low temperature tolerance.

In particular, it was observed that increasing or generating the activity of a gene product being encoded by a gene comprising the nucleic acid sequence SEQ ID NO.: 4131 in *A. thaliana*, for example with the activity of a "2-deoxyglucose-6-phosphate phosphatase", conferred an increased yield, e.g.

an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "2-deoxyglucose-6-phosphate phosphatase" and being encoded by a gene comprising the nucleic acid sequence SEQ ID NO.: 4131 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4131 localized as indicated in table I, column 6, e.g. plastidic in *A. thaliana*, for example with the activity of a "2-deoxyglucose-6-phosphate phosphatase", conferred an increased yield, for example a low temperature tolerance.

In particular, it was observed that increasing or generating the activity of a gene product being encoded by a gene comprising the nucleic acid sequence SEQ ID NO.: 4217 in *A. thaliana*, for example with the activity of a "lanosterol synthase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "lanosterol synthase" and being encoded by a gene comprising the nucleic acid sequence SEQ ID NO.: 4217 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4217 localized as indicated in table I, column 6, e.g. cytoplasmic in *A. thaliana*, for example with the activity of a "lanosterol synthase", conferred an increased yield, for example a low temperature tolerance.

In particular, it was observed that increasing or generating the activity of a gene product being encoded by a gene comprising the nucleic acid sequence SEQ ID NO.: 4491 in *A. thaliana*, for example with the activity of a "yhr213w-a-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "yhr213w-a-protein" and being encoded by a gene comprising the nucleic acid sequence SEQ ID NO.: 4491 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4491 localized as indicated in table I, column 6, e.g. cytoplasmic in *A. thaliana*, for example with the activity of a "yhr213w-a-protein", conferred an increased yield, for example a low temperature tolerance.

In particular, it was observed that increasing or generating the activity of a gene product being encoded by a gene comprising the nucleic acid sequence SEQ ID NO.: 4495 in *A. thaliana*, for example with the activity of a "(DL)-glycerol-3-phosphatase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "(DL)-glycerol-3-phosphatase" and being encoded by a gene comprising the nucleic acid sequence SEQ ID NO.: 4495 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4495 localized as indicated in table I, column 6, e.g. cytoplasmic in *A. thaliana*, for example with the activity of a "(DL)-glycerol-3-phosphatase", conferred an increased yield, for example a low temperature tolerance.

In particular, it was observed that increasing or generating the activity of a gene product being encoded by a gene comprising the nucleic acid sequence SEQ ID NO.: 4558 in *A. thaliana*, for example with the activity of a "transcriptional regulatory protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "transcriptional regulatory protein" and being encoded by a gene comprising the nucleic acid sequence SEQ ID NO.: 4558 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4558 localized as indicated in table I, column 6, e.g. plastidic in *A. thaliana*, for example with the activity of a "transcriptional regulatory protein", conferred an increased yield, for example a low temperature tolerance.

In particular, it was observed that increasing or generating the activity of a gene product being encoded by a gene comprising the nucleic acid sequence SEQ ID NO.: 4589 in *A. thaliana*, for example with the activity of a "Glycogen synthesis initiator protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Glycogen synthesis initiator protein" and being encoded by a gene comprising the nucleic acid sequence SEQ ID NO.: 4589 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4589 localized as indicated in table I, column 6, e.g. plastidic in *A. thaliana*, for example with the activity of a "Glycogen synthesis initiator protein", conferred an increased yield, for example a low temperature tolerance.

In particular, it was observed that increasing or generating the activity of a gene product being encoded by a gene comprising the nucleic acid sequence SEQ ID NO.: 4622 in *A. thaliana*, for example with the activity of a "aspartate aminotransferase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "aspartate aminotransferase" and being encoded by a gene comprising the nucleic acid sequence SEQ ID NO.: 4622 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 4622 localized as indicated in table I, column 6, e.g. cytoplasmic in *A. thaliana*, for example with the activity of a "aspartate aminotransferase", conferred an increased yield, for example a low temperature tolerance.

In particular, it was observed that increasing or generating the activity of a gene product being encoded by a gene comprising the nucleic acid sequence SEQ ID NO.: 5070 in *A. thaliana*, for example with the activity of a "YML079W-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "YML079W-protein" and being encoded by a gene comprising the nucleic acid sequence SEQ ID NO.: 5070 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 5070 localized as indicated in table I, column 6, e.g. plastidic or cytoplasmic in *A. thaliana*, for example with the activity of a "YML079W-protein", conferred an increased yield, for example a low temperature tolerance. In particular, it was observed that increasing or generating the activity of a gene product being encoded by a gene comprising the nucleic acid sequence SEQ ID NO.: 5102 in *A. thaliana*, for example with the activity of a "YMR157C-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "YMR157C-protein" and being encoded by a gene comprising the nucleic acid sequence SEQ ID NO.: 5102 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 5102 localized as indicated in table I, column 6, e.g. plastidic in *A. thaliana*, for example with the activity of a "YMR157C-protein", conferred an increased yield, for example a low temperature tolerance.

In particular, it was observed that increasing or generating the activity of a gene product being encoded by a gene comprising the nucleic acid sequence SEQ ID NO.: 5115 in *A. thaliana*, for example with the activity of a "YNL024C-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "YNL024C-protein" and being encoded by a gene comprising the nucleic acid sequence SEQ ID NO.: 5115 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 5115 localized as indicated in table I, column 6, e.g. plastidic in *A. thaliana*, for example with the activity of a "YNL024C-protein", conferred an increased yield, for example a low temperature tolerance.

In particular, it was observed that increasing or generating the activity of a gene product being encoded by a gene comprising the nucleic acid sequence SEQ ID NO.: 5159 in *A. thaliana*, for example with the activity of a "Argininosuccinate synthase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Argininosuccinate synthase" and being encoded by a gene comprising the nucleic acid sequence SEQ ID NO.: 5159 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 5159 localized as indicated in table I, column 6, e.g. plastidic or cytoplasmic in *A. thaliana*, for example with the activity of a "Argininosuccinate synthase", conferred an increased yield, for example a low temperature tolerance.

In particular, it was observed that increasing or generating the activity of a gene product being encoded by a gene comprising the nucleic acid sequence SEQ ID NO.: 5746 in *A. thaliana*, for example with the activity of a "subunit of TORC1", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "subunit of TORC1" and being encoded by a gene comprising the nucleic acid sequence SEQ ID NO.: 5746 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 5746 localized as indicated in table I, column 6, e.g. cytoplasmic in *A. thaliana*, for example with the activity of a "subunit of TORC1", conferred an increased yield, for example a low temperature tolerance.

In particular, it was observed that increasing or generating the activity of a gene product being encoded by a gene comprising the nucleic acid sequence SEQ ID NO.: 5756 in *A. thaliana*, for example with the activity of a "Phosphoadenosine phosphosulfate reductase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Phosphoadenosine phosphosulfate reductase" and being encoded by a gene comprising the nucleic acid sequence SEQ ID NO.: 5756 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 5756 localized as indicated in table I, column 6, e.g. plastidic in *A. thaliana*, for example with the activity of a "Phosphoadenosine phosphosulfate reductase", conferred an increased yield, for example a low temperature tolerance.

In particular, it was observed that increasing or generating the activity of a gene product being encoded by a gene comprising the nucleic acid sequence SEQ ID NO.: 6086 in *A. thaliana*, for example with the activity of a "Enoyl CoA hydratase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Enoyl CoA hydratase" and being encoded by a gene comprising the nucleic acid sequence SEQ ID NO.: 6086 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 6086 localized as indicated in table I, column 6, e.g. plastidic in *A. thaliana*, for example with the activity of a "Enoyl CoA hydratase", conferred an increased yield, for example a low temperature tolerance.

In particular, it was observed that increasing or generating the activity of a gene product being encoded by a gene comprising the nucleic acid sequence SEQ ID NO.: 6581 in *A. thaliana*, for example with the activity of a "B1906-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "B1906-protein" and being encoded by a gene comprising the nucleic acid sequence SEQ ID NO.: 6581 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 6581 localized as indicated in table I, column 6, e.g. cytoplasmic in *A. thaliana*, for example with the activity of a "B1906-protein", conferred an increased yield, for example a low temperature tolerance.

In particular, it was observed that increasing or generating the activity of a gene product being encoded by a gene comprising the nucleic acid sequence SEQ ID NO.: 6609 in *A. thaliana*, for example with the activity of a "CoA-transferase-like protein (NAD(P)-binding)", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "CoA-transferase-like protein (NAD(P)-binding)" and being encoded by a gene comprising the nucleic acid sequence SEQ ID NO.: 6609 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 6609 localized as indicated in table I, column 6, e.g. cytoplasmic in *A. thaliana*, for example with the activity of a "CoA-transferase-like protein (NAD(P)-binding)", conferred an increased yield, for example a low temperature tolerance.

In particular, it was observed that increasing or generating the activity of a gene product being encoded by a gene comprising the nucleic acid sequence SEQ ID NO.: 6949 in *A. thaliana*, for example with the activity of a "Molybdenum-binding subunit of aldehyde oxidases and xanthine dehydrogenases", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Molybdenum-binding subunit of aldehyde oxidases and xanthine dehydrogenases" and being encoded by a gene comprising the nucleic acid sequence SEQ ID NO.: 6949 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 6949 localized as indicated in table I, column 6, e.g. cytoplasmic in *A. thaliana*, for example with the activity of a "Molybdenum-binding subunit of aldehyde oxidases and xanthine dehydrogenases", conferred an increased yield, for example a low temperature tolerance.

In particular, it was observed that increasing or generating the activity of a gene product being encoded by a gene comprising the nucleic acid sequence SEQ ID NO.: 7078 in *A. thaliana*, for example with the activity of a "Pirin-like protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Pirin-like protein" and being encoded by a gene comprising the nucleic acid sequence SEQ ID NO.: 7078 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 7078 localized as indicated in table I, column 6, e.g. cytoplasmic in *A. thaliana*, for example with the activity of a "Pirin-like protein", conferred an increased yield, for example a low temperature tolerance.

In particular, it was observed that increasing or generating the activity of a gene product being encoded by a gene comprising the nucleic acid sequence SEQ ID NO.: 7270 in *A. thaliana*, for example with the activity of a "Heat shock protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Heat shock protein" and being encoded by a gene comprising the nucleic acid sequence SEQ ID NO.: 7270 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 7270 localized as indicated in table I, column 6, e.g. plastidic in *A. thaliana*, for example with the activity of a "Heat shock protein", conferred an increased yield, for example a low temperature tolerance.

In particular, it was observed that increasing or generating the activity of a gene product being encoded by a gene comprising the nucleic acid sequence SEQ ID NO.: 7467 in *A. thaliana*, for example with the activity of a "B3410-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "B3410-protein" and being encoded by a gene comprising the nucleic acid sequence SEQ ID NO.: 7467 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 7467 localized as indicated in table I, column 6, e.g. cytoplasmic in *A. thaliana*, for example with the activity of a "B3410-protein", conferred an increased yield, for example a low temperature tolerance.

In particular, it was observed that increasing or generating the activity of a gene product being encoded by a gene comprising the nucleic acid sequence SEQ ID NO.: 7492 in *A. thaliana*, for example with the activity of a "Regulator of cell morphogenesis and NO signaling", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Regulator of cell morphogenesis and NO signaling" and being encoded by a gene comprising the nucleic acid sequence SEQ ID NO.: 7492 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 7492 localized as indicated in table I, column 6, e.g. plastidic in *A. thaliana*, for example with the activity of a "Regulator of cell morphogenesis and NO signaling", conferred an increased yield, for example a low temperature tolerance.

In particular, it was observed that increasing or generating the activity of a gene product being encoded by a gene comprising the nucleic acid sequence SEQ ID NO.: 7591 in *A. thaliana*, for example with the activity of a "glutathione S-transferase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "glutathione S-transferase" and being encoded by a gene comprising the nucleic acid sequence SEQ ID NO.: 7591 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 7591 localized as indicated in table I, column 6, e.g. cytoplasmic in *A. thaliana*, for example with the activity of a "glutathione S-transferase", conferred an increased yield, for example a low temperature tolerance.

In particular, it was observed that increasing or generating the activity of a gene product being encoded by a gene comprising the nucleic acid sequence SEQ ID NO.: 7670 in *A. thaliana*, for example with the activity of a "serine acetyltransferase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "serine acetyltransferase" and being encoded by a gene comprising the nucleic acid sequence SEQ ID NO.: 7670 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 7670 localized as indicated in table I, column 6, e.g. Mitochondric in *A. thaliana*, for example with the activity of a "serine acetyltransferase", conferred an increased yield, for example a low temperature tolerance.

In particular, it was observed that increasing or generating the activity of a gene product being encoded by a gene comprising the nucleic acid sequence SEQ ID NO.: 8236 in *A. thaliana*, for example with the activity of a "amino acid permease", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "amino acid permease" and being encoded by a gene comprising the nucleic acid sequence SEQ ID NO.: 8236 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 8236 localized as indicated in table I, column 6, e.g. plastidic in *A. thaliana*, for example with the activity of a "amino acid permease", conferred an increased yield, for example a low temperature tolerance.

In particular, it was observed that increasing or generating the activity of a gene product being encoded by a gene comprising the nucleic acid sequence SEQ ID NO.: 8563 in *A. thaliana*, for example with the activity of a "signalosome complex subunit", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "signalosome complex subunit" and being encoded by a gene comprising the nucleic acid sequence SEQ ID NO.: 8563 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 8563 localized as indicated in table I, column 6, e.g. cytoplasmic in *A. thaliana*, for example with the activity of a "signalosome complex subunit", conferred an increased yield, for example a low temperature tolerance.

In particular, it was observed that increasing or generating the activity of a gene product being encoded by a gene comprising the nucleic acid sequence SEQ ID NO.: 8648 in *A. thaliana*, for example with the activity of a "multidrug resistance protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "multidrug resistance protein" and being encoded by a gene comprising the nucleic acid sequence SEQ ID NO.: 8648 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 8648 localized as indicated in table I, column 6, e.g. plastidic in *A. thaliana*, for example with the activity of a "multidrug resistance protein", conferred an increased yield, for example a low temperature tolerance.

In particular, it was observed that increasing or generating the activity of a gene product being encoded by a gene comprising the nucleic acid sequence SEQ ID NO.: 8760 in *A. thaliana*, for example with the activity of a "Arabinose transport system ATP-binding protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Arabinose transport system ATP-binding protein" and being encoded by a gene comprising the nucleic acid sequence SEQ ID NO.: 8760 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 8760 localized as indicated in table I, column 6, e.g. plastidic in *A. thaliana*, for example with the activity of a "Arabinose transport system ATP-binding protein", conferred an increased yield, for example a low temperature tolerance.

In particular, it was observed that increasing or generating the activity of a gene product being encoded by a gene comprising the nucleic acid sequence SEQ ID NO.: 8861 in *A. thaliana*, for example with the activity of a "precorrin-6y methylase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "precorrin-6y methylase" and being encoded by a gene comprising the nucleic acid sequence SEQ ID NO.: 8861 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 8861 localized as indicated in table I, column 6, e.g. cytoplasmic in *A. thaliana*, for example with the activity of a "precorrin-6y methylase", conferred an increased yield, for example a low temperature tolerance.

In particular, it was observed that increasing or generating the activity of a gene product being encoded by a gene comprising the nucleic acid sequence SEQ ID NO.: 9046 in *A. thaliana*, for example with the activity of a "cobalt transport protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "cobalt transport protein" and being encoded by a gene comprising the nucleic acid sequence SEQ ID NO.: 9046 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9046 localized as indicated in table I, column 6, e.g. cytoplasmic in *A. thaliana*, for example with the activity of a "cobalt transport protein", conferred an increased yield, for example a low temperature tolerance.

In particular, it was observed that increasing or generating the activity of a gene product being encoded by a gene comprising the nucleic acid sequence SEQ ID NO.: 9280 in *A.

*thaliana*, for example with the activity of a "SLR1094-protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "SLR1094-protein" and being encoded by a gene comprising the nucleic acid sequence SEQ ID NO.: 9280 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9280 localized as indicated in table I, column 6, e.g. cytoplasmic in *A. thaliana*, for example with the activity of a "SLR1094-protein", conferred an increased yield, for example a low temperature tolerance.

In particular, it was observed that increasing or generating the activity of a gene product being encoded by a gene comprising the nucleic acid sequence SEQ ID NO.: 9307 in *A. thaliana*, for example with the activity of a "oxidoreductase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "oxidoreductase" and being encoded by a gene comprising the nucleic acid sequence SEQ ID NO.: 9307 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9307 localized as indicated in table I, column 6, e.g. cytoplasmic in *A. thaliana*, for example with the activity of a "oxidoreductase", conferred an increased yield, for example a low temperature tolerance.

In particular, it was observed that increasing or generating the activity of a gene product being encoded by a gene comprising the nucleic acid sequence SEQ ID NO.: 9430 in *A. thaliana*, for example with the activity of a "cardiolipin synthetase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "cardiolipin synthetase" and being encoded by a gene comprising the nucleic acid sequence SEQ ID NO.: 9430 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9430 localized as indicated in table I, column 6, e.g. cytoplasmic in *A. thaliana*, for example with the activity of a "cardiolipin synthetase", conferred an increased yield, for example a low temperature tolerance.

In particular, it was observed that increasing or generating the activity of a gene product being encoded by a gene comprising the nucleic acid sequence SEQ ID NO.: 9479 in *A. thaliana*, for example with the activity of a "ethanolamine kinase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "ethanolamine kinase" and being encoded by a gene comprising the nucleic acid sequence SEQ ID NO.: 9479 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9479 localized as indicated in table I, column 6, e.g. cytoplasmic in *A. thaliana*, for example with the activity of a "ethanolamine kinase", conferred an increased yield, for example a low temperature tolerance.

In particular, it was observed that increasing or generating the activity of a gene product being encoded by a gene comprising the nucleic acid sequence SEQ ID NO.: 9500 in *A. thaliana*, for example with the activity of a "enoyl-CoA isomerase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "enoyl-CoA isomerase" and being encoded by a gene comprising the nucleic acid sequence SEQ ID NO.: 9500 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9500 localized as indicated in table I, column 6, e.g. plastidic in *A. thaliana*, for example with the activity of a "enoyl-CoA isomerase", conferred an increased yield, for example a low temperature tolerance.

In particular, it was observed that increasing or generating the activity of a gene product being encoded by a gene comprising the nucleic acid sequence SEQ ID NO.: 9553 in *A. thaliana*, for example with the activity of a "holo-[acyl-carrier-protein] synthase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "holo-[acyl-carrier-protein] synthase" and being encoded by a gene comprising the nucleic acid sequence SEQ ID NO.: 9553 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9553 localized as indicated in table I, column 6, e.g. plastidic in *A. thaliana*, for example with the activity of a "holo-[acyl-carrier-protein] synthase", conferred an increased yield, for example a low temperature tolerance.

In particular, it was observed that increasing or generating the activity of a gene product being encoded by a gene comprising the nucleic acid sequence SEQ ID NO.: 9574 in *A. thaliana*, for example with the activity of a "transketolase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "transketolase" and being encoded by a gene comprising the nucleic acid sequence SEQ ID NO.: 9574 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 9574 localized as indicated in table I, column 6, e.g. plastidic in *A. thaliana*, for example with the activity of a "transketolase", conferred an increased yield, for example a low temperature tolerance.

In particular, it was observed that increasing or generating the activity of a gene product being encoded by a gene comprising the nucleic acid sequence SEQ ID NO.: 10404 in *A. thaliana*, for example with the activity of a "NADH dehydrogenase/NAD(P)H nitroreductase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "NADH dehydrogenase/NAD(P)H nitroreductase" and being encoded by a gene comprising the nucleic acid sequence SEQ ID NO.: 10404 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 10404 localized as indicated in table I, column 6, e.g. plastidic in *A. thaliana*, for example with the activity of a "NADH dehydrogenase/NAD(P)H nitroreductase", conferred an increased yield, for example a low temperature tolerance.

In particular, it was observed that increasing or generating the activity of a gene product being encoded by a gene comprising the nucleic acid sequence SEQ ID NO.: 10503 in *A. thaliana*, for example with the activity of a "multiple drug resistance protein", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "multiple drug resistance protein" and being encoded by a gene comprising the nucleic acid sequence SEQ ID NO.: 10503 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 10503 localized as indicated in table I, column 6, e.g. plastidic in *A. thaliana*, for example with the activity of a "multiple drug resistance protein", conferred an increased yield, for example a low temperature tolerance.

In particular, it was observed that increasing or generating the activity of a gene product being encoded by a gene comprising the nucleic acid sequence SEQ ID NO.: 10591 in *A. thaliana*, for example with the activity of a "peptidyl-prolyl cis-trans isomerase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "peptidyl-prolyl cis-trans isomerase" and being encoded by a gene comprising the nucleic acid sequence SEQ ID NO.: 10591 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 10591 localized as indicated in table I, column 6, e.g. plastidic in *A. thaliana*, for example with the activity of a "peptidyl-prolyl cis-trans isomerase", conferred an increased yield, for example a low temperature tolerance.

In particular, it was observed that increasing or generating the activity of a gene product being encoded by a gene comprising the nucleic acid sequence SEQ ID NO.: 10934 in *A. thaliana*, for example with the activity of a "3-methyl-2-oxobutanoate hydroxymethyltransferase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "3-methyl-2-oxobutanoate hydroxymethyltransferase" and being encoded by a gene comprising the nucleic acid sequence SEQ ID NO.: 10934 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 10934 localized as indicated in table I, column 6, e.g. cytoplasmic in *A. thaliana*, for example with the activity of a "3-methyl-2-oxobutanoate hydroxymethyltransferase", conferred an increased yield, for example a low temperature tolerance.

In particular, it was observed that increasing or generating the activity of a gene product being encoded by a gene comprising the nucleic acid sequence SEQ ID NO.: 11461 in *A. thaliana*, for example with the activity of a "alcohol acetyltransferase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "alcohol acetyltransferase" and being encoded by a gene comprising the nucleic acid sequence SEQ ID NO.: 11461 in *A. thaliana* conferred an tolerance to abiotic environmental stress, e.g.

increase low temperature tolerance compared with the wild type control. In particular, it was observed that increasing or generating the activity of a gene product being encoded by a gene comprising the nucleic acid sequence SEQ ID NO.: 11461 localized as indicated in table I, column 6, e.g. cytoplasmic in A. thaliana, for example with the activity of a "alcohol acetyltransferase", conferred an increased yield, for example a low temperature tolerance.

In particular, it was observed that increasing or generating the activity of a gene product being encoded by a gene comprising the nucleic acid sequence SEQ ID NO.: 11501 in A. thaliana, for example with the activity of a "thiol-specific monooxygenase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "thiol-specific monooxygenase" and being encoded by a gene comprising the nucleic acid sequence SEQ ID NO.: 11501 in A. thaliana conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 11501 localized as indicated in table I, column 6, e.g. cytoplasmic in A. thaliana, for example with the activity of a "thiol-specific monooxygenase", conferred an increased yield, for example a low temperature tolerance.

In particular, it was observed that increasing or generating the activity of a gene product being encoded by a gene comprising the nucleic acid sequence SEQ ID NO.: 11564 in A. thaliana, for example with the activity of a "Molybdenum-binding subunit of aldehyde oxidases and xanthine dehydrogenases", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Molybdenum-binding subunit of aldehyde oxidases and xanthine dehydrogenases" and being encoded by a gene comprising the nucleic acid sequence SEQ ID NO.: 11564 in A. thaliana conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 11564 localized as indicated in table I, column 6, e.g. cytoplasmic in A. thaliana, for example with the activity of a "Molybdenum-binding subunit of aldehyde oxidases and xanthine dehydrogenases", conferred an increased yield, for example a low temperature tolerance.

In particular, it was observed that increasing or generating the activity of a gene product being encoded by a gene comprising the nucleic acid sequence SEQ ID NO.: 11695 in A. thaliana, for example with the activity of a "glycerol dehydrogenase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "glycerol dehydrogenase" and being encoded by a gene comprising the nucleic acid sequence SEQ ID NO.: 11695 in A. thaliana conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 11695 localized as indicated in table I, column 6, e.g. cytoplasmic in A. thaliana, for example with the activity of a "glycerol dehydrogenase", conferred an increased yield, for example a low temperature tolerance.

In particular, it was observed that increasing or generating the activity of a gene product being encoded by a gene comprising the nucleic acid sequence SEQ ID NO.: 11907 in A. thaliana, for example with the activity of a "protein required for degradation of glycoproteins", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "protein required for degradation of glycoproteins" and being encoded by a gene comprising the nucleic acid sequence SEQ ID NO.: 11907 in A. thaliana conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 11907 localized as indicated in table I, column 6, e.g. cytoplasmic in A. thaliana, for example with the activity of a "protein required for degradation of glycoproteins", conferred an increased yield, for example a low temperature tolerance.

In particular, it was observed that increasing or generating the activity of a gene product being encoded by a gene comprising the nucleic acid sequence SEQ ID NO.: 11944 in A. thaliana, for example with the activity of a "ammonium transporter", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "ammonium transporter" and being encoded by a gene comprising the nucleic acid sequence SEQ ID NO.: 11944 in A. thaliana conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 11944 localized as indicated in table I, column 6, e.g. cytoplasmic in A. thaliana, for example with the activity of a "ammonium transporter", conferred an increased yield, for example a low temperature tolerance.

In particular, it was observed that increasing or generating the activity of a gene product being encoded by a gene comprising the nucleic acid sequence SEQ ID NO.: 12357 in A. thaliana, for example with the activity of a "Argininosuccinate synthase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "Argininosuccinate synthase" and being encoded by a gene comprising the nucleic acid sequence SEQ ID NO.: 12357 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 12357 localized as indicated in table I, column 6, e.g. plastidic or cytoplasmic in *A. thaliana*, for example with the activity of a "Argininosuccinate synthase", conferred an increased yield, for example a low temperature tolerance.

In particular, it was observed that increasing or generating the activity of a gene product being encoded by a gene comprising the nucleic acid sequence SEQ ID NO.: 12936 in *A. thaliana*, for example with the activity of a "glutamine synthetase", conferred an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the wild type control. It was further observed that increasing or generating the activity of a gene product with said activity of a "glutamine synthetase" and being encoded by a gene comprising the nucleic acid sequence SEQ ID NO.: 12936 in *A. thaliana* conferred an tolerance to abiotic environmental stress, e.g. increase low temperature tolerance compared with the wild type control. In particular, it was observed that increasing or generating the activity of a gene product being encoded by a gene comprising the nucleic acid sequence SEQ ID NO.: 12936 localized as indicated in table I, column 6, e.g. cytoplasmic in *A. thaliana*, for example with the activity of a "glutamine synthetase", conferred an increased yield, for example a low temperature tolerance It was further observed that increasing or generating the activity of a nucleic acid molecule derived from the nucleic acid molecule shown in Table VIIIa in *A. thaliana* conferred increased nutrient use efficiency, e.g. an increased the nitrogen use efficiency, compared with the wild type control. Thus, in one embodiment, a nucleic acid molecule indicated in Table VIIIa or its homolog as indicated in Table I or the expression product is used in the method of the present invention to increased nutrient use efficiency, e.g. to increased the nitrogen use efficiency, of the a plant compared with the wild type control.

It was further observed that increasing or generating the activity of a nucleic acid molecule derived from the nucleic acid molecule shown in Table VIIIb in *A. thaliana* conferred increased stress tolerance, e.g. increased low temperature tolerance, compared with the wild type control. Thus, in one embodiment, a nucleic acid molecule indicated in Table VIIIb or its homolog as indicated in Table I or the expression product is used in the method of the present invention to increase stress tolerance, e.g. increase low temperature, of a plant compared with the wild type control.

It was further observed that increasing or generating the activity of a nucleic acid molecule derived from the nucleic acid molecule shown in Table VIIIc in *A. thaliana* conferred increased stress tolerance, e.g. increased cycling drought tolerance, compared with the wild type control. Thus, in one embodiment, a nucleic acid molecule indicated in Table VIIIc or its homolog as indicated in Table I or the expression product is used in the method of the present invention to increase stress tolerance, e.g. increase cycling drought tolerance, of a plant compared with the wild type control.

It was further observed that increasing or generating the activity of a nucleic acid molecule derived from the nucleic acid molecule shown in Table VIIId in *A. thaliana* conferred increase in intrinsic yield, e.g. increased biomass under standard conditions, e.g. increased biomass under non-deficiency or non-stress conditions, compared with the wild type control. Thus, in one embodiment, a nucleic acid molecule indicated in Table VIIId or its homolog as indicated in Table I or the expression product is used in the method of the present invention to increase intrinsic yield, e.g. to increase yield under standard conditions, e.g. increase biomass under non-deficiency or non-stress conditions, of a plant compared with the wild type control.

The term "expression" refers to the transcription and/or translation of a codogenic gene segment or gene. As a rule, the resulting product is an mRNA or a protein. However, expression products can also include functional RNAs such as, for example, antisense, nucleic acids, tRNAs, snRNAs, rRNAs, RNAi, siRNA, ribozymes etc. Expression may be systemic, local or temporal, for example limited to certain cell types, tissues organs or organelles or time periods.

In one embodiment, the process of the present invention comprises one or more of the following steps
(a) stabilizing a protein conferring the increased expression of a protein encoded by the nucleic acid molecule of the invention or of the polypeptide of the invention having the herein-mentioned activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD (P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein and conferring increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof;

(b) stabilizing a mRNA conferring the increased expression of a protein encoded by the nucleic acid molecule of the invention or its homologs or of a mRNA encoding the polypeptide of the present invention having the herein-mentioned activity selected from the group consisting of said activities mentioned in (a) and conferring increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof;

(c) increasing the specific activity of a protein conferring the increased expression of a protein encoded by the nucleic acid molecule of the invention or of the polypeptide of the present invention or decreasing the inhibitory regulation of the polypeptide of the invention;

(d) generating or increasing the expression of an endogenous or artificial transcription factor mediating the expression of a protein conferring the increased expression of a protein encoded by the nucleic acid molecule of the invention or of the polypeptide of the invention having the herein-mentioned activity selected from the group consisting of said activities mentioned in (a) and conferring increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof;

(e) stimulating activity of a protein conferring the increased expression of a protein encoded by the nucleic acid molecule of the present invention or a polypeptide of the present invention having the herein-mentioned activity selected from the group consisting of said activities mentioned in (a) and conferring increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof by adding one or more exogenous inducing factors to the organism or parts thereof;

(f) expressing a transgenic gene encoding a protein conferring the increased expression of a polypeptide encoded by the nucleic acid molecule of the present invention or a polypeptide of the present invention, having the herein-mentioned activity selected from the group consisting of said activities mentioned in (a) and conferring increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof; and/or (g) increasing the copy number of a gene conferring the increased expression of a nucleic acid molecule encoding a polypeptide encoded by the nucleic acid molecule of the invention or the polypeptide of the invention having the herein-mentioned activity selected from the group consisting of said activities mentioned in (a) and conferring increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof;

(h) increasing the expression of the endogenous gene encoding the polypeptide of the invention or its homologs by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements—positive elements can be randomly introduced in plants by T-DNA or transposon mutagenesis and lines can be identified in which the positive elements have been integrated near to a gene of the invention, the expression of which is thereby enhanced; and/or (i) modulating growth conditions of the plant in such a manner, that the expression or activity of the gene encoding the protein of the invention or the protein itself is enhanced;

(j) selecting of organisms with especially high activity of the proteins of the invention from natural or from mutagenized resources and breeding them into the target organisms, e.g. the elite crops.

Preferably, said mRNA is the nucleic acid molecule of the present invention and/or the protein conferring the increased expression of a protein encoded by the nucleic acid molecule of the present invention alone or linked to a transit nucleic acid sequence or transit peptide encoding nucleic acid sequence or the polypeptide having the herein mentioned activity, e.g. conferring with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof after increasing the expression or activity of the encoded polypeptide or having the activity of a polypeptide having an activity as the protein as shown in table II column 3 or its homologs.

In general, the amount of mRNA or polypeptide in a cell or a compartment of an organism correlates with the amount of encoded protein and thus with the overall activity of the encoded protein in said volume. Said correlation is not always linear, the activity in the volume is dependent on the stability of the molecules or the presence of activating or inhibiting co-factors. Further, product and educt inhibitions of enzymes are well known and described in textbooks, e.g. Stryer, Biochemistry.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren"/Enzyme inhibitors".

The activity of the abovementioned proteins and/or polypeptides encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell or organelle of a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, especially a plant, a tissue, a cell or a cell compartment. "Increase" in the amount of a protein means the quantitative increase of the molecule number of said protein in an organism, especially a plant, a tissue, a cell or a cell compartment such as an organelle like a plastid or mitochondria or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable. Furthermore such an increase can be reached by the introduction of the inventive nucleic acid sequence or the encoded protein in the correct cell compartment for example into the nucleus or cytoplasm respectively or into plastids either by transformation and/or targeting.

For the purposes of the description of the present invention, the term "cytoplasmic" shall indicate, that the nucleic acid of the invention is expressed without the addition of an non-natural transit peptide encoding sequence. A non-natural transient peptide encoding sequence is a sequence which is not a natural part of a nucleic acid of the invention but is rather added by molecular manipulation steps as for example described in the example under "plastid targeted expression". Therefore the term "cytoplasmic" shall not exclude a targeted localisation to any cell compartment for the products of the inventive nucleic acid sequences by their naturally occurring sequence properties.

In one embodiment the increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell in the plant or a part thereof, e.g. in a cell, a tissue, a organ, an organelle, the cytoplasm etc., is achieved by increasing the endogenous level of the polypeptide of the invention. Accordingly, in an embodiment of the present invention, the present invention relates to a process wherein the gene copy number of a gene encoding the polynucleotide or nucleic acid molecule of the invention is increased. Further, the endogenous level of the polypeptide of the invention can for example be increased by modifying the transcriptional or translational regulation of the polypeptide.

In one embodiment the increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait of the plant or part thereof can be altered by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 132 (1), 174 (2003)) and citations therein can be used to disrupt repressor elements or to enhance to activity of positive regulatory elements.

Furthermore positive elements can be randomly introduced in (plant) genomes by T-DNA or transposon mutagenesis and lines can be screened for, in which the positive elements have been integrated near to a gene of the invention, the expression of which is thereby enhanced. The activation of plant genes by random integrations of enhancer elements has been described by Hayashi et al. (Science 258,1350 (1992)) or Weigel et al. (Plant Physiol. 122, 1003 (2000)) and others recited therein.

Reverse genetic strategies to identify insertions (which eventually carrying the activation elements) near in genes of interest have been described for various cases e.g. Krysan et al. (Plant Cell 11, 2283 (1999)); Sessions et al. (Plant Cell 14, 2985 (2002)); Young et al. (Plant Physiol. 125, 513 (2001)); Koprek et al. (Plant J. 24, 253 (2000)); Jeon et al. (Plant J. 22, 561 (2000)); Tissier et al. (Plant Cell 11, 1841(1999)); Speulmann et al. (Plant Cell 11, 1853 (1999)). Briefly material from all plants of a large T-DNA or transposon mutagenized plant population is harvested and genomic DNA prepared. Then the genomic DNA is pooled following specific architectures as described for example in Krysan et al. (Plant Cell 11, 2283 (1999)). Pools of genomics DNAs are then screened by specific multiplex PCR reactions detecting the combination of the insertional mutagen (e.g. T-DNA or Transposon) and the gene of interest. Therefore PCR reactions are run on the DNA pools with specific combinations of T-DNA or transposon border primers and gene specific primers. General rules for primer design can again be taken from Krysan et al. (Plant Cell 11, 2283 (1999)). Rescreening of lower levels DNA pools lead to the identification of individual plants in which the gene of interest is activated by the insertional mutagen.

The enhancement of positive regulatory elements or the disruption or weakening of negative regulatory elements can also be achieved through common mutagenesis techniques: The production of chemically or radiation mutated populations is a common technique and known to the skilled worker. Methods for plants are described by Koorneef et al. (Mutat Res. March 93 (1) (1982)) and the citations therein and by Lightner and Caspar in "Methods in Molecular Biology" Vol. 82. These techniques usually induce point mutations that can be identified in any known gene using methods such as TILL-ING (Colbert et al., Plant Physiol, 126, (2001)).

Accordingly, the expression level can be increased if the endogenous genes encoding a polypeptide conferring an increased expression of the polypeptide of the present invention, in particular genes comprising the nucleic acid molecule of the present invention, are modified via homologous recombination, Tilling approaches or gene conversion. It also possible to add as mentioned herein targeting sequences to the inventive nucleic acid sequences.

Regulatory sequences, if desired, in addition to a target sequence or part thereof can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended. For example, the activation of plant genes by random integrations of enhancer elements has been described by Hayashi et al. (Science 258, 1350(1992)) or Weigel et al. (Plant Physiol. 122, 1003 (2000)) and others recited therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of an artificial transcription factor as described in the examples. Alternative promoters, terminators and UTR are described below.

The activation of an endogenous polypeptide having above-mentioned activity, e.g. having the activity of a protein as shown in table II, column 3 or of the polypeptide of the invention, e.g. conferring increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof after increase of expression or activity in the cytoplasm and/or in an organelle like a plastid, can also be increased by introducing a synthetic transcription factor, which binds close to the coding region of the gene encoding the protein as shown in table II, column 3 and activates its transcription. A chimeric zinc finger protein can be constructed, which comprises a specific DNA-binding domain and an activation domain as e.g. the VP16 domain of Herpes Simplex virus. The specific binding domain can bind to the regulatory region of the gene encoding the protein as shown in table II, column 3. The expression of the chimeric transcription factor in a organism, in particular in a plant, leads to a specific expression of the protein as shown in table II, column 3. The methods thereto are known to a skilled person and/or disclosed e.g. in WO01/52620, Oriz, Proc. Natl. Acad. Sci. USA, 99, 13290 (2002) or Guan, Proc. Natl. Acad. Sci. USA 99, 13296 (2002).

In one further embodiment of the process according to the invention, organisms are used in which one of the abovementioned genes, or one of the abovementioned nucleic acids, is mutated in a way that the activity of the encoded gene products is less influenced by cellular factors, or not at all, in comparison with the not mutated proteins. For example, well known regulation mechanism of enzyme activity are substrate inhibition or feed back regulation mechanisms. Ways and techniques for the introduction of substitution, deletions and additions of one or more bases, nucleotides or amino acids of a corresponding sequence are described herein below in the corresponding paragraphs and the references listed there, e.g. in Sambrook et al., Molecular Cloning, Cold Spring Harbour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms for the identifying of binding sites and regulation domains or by introducing into a nucleic acid molecule or in a protein systematically mutations and assaying for those mutations which will lead to an increased specific activity or an increased activity per volume, in particular per cell.

It can therefore be advantageous to express in an organism a nucleic acid molecule of the invention or a polypeptide of the invention derived from a evolutionary distantly related organism, as e.g. using a prokaryotic gene in a eukaryotic host, as in these cases the regulation mechanism of the host cell may not weaken the activity (cellular or specific) of the gene or its expression product.

The mutation is introduced in such a way that increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait are not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism. This leads to increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof.

The invention provides that the above methods can be performed such that yield, e.g. a yield-related trait, for example enhanced tolerance to abiotic environmental stress, for example drought tolerance and/or low temperature tolerance and/or nutrient use efficiency, intrinsic yield and/or another mentioned yield-related traits increased, wherein particularly the tolerance to low temperature is increased. In a further embodiment the invention provides that the above methods can be performed such that the tolerance to abiotic stress, particularly the tolerance to low temperature and/or water use efficiency, and at the same time, the nutrient use efficiency, particularly the nitrogen use efficiency is increased. In another embodiment the invention provides that the above methods can be performed such that the yield is increased in the absence of nutrient deficiencies as well as the absence of stress conditions. In a further embodiment the invention provides that the above methods can be performed such that the nutrient use efficiency, particularly the nitrogen use efficiency, and the yield, in the absence of nutrient deficiencies as well as the absence of stress conditions, is increased. In a preferred embodiment the invention provides that the above methods can be performed such that the tolerance to abiotic stress, particularly the tolerance to low temperature and/or water use efficiency, and at the same time, the nutrient use efficiency, particularly the nitrogen use efficiency, and the yield in the absence of nutrient deficiencies as well as the absence of stress conditions, is increased.

The invention is not limited to specific nucleic acids, specific polypeptides, specific cell types, specific host cells, specific conditions or specific methods etc. as such, but may vary and numerous modifications and variations therein will be apparent to those skilled in the art. It is also to be understood that the terminology used herein is for the purpose of describing specific embodiments only and is not intended to be limiting.

The present invention also relates to isolated nucleic acids comprising a nucleic acid molecule selected from the group consisting of:
(a) a nucleic acid molecule encoding the polypeptide shown in column 7 of table II B, application no. 1;
(b) a nucleic acid molecule shown in column 7 of table I B, application no. 1;
(c) a nucleic acid molecule, which, as a result of the degeneracy of the genetic code, can be derived from a polypeptide sequence depicted in column 5 or 7 of table II, application no. 1, and confers increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(d) a nucleic acid molecule having at least 30% identity, preferably at least 40%, 50%, 60%, 70%, 75%, 80%, 85%, 90%, 95%, 96%, 97%, 98%, 99%, 99.5%, with the nucleic acid molecule sequence of a polynucleotide comprising the nucleic acid molecule shown in column 5 or 7 of table I, application no. 1, and confers increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(e) a nucleic acid molecule encoding a polypeptide having at least 30% identity, preferably at least 40%, 50%, 60%, 70%, 75%, 80%, 85%, 90%, 95%, 96%, 97%, 98%, 99%, 99.5%, with the amino acid sequence of the polypeptide encoded by the nucleic acid molecule of (a), (b), (c) or (d) and having the activity represented by a nucleic acid molecule comprising a polynucleotide as depicted in column 5 of table I, application no. 1, and confers increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(f) nucleic acid molecule which hybridizes with a nucleic acid molecule of (a), (b), (c), (d) or
(e) under stringent hybridization conditions and confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(g) a nucleic acid molecule encoding a polypeptide which can be isolated with the aid of monoclonal or polyclonal antibodies made against a polypeptide encoded by one of the nucleic acid molecules of (a), (b), (c), (d), (e) or (f) and having the activity represented by the nucleic acid molecule comprising a polynucleotide as depicted in column 5 of table I, application no. 1;
(h) a nucleic acid molecule encoding a polypeptide comprising the consensus sequence or one or more polypeptide motifs as shown in column 7 of table IV, application no. 1, and preferably having the activity represented by a protein comprising a polypeptide as depicted in column 5 of table II or IV, application no. 1;
(i) a nucleic acid molecule encoding a polypeptide having the activity represented by a protein as depicted in column 5 of table II, application no. 1, and confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(j) nucleic acid molecule which comprises a polynucleotide, which is obtained by amplifying a cDNA library or a genomic library using the primers in column 7 of table III, application no. 1, and e.g. having the activity represented by a protein comprising a polypeptide as depicted in column 5 of table II or IV, application no. 1; and
(k) a nucleic acid molecule which is obtainable by screening a suitable nucleic acid library, especially a cDNA library and/or a genomic library, under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt, 500 nt, 750 nt or 1000 nt of a nucleic acid molecule complementary to a nucleic acid molecule sequence characterized in (a) to (e) and encoding a polypeptide having the activity represented by a protein comprising a polypeptide as depicted in column 5 of table II, application no. 1.

In one embodiment, the nucleic acid molecule according to (a), (b), (c), (d), (e), (f), (g), (h), (i), (j) and (k) is at least in one or more nucleotides different from the sequence depicted in column 5 or 7 of table I A, application no. 1, and preferably which encodes a protein which differs at least in one or more amino acids from the protein sequences depicted in column 5 or 7 of table II A, application no. 1.

In one embodiment the invention relates to homologs of the aforementioned sequences, which can be isolated advantageously from yeast, fungi, viruses, algae, bacteria, such as *Acetobacter* (subgen. *Acetobacter*) *aceti*; *Acidithiobacillus ferrooxidans*; *Acinetobacter* sp.; *Actinobacillus* sp; *Aeromonas salmonicida*; *Agrobacterium tumefaciens*; *Aquifex aeolicus*; *Arcanobacterium pyogenes*; Aster yellows phytoplasma; *Bacillus* sp.; *Bifidobacterium* sp.; *Borrelia burgdorferi*; *Brevibacterium linens*; *Brucella melitensis*; *Buchnera* sp.; *Butyrivibrio fibrisolvens*; *Campylobacter jejuni*; *Caulobacter crescentus*; *Chlamydia* sp.; *Chlamydophila* sp.; *Chlorobium limicola*; *Citrobacter rodentium*; *Clostridium* sp.; *Comamonas testosteroni*; *Corynebacterium* sp.; *Coxiella burnetii*; *Deinococcus radiodurans*; *Dichelobacter nodosus*; *Edwardsiella ictaluri*; *Enterobacter* sp.; *Erysipelothrix rhusiopathiae*; *E. coli*; *Flavobacterium* sp.; *Francisella tularensis*; *Frankia* sp. Cpl1; *Fusobacterium nucleatum*; *Geobacillus stearothermophilus*; *Gluconobacter oxydans*; *Haemophilus* sp.; *Helicobacter pylori*; *Klebsiella pneumoniae*; *Lactobacillus* sp.; *Lactococcus lactis*; *Listeria* sp.; *Mannheimia haemolytica*; *Mesorhizobium loti*; *Methylophaga thalassica*; *Microcystis aeruginosa*; *Microscilla* sp. PRE1; *Moraxella* sp. TA144; *Mycobacterium* sp.; *Mycoplasma* sp.; *Neisseria* sp.; *Nitrosomonas* sp.; *Nostoc* sp. PCC 7120; *Novosphingobium aromaticivorans*; *Oenococcus oeni*; *Pantoea citrea*; *Pasteurella multocida*; *Pediococcus pentosaceus*; *Phormidium foveolarum*; *Phytoplasma* sp.; *Plectonema boryanum*; *Prevotella ruminicola*; *Propionibacterium* sp.; *Proteus vulgaris*; *Pseudomonas* sp.; *Ralstonia* sp.; *Rhizobium* sp.; *Rhodococcus equi*; *Rhodothermus marinus*; *Rickettsia* sp.; *Riemerella anatipestifer*; *Ruminococcus flavefaciens*; *Salmonella* sp.; *Selenomonas ruminantium*; *Serratia entomophila*; *Shigella* sp.; *Sinorhizobium meliloti*; *Staphylococcus* sp.; *Streptococcus* sp.; *Streptomyces* sp.; *Synechococcus* sp.; *Synechocystis* sp. PCC 6803; *Thermotoga maritima*; *Treponema* sp.; *Ureaplasma urealyticum*; *Vibrio cholerae*; *Vibrio parahaemolyticus*; *Xylella fastidiosa*; *Yersinia* sp.; *Zymomonas mobilis*, preferably *Salmonella* sp. or *E. coli* or plants, preferably from yeasts such as from the genera *Saccharomyces*, *Pichia*, *Candida*, *Hansenula*, *Torulopsis* or *Schizosaccharomyces* or plants such as *A. thaliana*, maize, wheat, rye, oat, triticale, rice, barley, soybean, peanut, cotton, borage, sunflower, linseed, primrose, rapeseed, canola and turnip rape, *manihot*, pepper, sunflower, tagetes, solanaceous plant such as potato, tobacco, eggplant and tomato, *Vicia* species, pea, alfalfa, bushy plants such as coffee, cacao, tea, *Salix* species, trees such as oil palm, coconut, perennial grass, such as ryegrass and fescue, and forage crops, such as alfalfa and clover and from spruce, pine or fir for example. More preferably homologs of aforementioned sequences can be isolated from *S. cerevisiae*, *E. coli* or *Synechocystis* sp. or plants, preferably *Brassica napus*, *Glycine max*, *Zea mays*, cotton or *Oryza sativa*.

The proteins of the present invention are preferably produced by recombinant DNA techniques. For example, a nucleic acid molecule encoding the protein is cloned into an expression vector, for example in to a binary vector, the expression vector is introduced into a host cell, for example the *A. thaliana* wild type NASC N906 or any other plant cell as described in the examples see below, and the protein is expressed in said host cell. Examples for binary vectors are pBIN19, pBI101, pBinAR, pGPTV, pCAMBIA, pBIB-HYG, pBecks, pGreen or pPZP (Hajukiewicz, P. et al., Plant Mol. Biol. 25, 989 (1994), and Hellens et al, Trends in Plant Science 5, 446 (2000)).

In one embodiment the protein of the present invention is preferably produced in an compartment of the cell, e.g. in the plastids. Ways of introducing nucleic acids into plastids and producing proteins in this compartment are known to the person skilled in the art have been also described in this application. In one embodiment, the polypeptide of the invention is a protein localized after expression as indicated in column 6 of table II, e.g. non-targeted, in the cytsol or cytoplasm or in an organelle such as a plastid or mitochondria or both, for example it is fused to a transit peptide as described above for plastidic localisation.

In another embodiment the protein of the present invention is produced without further targeting singal (e.g. as mentioned herein), e.g. in the cytoplasm of the cell. Ways of producing proteins in the cytoplasm are known to the person skilled in the art. Ways of producing proteins without artificial targeting are known to the person skilled in the art.

Advantageously, the nucleic acid sequences according to the invention or the gene construct together with at least one reporter gene are cloned into an expression cassette, which is introduced into the organism via a vector or directly into the genome. This reporter gene should allow easy detection via a growth, fluorescence, chemical, bioluminescence or tolerance assay or via a photometric measurement. Examples of reporter genes which may be mentioned are antibiotic- or herbicide-tolerance genes, hydrolase genes, fluorescence protein genes, bioluminescence genes, sugar or nucleotide metabolic genes or biosynthesis genes such as the Ura3 gene, the Ilv2 gene, the luciferase gene, the β-galactosidase gene, the gfp gene, the 2-desoxyglucose-6-phosphate phosphatase gene, the β-glucuronidase gene, β-lactamase gene, the neomycin phosphotransferase gene, the hygromycin phosphotransferase gene, a mutated acetohydroxyacid synthase (AHAS) gene (also known as acetolactate synthase (ALS) gene), a gene for a D-amino acid metabolizing enzyme or the BASTA (=gluphosinate-tolerance) gene. These genes permit easy measurement and quantification of the transcription activity and hence of the expression of the genes. In this way genome positions may be identified which exhibit differing productivity.

In a preferred embodiment a nucleic acid construct, for example an expression cassette, comprises upstream, i.e. at the 5' end of the encoding sequence, a promoter and downstream, i.e. at the 3' end, a polyadenylation signal and optionally other regulatory elements which are operably linked to the intervening encoding sequence with one of the nucleic acids of SEQ ID NO as depicted in table I, column 5 and 7. By an operable linkage is meant the sequential arrangement of promoter, encoding sequence, terminator and optionally other regulatory elements in such a way that each of the regulatory elements can fulfill its function in the expression of the encoding sequence in due manner. In one embodiment the sequences preferred for operable linkage are targeting sequences for ensuring subcellular localization in plastids. However, targeting sequences for ensuring subcellular localization in the mitochondrium, in the endoplasmic reticulum (=ER), in the nucleus, in oil corpuscles or other compartments may also be employed as well as translation promoters such as the 5' lead sequence in tobacco mosaic virus (Gallie et al., Nucl. Acids Res. 15 8693 (1987)).

A nucleic acid construct, for example an expression cassette may, for example, contain a constitutive promoter or a tissue-specific promoter (preferably the USP or napin promoter) the gene to be expressed and the ER retention signal.

For the ER retention signal the KDEL amino acid sequence (lysine, aspartic acid, glutamic acid, leucine) or the KKX amino acid sequence (lysine-lysine-X-stop, wherein X means every other known amino acid) is preferably employed.

For expression in a host organism, for example a plant, the expression cassette is advantageously inserted into a vector such as by way of example a plasmid, a phage or other DNA which allows optimal expression of the genes in the host organism. Examples of suitable plasmids are: in *E. coli* pLG338, pACYC184, pBR series such as e.g. pBR322, pUC series such as pUC18 or pUC19, M113mp series, pKC30, pRep4, pHS1, pHS2, pPLc236, pMBL24, pLG200, pUR290, pIN-III[113]-B1, λgt11 or pBdCl; in *Streptomyces* pIJ101, pIJ364, pIJ702 or pIJ361; in *Bacillus* pUB110, pC194 or pBD214; in *Corynebacterium* pSA77 or pAJ667; in fungi pALS1, pIL2 or pBB116; other advantageous fungal vectors are described by Romanos M. A. et al., Yeast 8, 423 (1992) and by van den Hondel, C. A. M. J. J. et al. [(1991) "Heterologous gene expression in filamentous fungi"] as well as in "More Gene Manipulations" in "Fungi" in Bennet J. W. & Lasure L. L., eds., pp. 396-428, Academic Press, San Diego, and in "Gene transfer systems and vector development for filamentous fungi" [van den Hondel, C. A. M. J. J. & Punt, P. J. (1991) in: Applied Molecular Genetics of Fungi, Peberdy, J. F. et al., eds., pp. 1-28, Cambridge University Press: Cambridge]. Examples of advantageous yeast promoters are 2 μM, pAG-1, YEp6, YEp13 or pEMBLYe23. Examples of algal or plant promoters are pLGV23, pGHlac+, pBIN19, pAK2004, pVKH or pDH51 (see Schmidt, R. and Willmitzer, L., Plant Cell Rep. 7, 583 (1988))). The vectors identified above or derivatives of the vectors identified above are a small selection of the possible plasmids. Further plasmids are well known to those skilled in the art and may be found, for example, in "Cloning Vectors" (Eds. Pouwels P. H. et al. Elsevier, Amsterdam-New York-Oxford, 1985, ISBN 0 444 904018). Suitable plant vectors are described inter alia in "Methods in Plant Molecular Biology and Biotechnology" (CRC Press, Ch. 6/7, pp. 71-119). Advantageous vectors are known as shuttle vectors or binary vectors which replicate in *E. coli* and *Agrobacterium*.

By vectors is meant with the exception of plasmids all other vectors known to those skilled in the art such as by way of example phages, viruses such as SV40, CMV, baculovirus, adenovirus, transposons, IS elements, phasmids, phagemids, cosmids, linear or circular DNA. These vectors can be replicated autonomously in the host organism or be chromosomally replicated, chromosomal replication being preferred.

In a further embodiment of the vector the expression cassette according to the invention may also advantageously be introduced into the organisms in the form of a linear DNA and be integrated into the genome of the host organism by way of heterologous or homologous recombination. This linear DNA may be composed of a linearized plasmid or only of the expression cassette as vector or the nucleic acid sequences according to the invention.

In a further advantageous embodiment the nucleic acid sequence according to the invention can also be introduced into an organism on its own.

If in addition to the nucleic acid sequence according to the invention further genes are to be introduced into the organism, all together with a reporter gene in a single vector or each single gene with a reporter gene in a vector in each case can be introduced into the organism, whereby the different vectors can be introduced simultaneously or successively.

The vector advantageously contains at least one copy of the nucleic acid sequences according to the invention and/or the expression cassette (=gene construct) according to the invention.

The invention further provides an isolated recombinant expression vector comprising a nucleic acid encoding a polypeptide as depicted in table II, column 5 or 7, wherein expression of the vector in a host cell results in increased yield, e.g. increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a wild type variety of the host cell.

As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g. bacterial vectors having a bacterial origin of replication and episomal mammalian vectors). Other vectors (e.g. non-episomal mammalian vectors) are integrated into the genome of a host cell or a organelle upon introduction into the host cell, and thereby are replicated along with the host or organelle genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. As used herein with respect to a recombinant expression vector, "operatively linked" is intended to mean that the nucleotide sequence of interest is linked to the regulatory sequence(s) in a manner which allows for expression of the nucleotide sequence (e.g. in an in vitro transcription/translation system or in a host cell when the vector is introduced into the host cell). The term "regulatory sequence" is intended to include promoters, enhancers, and other expression control elements (e.g. polyadenylation signals). Such regulatory sequences are described, for example, in Goeddel, Gene Expression Technology: Methods in Enzymology 185, Academic Press, San Diego, Calif. (1990), and Gruber and Crosby, in: Methods in Plant Molecular Biology and Biotechnology, eds. Glick and Thompson, Chapter 7, 89-108, CRC Press; Boca Raton, Fla., including the references therein. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., LTRRPs, mutant forms of LTRRPs, fusion polypeptides, "Yield Related Proteins" or "YRPs" etc.).

The recombinant expression vectors of the invention can be designed for expression of the polypeptide of the invention in plant cells. For example, LTRRP or YRP genes can be expressed in plant cells (see Schmidt R., and Willmitzer L., Plant Cell Rep. 7 (1988); Plant Molecular Biology and Biotechnology, C Press, Boca Raton, Fla., Chapter 6/7, p. 71-119 (1993); White F. F., Jenes B. et al., Techniques for Gene Transfer, in: Transgenic Plants, Vol. 1, Engineering and Utilization, eds. Kung and Wu R., 128-43, Academic Press: 1993; Potrykus, Annu. Rev. Plant Physiol. Plant Molec. Biol. 42, 205 (1991) and references cited therein). Suitable host cells are discussed further in Goeddel, Gene Expression Technology: Methods in Enzymology 185, Academic Press: San Diego, Calif. (1990). Alternatively, the recombinant expression vector can be transcribed and translated in vitro, for example using T7 promoter regulatory sequences and T7 polymerase.

Expression of polypeptides in prokaryotes is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide but also to the C-terminus or fused within suitable regions in the polypeptides. Such fusion vectors typically serve three purposes: 1) to increase expression of a recombinant polypeptide; 2) to increase the solubility of a recombinant polypeptide; and 3) to aid in the purification of a recombinant polypeptide by acting as a ligand in affinity purification. Often, in fusion expression vectors, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin, and enterokinase.

By way of example the plant expression cassette can be installed in the pRT transformation vector ((a) Toepfer et al., Methods Enzymol. 217, 66 (1993), (b) Toepfer et al., Nucl. Acids. Res. 15, 5890 (1987)). Alternatively, a recombinant vector (=expression vector) can also be transcribed and translated in vitro, e.g. by using the T7 promoter and the T7 RNA polymerase.

Expression vectors employed in prokaryotes frequently make use of inducible systems with and without fusion proteins or fusion oligopeptides, wherein these fusions can ensue in both N-terminal and C-terminal manner or in other useful domains of a protein. Such fusion vectors usually have the following purposes: 1) to increase the RNA expression rate; 2) to increase the achievable protein synthesis rate; 3) to increase the solubility of the protein; 4) or to simplify purification by means of a binding sequence usable for affinity chromatography. Proteolytic cleavage points are also frequently introduced via fusion proteins, which allow cleavage of a portion of the fusion protein and purification. Such recognition sequences for proteases are recognized, e.g. factor Xa, thrombin and enterokinase.

Typical advantageous fusion and expression vectors are pGEX (Pharmacia Biotech Inc; Smith D. B. and Johnson K. S., Gene 67, 31 (1988)), pMAL (New England Biolabs, Beverly, Mass.) and pRIT5 (Pharmacia, Piscataway, N.J.) which contains glutathione S-transferase (GST), maltose binding protein or protein A.

In one embodiment, the coding sequence of the polypeptide of the invention is cloned into a pGEX expression vector to create a vector encoding a fusion polypeptide comprising, from the N-terminus to the C-terminus, GST-thrombin cleavage site-X polypeptide. The fusion polypeptide can be purified by affinity chromatography using glutathione-agarose resin. Recombinant PK LTRRP or YRP unfused to GST can be recovered by cleavage of the fusion polypeptide with thrombin. Other examples of $E.$ $coli$ expression vectors are pTrc (Amann et al., Gene 69, 301 (1988)) and pET vectors (Studier et al., Gene Expression Technology: Methods in Enzymology 185, Academic Press, San Diego, Calif. (1990) 60-89; Stratagene, Amsterdam, The Netherlands).

Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21(DE3) or HMS174(DE3) from a resident I prophage harboring a T7 gn1 gene under the transcriptional control of the lacUV 5 promoter.

In an further embodiment of the present invention, the LTRRP or YRPs are expressed in plants and plants cells such as unicellular plant cells (e.g. algae) (see Falciatore et al., Marine Biotechnology 1 (3), 239 (1999) and references therein) and plant cells from higher plants (e.g., the spermatophytes, such as crop plants), for example to regenerate plants from the plant cells. A nucleic acid molecule coding for LTRRP or YRP as depicted in table II, column 5 or 7 may be "introduced" into a plant cell by any means, including transfection, transformation or transduction, electroporation, particle bombardment, agroinfection, and the like. One transformation method known to those of skill in the art is the dipping of a flowering plant into an Agrobacteria solution, wherein the Agrobacteria contains the nucleic acid of the invention, followed by breeding of the transformed gametes.

Other suitable methods for transforming or transfecting host cells including plant cells can be found in Sambrook et al., Molecular Cloning: A Laboratory Manual. $2^{nd}$, ed., Cold Spring Harbor Laboratory, Cold Spring Harbor Laboratory Press, Cold Spring Harbor, N.Y., 1989, and other laboratory manuals such as Methods in Molecular Biology, 1995, Vol. 44, *Agrobacterium* protocols, ed: Gartland and Davey, Humana Press, Totowa, N.J. As increased tolerance to abiotic environmental stress and/or yield is a general trait wished to be inherited into a wide variety of plants like maize, wheat, rye, oat, triticale, rice, barley, soybean, peanut, cotton, rapeseed and canola, *manihot*, pepper, sunflower and tagetes, solanaceous plants like potato, tobacco, eggplant, and tomato, *Vicia* species, pea, alfalfa, bushy plants (coffee, cacao, tea), *Salix* species, trees (oil palm, coconut), perennial grasses, and forage crops, these crop plants are also preferred target plants for a genetic engineering as one further embodiment of the present invention. Forage crops include, but are not limited to Wheatgrass, Canarygrass, Bromegrass, Wildrye Grass, Bluegrass, Orchardgrass, Alfalfa, Salfoin, Birdsfoot Trefoil, Alsike Clover, Red Clover and Sweet Clover.

In one embodiment of the present invention, transfection of a nucleic acid molecule coding for LTRRP or YRP as depicted in table II, column 5 or 7 into a plant is achieved by *Agrobacterium* mediated gene transfer. *Agrobacterium* mediated plant transformation can be performed using for example the GV3101(pMP90) (Koncz and Schell, Mol. Gen. Genet. 204, 383 (1986)) or LBA4404 (Clontech) *Agrobacterium tumefaciens* strain. Transformation can be performed by standard transformation and regeneration techniques (Deblaere et al., Nucl. Acids Res. 13, 4777 (1994), Gelvin, Stanton B. and Schilperoort Robert A, Plant Molecular Biology Manual, $2^{nd}$ Ed.—Dordrecht: Kluwer Academic Publ., 1995.—in Sect., Ringbuc Zentrale Signatur: BT11-P ISBN 0-7923-2731-4; Glick Bernard R., Thompson John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., Plant Cell Report 8, 238 (1989); De Block et al., Plant Physiol. 91, 694 (1989)). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., Plant Cell Report 13, 282 (1994). Additionally, transformation of soybean can be performed using for example a technique described in European Patent No. 424 047, U.S. Pat. No. 5,322,783, European Patent No. 397 687, U.S. Pat. No. 5,376, 543 or U.S. Pat. No. 5,169,770. Transformation of maize can be achieved by particle bombardment, polyethylene glycol mediated DNA uptake or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced nucleic acid molecule coding for LTRRP or YRP as depicted in table II, column 5 or 7 may be maintained in the plant cell stably if it is incorporated into a non-chromosomal autonomous replicon or integrated into the plant chromosomes or organelle genome. Alternatively, the introduced LTRRP or YRP may be present on an extra-chromosomal non-replicating vector and be transiently expressed or transiently active.

In one embodiment, a homologous recombinant microorganism can be created wherein the LTRRP or YRP is integrated into a chromosome, a vector is prepared which contains at least a portion of a nucleic acid molecule coding for LTRRP or YRP as depicted in table II, column 5 or 7 into which a deletion, addition, or substitution has been introduced to thereby alter, e.g., functionally disrupt, the LTRRP or YRP gene. For example, the LTRRP or YRP gene is a yeast gene, like a gene of *S. cerevisiae*, or of *Synechocystis*, or a bacterial gene, like an *E. coli* gene, but it can be a homolog from a related plant or even from a mammalian or insect source. The vector can be designed such that, upon homologous recombination, the endogenous nucleic acid molecule coding for LTRRP or YRP as depicted in table II, column 5 or 7 is mutated or otherwise altered but still encodes a functional polypeptide (e.g., the upstream regulatory region can be altered to thereby alter the expression of the endogenous LTRRP or YRP). In a preferred embodiment the biological activity of the protein of the invention is increased upon homologous recombination. To create a point mutation via homologous recombination, DNA-RNA hybrids can be used in a technique known as chimeraplasty (Cole-Strauss et al., Nucleic Acids Research 27 (5),1323 (1999) and Kmiec, Gene Therapy American Scientist. 87 (3), 240 (1999)). Homologous recombination procedures in *Physcomitrella patens* are also well known in the art and are contemplated for use herein.

Whereas in the homologous recombination vector, the altered portion of the nucleic acid molecule coding for LTRRP or YRP as depicted in table II, column 5 or 7 is flanked at its 5' and 3' ends by an additional nucleic acid molecule of the LTRRP or YRP gene to allow for homologous recombination to occur between the exogenous LTRRP or YRP gene carried by the vector and an endogenous LTRRP or YRP gene, in a microorganism or plant. The additional flanking LTRRP or YRP nucleic acid molecule is of sufficient length for successful homologous recombination with the endogenous gene. Typically, several hundreds of base pairs up to kilobases of flanking DNA (both at the 5' and 3' ends) are included in the vector. See, e.g., Thomas K. R., and Capecchi M. R., Cell 51, 503 (1987) for a description of homologous recombination vectors or Strepp et al., PNAS, 95 (8), 4368 (1998) for cDNA based recombination in *Physcomitrella patens*. The vector is introduced into a microorganism or plant cell (e.g. via polyethylene glycol mediated DNA), and cells in which the introduced LTRRP or YRP gene has homologously recombined with the endogenous LTRRP or YRP gene are selected using art-known techniques.

Whether present in an extra-chromosomal non-replicating vector or a vector that is integrated into a chromosome, the nucleic acid molecule coding for LTRRP or YRP as depicted in table II, column 5 or 7 preferably resides in a plant expression cassette. A plant expression cassette preferably contains regulatory sequences capable of driving gene expression in plant cells that are operatively linked so that each sequence can fulfill its function, for example, termination of transcription by polyadenylation signals. Preferred polyadenylation signals are those originating from *Agrobacterium tumefaciens* t-DNA such as the gene 3 known as octopine synthase of the Ti-plasmid pTiACH5 (Gielen et al., EMBO J. 3, 835 (1984)) or functional equivalents thereof but also all other terminators functionally active in plants are suitable. As plant gene expression is very often not limited on transcriptional levels, a plant expression cassette preferably contains other operatively linked sequences like translational enhancers such as the overdrive-sequence containing the 5'-untranslated leader sequence from tobacco mosaic virus enhancing the polypeptide per RNA ratio (Gallie et al., Nucl. Acids Research 15, 8693 (1987)). Examples of plant expression vectors include those detailed in: Becker D. et al., Plant Mol. Biol. 20, 1195 (1992); and Bevan M. W., Nucl. Acid. Res. 12, 8711 (1984); and "Vectors for Gene Transfer in Higher Plants" in: Transgenic Plants, Vol. 1, Engineering and Utilization, eds. Kung and Wu R., Academic Press, 1993, S. 15-38.

"Transformation" is defined herein as a process for introducing heterologous DNA into a plant cell, plant tissue, or plant. It may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time. Transformed plant cells, plant tissue, or plants are understood to encompass not only the end product of a transformation process, but also transgenic progeny thereof.

The terms "transformed," "transgenic," and "recombinant" refer to a host organism such as a bacterium or a plant into which a heterologous nucleic acid molecule has been introduced. The nucleic acid molecule can be stably integrated into the genome of the host or the nucleic acid molecule can also be present as an extra-chromosomal molecule. Such an extra-chromosomal molecule can be auto-replicating. Transformed cells, tissues, or plants are understood to encompass not only the end product of a transformation process, but also transgenic progeny thereof. A "non-transformed", "non-transgenic" or "non-recombinant" host refers to a wild-type organism, e.g. a bacterium or plant, which does not contain the heterologous nucleic acid molecule.

A "transgenic plant", as used herein, refers to a plant which contains a foreign nucleotide sequence inserted into either its nuclear genome or organelle genome. It encompasses further the offspring generations i.e. the T1-, T2- and consecutively generations or BC1-, BC2- and consecutively generation as well as crossbreeds thereof with non-transgenic or other transgenic plants.

The host organism (=transgenic organism) advantageously contains at least one copy of the nucleic acid according to the invention and/or of the nucleic acid construct according to the invention.

In principle all plants can be used as host organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassava, potato, sugarbeet, egg plant, alfalfa, and perennial grasses and forage plants, oil palm, vegetables (*brassicas*, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

In one embodiment of the invention transgenic plants are selected from the group comprising cereals, soybean, rapeseed (including oil seed rape, especially canola and winter oil seed rape), cotton sugarcane and potato, especially corn, soy, rapeseed (including oil seed rape, especially canola and winter oil seed rape), cotton, wheat and rice.

In another embodiment of the invention the transgenic plant is a gymnosperm plant, especially a spruce, pine or fir.

In one embodiment, the host plant is selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum Theobroma cacao* or *Camellia sinensis*. Anacardiaceae such as the genera *Pistacia, Mangifera, Anacardium* e.g. the species *Pistacia vera* [pistachios, Pistazie], *Mangifer*

*indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy], *Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrate, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Corylus avellana* or *Corylus colurna* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta [manihot*, arrowroot, tapioca, cassava] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inge fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [basard logwood, silk tree, East Indian Walnut], *Medicago sativa, Medicago falcate, Medicago varia* [alfalfa] *Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglens nigra* or *Wallia nigra* [walnut, black walnut, common walnut, persian walnut, white walnut, butternut, black walnut]; Lauraceae such as the genera *Persea, Laurus* e.g. the species laurel *Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminate, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elacis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata*. [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum [barley*, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum [Sorghum, millet], Oryza sativa, Oryza latifolia* [rice], *Zea mays* [corn, maize] *Triticum aestivum, Triticum durum, Triticum turgidum, Triti-* cum hybernum, Triticum macha, Triticum sativum or Triticum vulgare [wheat, bread wheat, common wheat], Proteaceae such as the genera Macadamia e.g. the species Macadamia intergrifolia [macadamia]; Rubiaceae such as the genera Coffea e.g. the species Cofea spp., Coffea arabica, Coffea canephora or Coffea liberica [coffee]; Scrophulariaceae such as the genera Verbascum e.g. the species Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum or Verbascum thapsus [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera Capsicum, Nicotiana, Solanum, Lycopersicon e.g. the species Capsicum annuum, Capsicum annuum var. glabriusculum, Capsicum frutescens [pepper], Capsicum annuum [paprika], Nicotiana tabacum, Nicotiana alata, Nicotiana attenuata, Nicotiana glauca, Nicotiana langsdorffii, Nicotiana obtusifolia, Nicotiana quadrivalvis, Nicotiana repanda, Nicotiana rustica, Nicotiana sylvestris [tobacco], Solanum tuberosum [potato], Solanum melongena [eggplant] (Lycopersicon esculentum, Lycopersicon lycopersicum, Lycopersicon pyriforme, Solanum integrifolium or Solanum lycopersicum [tomato]; Sterculiaceae such as the genera Theobroma e.g. the species Theobroma cacao [cacao]; Theaceae such as the genera Camellia e.g. the species Camellia sinensis) [tea].

The introduction of the nucleic acids according to the invention, the expression cassette or the vector into organisms, plants for example, can in principle be done by all of the methods known to those skilled in the art. The introduction of the nucleic acid sequences gives rise to recombinant or transgenic organisms.

Unless otherwise specified, the terms "polynucleotides", "nucleic acid" and "nucleic acid molecule" as used herein are interchangeably. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

The genes of the invention, coding for an activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein are also called "LTRRP gene" or interchangeable "YRP gene".

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. The triplets taa, tga and tag represent the (usual) stop codons which are interchangeable. A coding sequence can include, but is not limited to mRNA, cDNA, recombinant nucleotide sequences or genomic DNA, while introns may be present as well under certain circumstances.

The transfer of foreign genes into the genome of a plant is called transformation. In doing this the methods described for the transformation and regeneration of plants from plant tissues or plant cells are utilized for transient or stable transformation. Suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by Agrobacterium. Said methods are described by way of example in Jenes B. et al., Techniques for Gene Transfer, in: Transgenic Plants, Vol. 1, Engineering and Utilization, eds. Kung S. D and Wu R., Academic Press (1993) 128-143 and in Potrykus, Annu. Rev. Plant Physiol. Plant Molec. Biol. 42, 205 (1991). The nucleic acids or the construct to be expressed is preferably cloned into a vector which is suitable for transforming Agrobacterium tumefaciens, for example pBin19 (Bevan et al., Nucl. Acids Res. 12, 8711 (1984)). Agrobacteria transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of Agrobacterium tumefaciens is described, for example, by Höfgen and Willmitzer in Nucl. Acid Res. 16, 9877 (1988) or is known inter alia from White F. F., Vectors for Gene Transfer in Higher Plants; in Transgenic Plants, Vol. 1, Engineering and Utilization, eds. Kung S. D. and Wu R., Academic Press, 1993, pp. 15-38.

Agrobacteria transformed by an expression vector according to the invention may likewise be used in known manner for the transformation of plants such as test plants like *Arabidopsis* or crop plants such as cereal crops, corn, oats, rye, barley, wheat, soybean, rice, cotton, sugar beet, canola, sunflower, flax, hemp, potatoes, tobacco, tomatoes, carrots, paprika, oilseed rape, tapioca, cassava, arrowroot, tagetes, alfalfa, lettuce and the various tree, nut and vine species, in particular oil-containing crop plants such as soybean, peanut, castor oil plant, sunflower, corn, cotton, flax, oilseed rape, coconut, oil palm, safflower (*Carthamus tinctorius*) or cocoa bean, or in particular corn, wheat, soybean, rice, cotton and canola, e.g. by bathing bruised leaves or chopped leaves in an agrobacterial solution and then culturing them in suitable media.

The genetically modified plant cells may be regenerated by all of the methods known to those skilled in the art. Appropriate methods can be found in the publications referred to above by Kung S. D. and Wu R., Potrykus or Höfgen and Willmitzer.

Accordingly, a further aspect of the invention relates to transgenic organisms transformed by at least one nucleic acid sequence, expression cassette or vector according to the invention as well as cells, cell cultures, tissue, parts—such as, for example, leaves, roots, etc. in the case of plant organisms—or reproductive material derived from such organisms. The terms "host organism", "host cell", "recombinant (host) organism" and "transgenic (host) cell" are used here interchangeably. Of course these terms relate not only to the particular host organism or the particular target cell but also to the descendants or potential descendants of these organisms or cells. Since, due to mutation or environmental effects certain modifications may arise in successive generations, these descendants need not necessarily be identical with the parental cell but nevertheless are still encompassed by the term as used here.

For the purposes of the invention "transgenic" or "recombinant" means with regard for example to a nucleic acid sequence, an expression cassette (=gene construct, nucleic acid construct) or a vector containing the nucleic acid sequence according to the invention or an organism transformed by the nucleic acid sequences, expression cassette or vector according to the invention all those constructions produced by genetic engineering methods in which either (a) the nucleic acid sequence depicted in table I, application no. 1, column 5 or 7 or its derivatives or parts thereof; or
(b) a genetic control sequence functionally linked to the nucleic acid sequence described under (a), for example a 3'- and/or 5'-genetic control sequence such as a promoter or terminator, or
(c) (a) and (b);

are not found in their natural, genetic environment or have been modified by genetic engineering methods, wherein the modification may by way of example be a substitution, addition, deletion, inversion or insertion of one or more nucleotide residues. Natural genetic environment means the natural genomic or chromosomal locus in the organism of origin or inside the host organism or presence in a genomic library. In the case of a genomic library the natural genetic environment of the nucleic acid sequence is preferably retained at least in part. The environment borders the nucleic acid sequence at least on one side and has a sequence length of at least 50 bp, preferably at least 500 bp, particularly preferably at least 1,000 bp, most particularly preferably at least 5,000 bp. A naturally occurring expression cassette—for example the naturally occurring combination of the natural promoter of the nucleic acid sequence according to the invention with the corresponding gene—turns into a transgenic expression cassette when the latter is modified by unnatural, synthetic ("artificial") methods such as by way of example a mutagenation. Appropriate methods are described by way of example in U.S. Pat. No. 5,565,350 or WO 00/15815.

Suitable organisms or host organisms for the nucleic acid, expression cassette or vector according to the invention are advantageously in principle all organisms, which are suitable for the expression of recombinant genes as described above. Further examples which may be mentioned are plants such as *Arabidopsis*, Asteraceae such as *Calendula* or crop plants such as soybean, peanut, castor oil plant, sunflower, flax, corn, cotton, flax, oilseed rape, coconut, oil palm, safflower (*Carthamus tinctorius*) or cocoa bean.

In one embodiment of the invention host plants for the nucleic acid, expression cassette or vector according to the invention are selected from the group comprising corn, soy, oil seed rape (including canola and winter oil seed rape), cotton, wheat and rice.

A further object of the invention relates to the use of a nucleic acid construct, e.g. an expression cassette, containing one or more DNA sequences encoding one or more polypeptides shown in table II or comprising one or more nucleic acid molecules as depicted in table I or encoding or DNA sequences hybridizing therewith for the transformation of plant cells, tissues or parts of plants.

In doing so, depending on the choice of promoter, the nucleic acid molecules or sequences shown in table I or II can be expressed specifically in the leaves, in the seeds, the nodules, in roots, in the stem or other parts of the plant. Those transgenic plants overproducing sequences, e.g. as depicted in table I, the reproductive material thereof, together with the plant cells, tissues or parts thereof are a further object of the present invention.

The expression cassette or the nucleic acid sequences or construct according to the invention containing nucleic acid molecules or sequences according to table I can, moreover, also be employed for the transformation of the organisms identified by way of example above such as bacteria, yeasts, filamentous fungi and plants.

Within the framework of the present invention, increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait relates to, for example, the artificially acquired trait of increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait, by comparison with the non-genetically modified initial plants e.g. the trait acquired by genetic modification of the target organism, and due to functional over-expression of one or more polypeptide (sequences) of table II, e.g. encoded by the corresponding nucleic acid molecules as depicted in table I, column 5 or 7, and/or homologs, in the organisms according to the invention, advantageously in the transgenic plant according to the invention or produced according to the method of the invention, at least for the duration of at least one plant generation.

A constitutive expression of the polypeptide sequences of table II, encoded by the corresponding nucleic acid molecule as depicted in table I, column 5 or 7 and/or homologs is, moreover, advantageous. On the other hand, however, an inducible expression may also appear desirable. Expression of the polypeptide sequences of the invention can be either direct to the cytoplasm or the organelles, preferably the plastids of the host cells, preferably the plant cells.

The efficiency of the expression of the sequences of the of table II, encoded by the corresponding nucleic acid molecule as depicted in table I, column 5 or 7 and/or homologs can be determined, for example, in vitro by shoot meristem propagation. In addition, an expression of the sequences of table II, encoded by the corresponding nucleic acid molecule as depicted in table I, column 5 or 7 and/or homologs modified in nature and level and its effect on yield, e.g. on an increased yield-related trait, for example enhanced tolerance to abiotic environmental stress, for example an increased drought tolerance and/or low temperature tolerance and/or an increased nutrient use efficiency, but also on the metabolic pathways performance can be tested on test plants in greenhouse trials.

An additional object of the invention comprises transgenic organisms such as transgenic plants transformed by an expression cassette containing sequences of as depicted in table I, column 5 or 7 according to the invention or DNA sequences hybridizing therewith, as well as transgenic cells, tissue, parts and reproduction material of such plants. Particular preference is given in this case to transgenic crop plants such as by way of example barley, wheat, rye, oats, corn, soybean, rice, cotton, sugar beet, oilseed rape and canola, sunflower, flax, hemp, thistle, potatoes, tobacco, tomatoes, tapioca, cassava, arrowroot, alfalfa, lettuce and the various tree, nut and vine species.

In one embodiment of the invention transgenic plants transformed by an expression cassette containing or comprising nucleic acid molecules or sequences as depicted in table I, column 5 or 7, in particular of table IIB, according to the invention or DNA sequences hybridizing therewith are selected from the group comprising corn, soy, oil seed rape (including canola and winter oil seed rape), cotton, wheat and rice.

For the purposes of the invention plants are mono- and dicotyledonous plants, mosses or algae, especially plants, for example in one embodiment monocotyledonous plants, or for example in another embodiment dicotyledonous plants. A further refinement according to the invention are transgenic plants as described above which contain a nucleic acid sequence or construct according to the invention or a expression cassette according to the invention.

However, transgenic also means that the nucleic acids according to the invention are located at their natural position in the genome of an organism, but that the sequence, e.g. the coding sequence or a regulatory sequence, for example the promoter sequence, has been modified in comparison with the natural sequence. Preferably, transgenic/recombinant is to be understood as meaning the transcription of one or more nucleic acids or molecules of the invention and being shown in table I, occurs at a non-natural position in the genome. In one embodiment, the expression of the nucleic acids or molecules is homologous. In another embodiment, the expression of the nucleic acids or molecules is heterologous. This expression can be transiently or of a sequence integrated stably into the genome.

The term "transgenic plants" used in accordance with the invention also refers to the progeny of a transgenic plant, for example the $T_1$, $T_2$, $T_3$ and subsequent plant generations or the $BC_1$, $BC_2$, $BC_3$ and subsequent plant generations. Thus, the transgenic plants according to the invention can be raised and selfed or crossed with other individuals in order to obtain further transgenic plants according to the invention. Transgenic plants may also be obtained by propagating transgenic plant cells vegetatively. The present invention also relates to transgenic plant material, which can be derived from a transgenic plant population according to the invention. Such material includes plant cells and certain tissues, organs and parts of plants in all their manifestations, such as seeds, leaves, anthers, fibers, tubers, roots, root hairs, stems, embryo, calli, cotelydons, petioles, harvested material, plant tissue, reproductive tissue and cell cultures, which are derived from the actual transgenic plant and/or can be used for bringing about the transgenic plant. Any transformed plant obtained according to the invention can be used in a conventional breeding scheme or in in vitro plant propagation to produce more transformed plants with the same characteristics and/or can be used to introduce the same characteristic in other varieties of the same or related species. Such plants are also part of the invention. Seeds obtained from the transformed plants genetically also contain the same characteristic and are part of the invention. As mentioned before, the present invention is in principle applicable to any plant and crop that can be transformed with any of the transformation method known to those skilled in the art.

Advantageous inducible plant promoters are by way of example the PRP1 promoter (Ward et al., Plant. Mol. Biol. 22361 (1993)), a promoter inducible by benzenesulfonamide (EP 388 186), a promoter inducible by tetracycline (Gatz et al., Plant J. 2, 397 (1992)), a promoter inducible by salicylic acid (WO 95/19443), a promoter inducible by abscisic acid (EP 335 528) and a promoter inducible by ethanol or cyclohexanone (WO 93/21334). Other examples of plant promoters which can advantageously be used are the promoter of cytoplasmic FBPase from potato, the ST-LSI promoter from potato (Stockhaus et al., EMBO J. 8, 2445 (1989)), the promoter of phosphoribosyl pyrophosphate amidotransferase from *Glycine max* (see also gene bank accession number U87999) or a nodiene-specific promoter as described in EP 249 676.

Particular advantageous are those promoters which ensure expression upon onset of abiotic stress conditions. Particular advantageous are those promoters which ensure expression upon onset of low temperature conditions, e.g. at the onset of chilling and/or freezing temperatures as defined hereinabove, e.g. for the expression of nucleic acid molecules as shown in table VIIIb. Advantageous are those promoters which ensure expression upon conditions of limited nutrient availability, e.g. the onset of limited nitrogen sources in case the nitrogen of the soil or nutrient is exhausted, e.g. for the expression of the nucleic acid molecules or their gene products as shown in table VIIIa. Particular advantageous are those promoters which ensure expression upon onset of water deficiency, as defined hereinabove, e.g. for the expression of the nucleic acid molecules or their gene products as shown in table VIIIc. Particular advantageous are those promoters which ensure expression upon onset of standard growth conditions, e.g. under condition without stress and deficient nutrient provision, e.g. for the expression of the nucleic acid molecules or their gene products as shown in table VIIId.

Such promoters are known to the person skilled in the art or can be isolated from genes which are induced under the conditions mentioned above. In one embodiment, seed-specific promoters may be used for monocotylodonous or dicotylodonous plants.

In principle all natural promoters with their regulation sequences can be used like those named above for the expression cassette according to the invention and the method according to the invention. Over and above this, synthetic promoters may also advantageously be used. In the preparation of an expression cassette various DNA fragments can be manipulated in order to obtain a nucleotide sequence, which usefully reads in the correct direction and is equipped with a correct reading frame. To connect the DNA fragments (=nucleic acids according to the invention) to one another adaptors or linkers may be attached to the fragments. The promoter and the terminator regions can usefully be provided in the transcription direction with a linker or polylinker containing one or more restriction points for the insertion of this sequence. Generally, the linker has 1 to 10, mostly 1 to 8, preferably 2 to 6, restriction points. In general the size of the linker inside the regulatory region is less than 100 bp, frequently less than 60 bp, but at least 5 bp. The promoter may be both native or homologous as well as foreign or heterologous to the host organism, for example to the host plant. In the 5'-3' transcription direction the expression cassette contains the promoter, a DNA sequence which shown in table I and a region for transcription termination. Different termination regions can be exchanged for one another in any desired fashion.

As also used herein, the terms "nucleic acid" and "nucleic acid molecule" are intended to include DNA molecules (e.g. cDNA or genomic DNA) and RNA molecules (e.g. mRNA) and analogs of the DNA or RNA generated using nucleotide analogs. This term also encompasses untranslated sequence located at both the 3' and 5' ends of the coding region of the gene—at least about 1000 nucleotides of sequence upstream from the 5' end of the coding region and at least about 200 nucleotides of sequence downstream from the 3' end of the coding region of the gene. The nucleic acid molecule can be single-stranded or double-stranded, but preferably is double-stranded DNA.

An "isolated" nucleic acid molecule is one that is substantially separated from other nucleic acid molecules, which are present in the natural source of the nucleic acid. That means other nucleic acid molecules are present in an amount less than 5% based on weight of the amount of the desired nucleic acid, preferably less than 2% by weight, more preferably less than 1% by weight, most preferably less than 0.5% by weight. Preferably, an "isolated" nucleic acid is free of some of the sequences that naturally flank the nucleic acid (i.e., sequences located at the 5' and 3' ends of the nucleic acid) in the genomic DNA of the organism from which the nucleic acid is derived. For example, in various embodiments, the isolated yield increasing, for example, low temperature resistance and/or tolerance related protein (LTRRP or YRP) encoding nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized.

A nucleic acid molecule of the present invention, e.g., a nucleic acid molecule encoding an LTRRP or YRP or a portion thereof which confers increased yield, e.g. an increased yield-related trait, e.g. an enhanced tolerance to abiotic environmental stress and/or increased nutrient use efficiency and/or enhanced cycling drought tolerance in plants, can be isolated using standard molecular biological techniques and the sequence information provided herein. For example, an *A. thaliana* LTRRP or YRP encoding cDNA can be isolated from a *A. thaliana* c-DNA library or a *Synechocystis* sp., *A. thaliana*, *Brassica napus*, *Glycine max*, *Zea mays* or *Oryza sativa*, LTRRP or YRP encoding cDNA can be isolated from a *Synechocystis* sp., *A. thaliana*, *Brassica napus*, *Glycine max*, *Zea mays* or *Oryza sativa*, c-DNA library respectively using all or portion of one of the sequences shown in table I. Moreover, a nucleic acid molecule encompassing all or a portion of one of the sequences of table I can be isolated by the polymerase chain reaction using oligonucleotide primers designed based upon this sequence. For example, mRNA can be isolated from plant cells (e.g., by the guanidinium-thiocyanate extraction procedure of Chirgwin et al., Biochemistry 18, 5294 (1979)) and cDNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in table I. A nucleic acid molecule of the invention can be amplified using cDNA or, alternatively, genomic DNA, as a template and appropriate oligonucleotide primers according to standard PCR amplification techniques. The nucleic acid molecule so amplified can be cloned into an appropriate vector and characterized by DNA sequence analysis. Furthermore, oligonucleotides corresponding to a LTRRP or YRP encoding nucleotide sequence can be prepared by standard synthetic techniques, e.g., using an automated DNA synthesizer.

In an embodiment, an isolated nucleic acid molecule of the invention comprises one of the nucleotide sequences or molecules as shown in table I encoding the LTRRP or YRP (i.e., the "coding region"), as well as a 5' untranslated sequence and 3' untranslated sequence.

Moreover, the nucleic acid molecule of the invention can comprise only a portion of the coding region of one of the sequences or molecules of a nucleic acid of table I, for example, a fragment which can be used as a probe or primer or a fragment encoding a biologically active portion of a LTRRP or YRP.

Portions of proteins encoded by the LTRRP or YRP encoding nucleic acid molecules of the invention are preferably biologically active portions described herein. As used herein, the term "biologically active portion of" a LTRRP or YRP is intended to include a portion, e.g. a domain/motif, of increased yield, e.g. increased or enhanced an yield related trait, e.g. increased the low temperature resistance and/or tolerance related protein that participates in an enhanced nutrient use efficiency e.g. NUE efficiency, and/or increased intrinsic yield in a plant. To determine whether a LTRRP or YRP, or a biologically active portion thereof, results in an increased yield, e.g. increased or enhanced an yield related trait, e.g. increased the low temperature resistance and/or tolerance related protein that participates in an enhanced nutrient use efficiency, e.g. NUE efficiency and/or increased intrinsic yield in a plant, an analysis of a plant comprising the LTRRP or YRP may be performed. Such analysis methods are well known to those skilled in the art, as detailed in the Examples. More specifically, nucleic acid fragments encoding biologically active portions of a LTRRP or YRP can be prepared by isolating a portion of one of the sequences of the nucleic acid of table I expressing the encoded portion of the LTRRP or YRP or peptide (e.g., by recombinant expression in vitro) and assessing the activity of the encoded portion of the LTRRP or YRP or peptide.

Biologically active portions of a LTRRP or YRP are encompassed by the present invention and include peptides comprising amino acid sequences derived from the amino acid sequence of a LTRRP or YRP encoding gene, or the amino acid sequence of a protein homologous to a LTRRP or YRP, which include fewer amino acids than a full length LTRRP or YRP or the full length protein which is homologous to a LTRRP or YRP, and exhibits at least some enzymatic or biological activity of a LTRRP or YRP. Typically, biologically active portions (e.g., peptides which are, for example, 5, 10, 15, 20, 30, 35, 36, 37, 38, 39, 40, 50, 100 or more amino acids in length) comprise a domain or motif with at least one activity of a LTRRP or YRP. Moreover, other biologically active portions in which other regions of the protein are deleted, can be prepared by recombinant techniques and evaluated for one or more of the activities described herein. Preferably, the biologically active portions of a LTRRP or YRP include one or more selected domains/motifs or portions thereof having biological activity.

The term "biological active portion" or "biological activity" means a polypeptide as depicted in table II, column 3 or a portion of said polypeptide which still has at least 10% or 20%, preferably 30%, 40%, 50% or 60%, especially preferably 70%, 75%, 80%, 90% or 95% of the enzymatic or biological activity of the natural or starting enzyme or protein.

In the process according to the invention nucleic acid sequences or molecules can be used, which, if appropriate, contain synthetic, non-natural or modified nucleotide bases, which can be incorporated into DNA or RNA. Said synthetic, non-natural or modified bases can for example increase the stability of the nucleic acid molecule outside or inside a cell. The nucleic acid molecules of the invention can contain the same modifications as aforementioned.

As used in the present context the term "nucleic acid molecule" may also encompass the untranslated sequence or molecule located at the 3' and at the 5' end of the coding gene region, for example at least 500, preferably 200, especially preferably 100, nucleotides of the sequence upstream of the 5' end of the coding region and at least 100, preferably 50, especially preferably 20, nucleotides of the sequence downstream of the 3' end of the coding gene region. It is often advantageous only to choose the coding region for cloning and expression purposes.

Preferably, the nucleic acid molecule used in the process according to the invention or the nucleic acid molecule of the invention is an isolated nucleic acid molecule. In one embodiment, the nucleic acid molecule of the invention is the nucleic acid molecule used in the process of the invention.

An "isolated" polynucleotide or nucleic acid molecule is separated from other polynucleotides or nucleic acid molecules, which are present in the natural source of the nucleic acid molecule. An isolated nucleic acid molecule may be a chromosomal fragment of several kb, or preferably, a molecule only comprising the coding region of the gene. Accordingly, an isolated nucleic acid molecule of the invention may comprise chromosomal regions, which are adjacent 5' and 3' or further adjacent chromosomal regions, but preferably comprises no such sequences which naturally flank the nucleic acid molecule sequence in the genomic or chromosomal context in the organism from which the nucleic acid molecule originates (for example sequences which are adjacent to the regions encoding the 5'- and 3'-UTRs of the nucleic acid molecule). In various embodiments, the isolated nucleic acid molecule used in the process according to the invention may, for example comprise less than approximately 5 kb, 4 kb, 3 kb, 2 kb, 1 kb, 0.5 kb or 0.1 kb nucleotide sequences which naturally flank the nucleic acid molecule in the genomic DNA of the cell from which the nucleic acid molecule originates.

The nucleic acid molecules used in the process, for example the polynucleotide of the invention or of a part thereof can be isolated using molecular-biological standard techniques and the sequence information provided herein. Also, for example a homologous sequence or homologous, conserved sequence regions at the DNA or amino acid level can be identified with the aid of comparison algorithms. The former can be used as hybridization probes under standard hybridization techniques (for example those described in Sambrook et al., Molecular Cloning: A Laboratory Manual. 2nd Ed., Cold Spring Harbor Laboratory, Cold Spring Harbor Laboratory Press, Cold Spring Harbor, N.Y., 1989) for isolating further nucleic acid sequences useful in this process.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this very sequence. For example, mRNA can be isolated from cells (for example by means of the guanidinium thiocyanate extraction method of Chirgwin et al., Biochemistry 18, 5294 (1979)) and cDNA can be generated by means of reverse transcriptase (for example Moloney, MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as shown in table III, column 7, by means of polymerase chain reaction can be generated on the basis of a sequence shown herein, for example the sequence shown in table I, columns 5 and 7 or the sequences derived from table II, columns 5 and 7.

Moreover, it is possible to identify a conserved protein by carrying out protein sequence alignments with the polypeptide encoded by the nucleic acid molecules of the present invention, in particular with the sequences encoded by the nucleic acid molecule shown in column 5 or 7 of table I, from which conserved regions, and in turn, degenerate primers can be derived. Conserved regions are those, which show a very little variation in the amino acid in one particular position of several homologs from different origin. The consensus sequence and polypeptide motifs shown in column 7 of table IV, are derived from said alignments. Moreover, it is possible to identify conserved regions from various organisms by carrying out protein sequence alignments with the polypeptide encoded by the nucleic acid of the present invention, in particular with the sequences encoded by the polypeptide molecule shown in column 5 or 7 of table II, from which conserved regions, and in turn, degenerate primers can be derived.

In one advantageous embodiment, in the method of the present invention the activity of a polypeptide comprising or consisting of a consensus sequence or a polypeptide motif shown in table IV, column 7 is increased and in one another embodiment, the present invention relates to a polypeptide comprising or consisting of a consensus sequence or a polypeptide motif shown in table IV, column 7 whereby less than 20, preferably less than 15 or 10, preferably less than 9, 8, 7, or 6, more preferred less than 5 or 4, even more preferred less then 3, even more preferred less then 2, even more preferred 0 of the amino acids positions indicated can be replaced by any amino acid. In one embodiment not more than 15%, preferably 10%, even more preferred 5%, 4%, 3%, or 2%, most preferred 1% or 0% of the amino acid position indicated by a letter are/is replaced another amino acid. In one embodiment less than 20, preferably less than 15 or 10, preferably less than 9, 8, 7, or 6, more preferred less than 5 or 4, even more preferred less than 3, even more preferred less than 2, even more preferred 0 amino acids are inserted into a consensus sequence or protein motif.

The consensus sequence was derived from a multiple alignment of the sequences as listed in table II. The letters represent the one letter amino acid code and indicate that the amino acids are conserved in at least 80% of the aligned proteins, whereas the letter X stands for amino acids, which are not conserved in at least 80% of the aligned sequences. The consensus sequence starts with the first conserved amino acid in the alignment, and ends with the last conserved amino acid in the alignment of the investigated sequences. The number of given X indicates the distances between conserved amino acid residues, e.g. Y-x(21,23)-F means that conserved tyrosine and phenylalanine residues in the alignment are separated from each other by minimum 21 and maximum 23 amino acid residues in the alignment of all investigated sequences.

Conserved domains were identified from all sequences and are described using a subset of the standard Prosite notation, e.g. the pattern Y-x(21,23)-[FW] means that a conserved tyrosine is separated by minimum 21 and maximum 23 amino acid residues from either a phenylalanine or tryptophane. Patterns had to match at least 80% of the investigated proteins. Conserved patterns were identified with the software tool MEME version 3.5.1 or manually. MEME was developed by Timothy L. Bailey and Charles Elkan, Dept. of Computer Science and Engeneering, University of California, San Diego, USA and is described by Timothy L. Bailey and Charles Elkan (Fitting a mixture model by expectation maximization to discover motifs in biopolymers, Proceedings of the Second International Conference on Intelligent Systems for Molecular Biology, pp. 28-36, AAAI Press, Menlo Park, Calif., 1994). The source code for the stand-alone program is public available from the San Diego Supercomputer centre. For identifying common motifs in all sequences with the software tool MEME, the following settings were used: -maxsize 500000, -nmotifs 15, -evt 0.001, -maxw 60, -distance 1e-3, -minsites number of sequences used for the analysis. Input sequences for MEME were non-aligned sequences in Fasta format. Other parameters were used in the default settings in this software version. Prosite patterns for conserved domains were generated with the software tool Pratt version 2.1 or manually. Pratt was developed by Inge Jonassen, Dept. of Informatics, University of Bergen, Norway and is described by Jonassen et al. (I. Jonassen, J. F. Collins and D. G. Higgins, Finding flexible patterns in unaligned protein sequences, Protein Science 4 (1995), pp. 1587-1595; I. Jonassen, Efficient discovery of conserved patterns using a pattern graph, Submitted to CABIOS February 1997]. The source code (ANSI C) for the stand-alone program is public available, e.g. at establisched Bioinformatic centers like EBI (European Bioinformatics Institute). For generating patterns with the software tool Pratt, following settings were used: PL (max Pattern Length): 100, PN (max Nr of Pattern Symbols): 100, PX (max Nr of consecutive x's): 30, FN (max Nr of flexible spacers): 5, FL (max Flexibility): 30, FP (max Flex-.Product): 10, ON (max number patterns): 50. Input sequences for Pratt were distinct regions of the protein sequences exhibiting high similarity as identified from software tool MEME. The minimum number of sequences, which have to match the generated patterns (CM, min Nr of Seqs to Match) was set to at least 80% of the provided sequences. Parameters not mentioned here were used in their default settings. The Prosite patterns of the conserved domains can be used to search for protein sequences matching this pattern. Various established Bioinformatic centres provide public internet portals for using those patterns in database searches (e.g. PIR (Protein Information Resource, located at Georgetown University Medical Center) or ExPASy (Expert Protein Analysis System)). Alternatively, stand-alone software is available, like the program Fuzzpro, which is part of the EMBOSS software package. For example, the program Fuzzpro not only allows to search for an exact pattern-protein match but also allows to set various ambiguities in the performed search.

The alignment was performed with the software ClustalW (version 1.83) and is described by Thompson et al. (Nucleic Acids Research 22, 4673 (1994)). The source code for the stand-alone program is public available from the European Molecular Biology Laboratory; Heidelberg, Germany. The analysis was performed using the default parameters of ClustalW v1.83 (gap open penalty: 10.0; gap extension penalty: 0.2; protein matrix: Gonnet; protein/DNA endgap: -1; protein/DNA gapdist: 4).

Degenerated primers can then be utilized by PCR for the amplification of fragments of novel proteins having abovementioned activity, e.g. conferring increased yield, e.g. the increased yield-related trait, in particular, the enhanced tolerance to abiotic environmental stress, e.g. low temperature tolerance, cycling drought tolerance, water use efficiency, nutrient (e.g. nitrogen) use efficiency and/or increased intrinsic yield as compared to a corresponding, e.g. non-transformed, wild type plant cell, plant or part thereof after increasing the expression or activity or having the activity of a protein as shown in table II, column 3 or further functional homologs of the polypeptide of the invention from other organisms.

These fragments can then be utilized as hybridization probe for isolating the complete gene sequence. As an alternative, the missing 5' and 3' sequences can be isolated by means of RACE-PCR. A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as or for the generation of a hybridization probe and following standard hybridization techniques under stringent hybridization conditions. In this context, it is possible to use, for example, isolated one or more nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

By "hybridizing" it is meant that such nucleic acid molecules hybridize under conventional hybridization conditions, preferably under stringent conditions such as described by, e.g., Sambrook (Molecular Cloning; A Laboratory Manual, $2^{nd}$ Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further information about the expressed gene product: e.g. expression pattern, occurrence of processing steps, like splicing and capping, etc. The Southern blot assay provides additional information about the chromosomal localization and organization of the gene encoding the nucleic acid molecule of the invention.

A preferred, non-limiting example of stringent hybridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×, 0.5×, 1×, 2×, 3×, 4× or 5×SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G+C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 0.2×SSC at 50° C., preferably at 65° C.) (20×SSC: 0.3 M sodium citrate, 3 M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied. Denaturants, for example formamide or SDS, may also be employed during the hybridization. In the presence of 50% formamide, hybridization is preferably effected at 42° C. Relevant factors like 1) length of treatment, 2) salt conditions, 3) detergent conditions, 4) competitor DNAs, 5) temperature and 6) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridization with radioactive labelled probe is done overnight at 68° C. Subsequent washing steps are performed at 68° C. with 1×SSC. For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Some examples of conditions for DNA hybridization (Southern blot assays) and wash step are shown herein below:

(1) Hybridization conditions can be selected, for example, from the following conditions:
(a) 4×SSC at 65° C.,
(b) 6×SSC at 45° C.,
(c) 6×SSC, 100 mg/ml denatured fragmented fish sperm DNA at 68° C.,
(d) 6×SSC, 0.5% SDS, 100 mg/ml denatured salmon sperm DNA at 68° C.,
(e) 6×SSC, 0.5% SDS, 100 mg/ml denatured fragmented salmon sperm DNA, 50% formamide at 42° C.,
(f) 50% formamide, 4×SSC at 42° C.,
(g) 50% (v/v) formamide, 0.1% bovine serum albumin, 0.1% Ficoll, 0.1% polyvinylpyrrolidone, 50 mM sodium phosphate buffer pH 6.5, 750 mM NaCl, 75 mM sodium citrate at 42° C.,
(h) 2× or 4×SSC at 50° C. (low-stringency condition), or
(i) 30 to 40% formamide, 2× or 4×SSC at 42° C. (low-stringency condition).

(2) Wash steps can be selected, for example, from the following conditions:
(a) 0.015 M NaCl/0.0015 M sodium citrate/0.1% SDS at 50° C.
(b) 0.1×SSC at 65° C.
(c) 0.1×SSC, 0.5% SDS at 68° C.
(d) 0.1×SSC, 0.5% SDS, 50% formamide at 42° C.
(e) 0.2×SSC, 0.1% SDS at 42° C.
(f) 2×SSC at 65° C. (low-stringency condition).

Polypeptides having above-mentioned activity, i.e. conferring increased yield, e.g. an increased yield-related trait as mentioned herein, e.g. increased abiotic stress tolerance, e.g. low temperature tolerance, e.g. with increased nutrient use efficiency, and/or water use efficiency and/or increased intrinsic yield as compared to a corresponding, e.g. non-transformed, wild type plant cell, plant or part thereof, derived from other organisms, can be encoded by other DNA sequences which hybridize to the sequences shown in table I, columns 5 and 7 under relaxed hybridization conditions and which code on expression for peptides conferring the increased yield, e.g. an increased yield-related trait as mentioned herein, e.g. increased abiotic stress tolerance, e.g. low temperature tolerance or enhanced cold tolerance, e.g. with increased nutrient use efficiency, and/or water use efficiency and/or increased intrinsic yield, as compared to a corresponding, e.g. non-transformed, wild type plant cell, plant or part thereof.

Further, some applications have to be performed at low stringency hybridization conditions, without any consequences for the specificity of the hybridization. For example, a Southern blot analysis of total DNA could be probed with a nucleic acid molecule of the present invention and washed at low stringency (55° C. in 2× SSPE, 0.1% SDS). The hybridization analysis could reveal a simple pattern of only genes encoding polypeptides of the present invention or used in the process of the invention, e.g. having the herein-mentioned activity of enhancing the increased yield, e.g. an increased yield-related trait as mentioned herein, e.g. increased abiotic stress tolerance, e.g. increased low temperature tolerance or enhanced cold tolerance, e.g. with increased nutrient use efficiency, and/or water use efficiency and/or increased intrinsic yield, as compared to a corresponding, e.g. non-transformed, wild type plant cell, plant or part thereof. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridization conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence or molecule referred to or hybridizing with the nucleic acid molecule of the invention or used in the process of the invention under stringent conditions, while the maximum size is not critical. In some applications, the maximum size usually is not substantially greater than that required to provide the desired activity and/or function(s) of the original sequence.

Typically, the truncated amino acid sequence or molecule will range from about 5 to about 310 amino acids in length. More typically, however, the sequence will be a maximum of about 250 amino acids in length, preferably a maximum of about 200 or 100 amino acids. It is usually desirable to select sequences of at least about 10, 12 or 15 amino acids, up to a maximum of about 20 or 25 amino acids.

The term "epitope" relates to specific immunoreactive sites within an antigen, also known as antigenic determinates. These epitopes can be a linear array of monomers in a polymeric composition—such as amino acids in a protein—or consist of or comprise a more complex secondary or tertiary structure. Those of skill will recognize that immunogens (i.e., substances capable of eliciting an immune response) are antigens; however, some antigen, such as haptens, are not immunogens but may be made immunogenic by coupling to a carrier molecule. The term "antigen" includes references to a substance to which an antibody can be generated and/or to which the antibody is specifically immunoreactive.

In one embodiment the present invention relates to a epitope of the polypeptide of the present invention or used in the process of the present invention and confers an increased yield, e.g. an increased yield-related trait as mentioned herein, e.g. increased abiotic stress tolerance, e.g. low temperature tolerance or enhanced cold tolerance, e.g. with increased nutrient use efficiency, and/or water use efficiency and/or increased intrinsic yield etc., as compared to a corresponding, e.g. non-transformed, wild type plant cell, plant or part thereof.

The term "one or several amino acids" relates to at least one amino acid but not more than that number of amino acids, which would result in a homology of below 50% identity. Preferably, the identity is more than 70% or 80%, more preferred are 85%, 90%, 91%, 92%, 93%, 94% or 95%, even more preferred are 96%, 97%, 98%, or 99% identity.

Further, the nucleic acid molecule of the invention comprises a nucleic acid molecule, which is a complement of one of the nucleotide sequences of above mentioned nucleic acid molecules or a portion thereof. A nucleic acid molecule or its sequence which is complementary to one of the nucleotide molecules or sequences shown in table I, columns 5 and 7 is one which is sufficiently complementary to one of the nucleotide molecules or sequences shown in table I, columns 5 and 7 such that it can hybridize to one of the nucleotide sequences shown in table I, columns 5 and 7, thereby forming a stable duplex. Preferably, the hybridization is performed under stringent hybrization conditions. However, a complement of one of the herein disclosed sequences is preferably a sequence complement thereto according to the base pairing of nucleic acid molecules well known to the skilled person. For example, the bases A and G undergo base pairing with the bases T and U or C, resp. and visa versa. Modifications of the bases can influence the base-pairing partner.

The nucleic acid molecule of the invention comprises a nucleotide sequence which is at least about 30%, 35%, 40% or 45%, preferably at least about 50%, 55%, 60% or 65%, more preferably at least about 70%, 80%, or 90%, and even more preferably at least about 95%, 97%, 98%, 99% or more homologous to a nucleotide sequence shown in table I, columns 5 and 7, or a portion thereof and preferably has above mentioned activity, in particular having a increasing-yield activity, e.g. increasing an yield-related trait, for example enhancing tolerance to abiotic environmental stress, for example increasing drought tolerance and/or low temperature tolerance and/or increasing nutrient use efficiency, increased intrinsic yield and/or another mentioned yield-related trait after increasing the activity or an activity of a gene as shown in table I or of a gene product, e.g. as shown in table II, column 3, by for example expression either in the cytsol or cytoplasm or in an organelle such as a plastid or mitochondria or both, preferably in plastids.

In one embodiment, the nucleic acid molecules marked in table I, column 6 with "plastidic" or gene products encoded by said nucleic acid molecules are expressed in combination with a targeting signal as described herein.

The nucleic acid molecule of the invention comprises a nucleotide sequence or molecule which hybridizes, preferably hybridizes under stringent conditions as defined herein, to one of the nucleotide sequences or molecule shown in table I, columns 5 and 7, or a portion thereof and encodes a protein having above-mentioned activity, e.g. conferring an increased yield, e.g. an increased yield-related trait, for example enhanced tolerance to abiotic environmental stress, for example an increased drought tolerance and/or low temperature tolerance and/or an increased nutrient use efficiency, increased intrinsic yield and/or another mentioned yield-related trait as compared to a corresponding, e.g. non-transformed, wild type plant cell, plant or part thereof by for example expression either in the cytsol or in an organelle such as a plastid or mitochondria or both, preferably in plastids, and optionally, the activity selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein.

Moreover, the nucleic acid molecule of the invention can comprise only a portion of the coding region of one of the sequences shown in table I, columns 5 and 7, for example a fragment which can be used as a probe or primer or a fragment encoding a biologically active portion of the polypeptide of the present invention or of a polypeptide used in the process of the present invention, i.e. having above-mentioned activity, e.g. conferring an increased yield, e.g. with an increased yield-related trait, for example enhanced tolerance to abiotic environmental stress, for example an increased drought tolerance and/or low temperature tolerance and/or an increased nutrient use efficiency, increased intrinsic yield and/or another mentioned yield-related trait as compared to a corresponding, e.g. non-transformed, wild type plant cell, plant or part thereof of its activity is increased by for example expression either in the cytsol or in an organelle such as a plastid or mitochondria or both, preferably in plastids. The nucleotide sequences determined from the cloning of the present protein-according-to-the-invention-encoding gene allows for the generation of probes and primers designed for use in identifying and/or cloning its homologues in other cell types and organisms. The probe/primer typically comprises substantially purified oligonucleotide. The oligonucleotide typically comprises a region of nucleotide sequence that hybridizes under stringent conditions to at least about 12, 15 preferably about 20 or 25, more preferably about 40, 50 or 75 consecutive nucleotides of a sense strand of one of the sequences set forth, e.g., in table I, columns 5 and 7, an anti-sense sequence of one of the sequences, e.g., set forth in table I, columns 5 and 7, or naturally occurring mutants thereof. Primers based on a nucleotide of invention can be used in PCR reactions to clone homologues of the polypeptide of the invention or of the polypeptide used in the process of the invention, e.g. as the primers described in the examples of the present invention, e.g. as shown in the examples. A PCR with the primers shown in table III, column 7 will result in a fragment of the gene product as shown in table II, column 3.

Primer sets are interchangeable. The person skilled in the art knows to combine said primers to result in the desired product, e.g. in a full length clone or a partial sequence. Probes based on the sequences of the nucleic acid molecule of the invention or used in the process of the present invention can be used to detect transcripts or genomic sequences encoding the same or homologous proteins. The probe can further comprise a label group attached thereto, e.g. the label group can be a radioisotope, a fluorescent compound, an enzyme, or an enzyme co-factor. Such probes can be used as a part of a genomic marker test kit for identifying cells which express an polypeptide of the invention or used in the process of the present invention, such as by measuring a level of an encoding nucleic acid molecule in a sample of cells, e.g., detecting mRNA levels or determining, whether a genomic gene comprising the sequence of the polynucleotide of the invention or used in the processes of the present invention has been mutated or deleted.

The nucleic acid molecule of the invention encodes a polypeptide or portion thereof which includes an amino acid sequence which is sufficiently homologous to the amino acid sequence shown in table II, columns 5 and 7 such that the protein or portion thereof maintains the ability to participate in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait as compared to a corresponding, e.g. non-transformed, wild type plant cell, plant or part thereof, in particular increasing the activity as mentioned above or as described in the examples in plants is comprised.

As used herein, the language "sufficiently homologous" refers to proteins or portions thereof which have amino acid sequences which include a minimum number of identical or equivalent amino acid residues (e.g., an amino acid residue which has a similar side chain as an amino acid residue in one of the sequences of the polypeptide of the present invention) to an amino acid sequence shown in table II, columns 5 and 7 such that the protein or portion thereof is able to participate in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait as compared to a corresponding, e.g. non-transformed, wild type plant cell, plant or part thereof. For examples having the activity of a protein as shown in table II, column 3 and as described herein.

In one embodiment, the nucleic acid molecule of the present invention comprises a nucleic acid that encodes a portion of the protein of the present invention. The protein is at least about 30%, 35%, 40%, 45% or 50%, preferably at least about 55%, 60%, 65% or 70%, and more preferably at least about 75%, 80%, 85%, 90%, 91%, 92%, 93% or 94% and most preferably at least about 95%, 97%, 98%, 99% or more homologous to an entire amino acid sequence of table II, columns 5 and 7 and having above-mentioned activity, e.g. conferring an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof by for example expression either in the cytsol or in an organelle such as a plastid or mitochondria or both, preferably in plastids.

Portions of proteins encoded by the nucleic acid molecule of the invention are preferably biologically active, preferably having above-mentioned annotated activity, e.g. conferring an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof after increase of activity.

As mentioned herein, the term "biologically active portion" is intended to include a portion, e.g., a domain/motif, that confers an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof or has an immunological activity such that it is binds to an antibody binding specifically to the polypeptide of the present invention or a polypeptide used in the process of the present invention for increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait as compared to a corresponding, e.g. non-transformed, wild type plant cell, plant or part thereof.

The invention further relates to nucleic acid molecules that differ from one of the nucleotide sequences shown in table I A, columns 5 and 7 (and portions thereof) due to degeneracy of the genetic code and thus encode a polypeptide of the present invention, in particular a polypeptide having above mentioned activity, e.g. as that polypeptides depicted by the sequence shown in table II, columns 5 and 7 or the functional homologues. Advantageously, the nucleic acid molecule of the invention comprises, or in an other embodiment has, a nucleotide sequence encoding a protein comprising, or in an other embodiment having, an amino acid sequence shown in table II, columns 5 and 7 or the functional homologues. In a still further embodiment, the nucleic acid molecule of the invention encodes a full length protein which is substantially homologous to an amino acid sequence shown in table II, columns 5 and 7 or the functional homologues. However, in one embodiment, the nucleic acid molecule of the present invention does not consist of the sequence shown in table I, preferably table IA, columns 5 and 7.

In addition, it will be appreciated by those skilled in the art that DNA sequence polymorphisms that lead to changes in the amino acid sequences may exist within a population. Such genetic polymorphism in the gene encoding the polypeptide of the invention or comprising the nucleic acid molecule of the invention may exist among individuals within a population due to natural variation.

As used herein, the terms "gene" and "recombinant gene" refer to nucleic acid molecules comprising an open reading frame encoding the polypeptide of the invention or comprising the nucleic acid molecule of the invention or encoding the polypeptide used in the process of the present invention, preferably from a crop plant or from a microorgansim useful for the method of the invention. Such natural variations can typically result in 1 to 5% variance in the nucleotide sequence of the gene. Any and all such nucleotide variations and resulting amino acid polymorphisms in genes encoding a polypeptide of the invention or comprising a the nucleic acid molecule of the invention that are the result of natural variation and that do not alter the functional activity as described are intended to be within the scope of the invention.

Nucleic acid molecules corresponding to natural variants homologues of a nucleic acid molecule of the invention, which can also be a cDNA, can be isolated based on their homology to the nucleic acid molecules disclosed herein using the nucleic acid molecule of the invention, or a portion thereof, as a hybridization probe according to standard hybridization techniques under stringent hybridization conditions.

Accordingly, in another embodiment, a nucleic acid molecule of the invention is at least 15, 20, 25 or 30 nucleotides in length. Preferably, it hybridizes under stringent conditions to a nucleic acid molecule comprising a nucleotide sequence of the nucleic acid molecule of the present invention or used in the process of the present invention, e.g. comprising the sequence shown in table I, columns 5 and 7. The nucleic acid molecule is preferably at least 20, 30, 50, 100, 250 or more nucleotides in length.

The term "hybridizes under stringent conditions" is defined above. In one embodiment, the term "hybridizes under stringent conditions" is intended to describe conditions for hybridization and washing under which nucleotide sequences at least 30%, 40%, 50% or 65% identical to each other typically remain hybridized to each other. Preferably, the conditions are such that sequences at least about 70%, more preferably at least about 75% or 80%, and even more preferably at least about 85%, 90% or 95% or more identical to each other typically remain hybridized to each other.

Preferably, nucleic acid molecule of the invention that hybridizes under stringent conditions to a sequence shown in table I, columns 5 and 7 corresponds to a naturally-occurring nucleic acid molecule of the invention. As used herein, a "naturally-occurring" nucleic acid molecule refers to an RNA or DNA molecule having a nucleotide sequence that occurs in nature (e.g., encodes a natural protein). Preferably, the nucleic acid molecule encodes a natural protein having above-mentioned activity, e.g. conferring increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait after increasing the expression or activity thereof or the activity of a protein of the invention or used in the process of the invention by for example expression the nucleic acid sequence of the gene product in the cytsol and/or in an organelle such as a plastid or mitochondria, preferably in plastids.

In addition to naturally-occurring variants of the sequences of the polypeptide or nucleic acid molecule of the invention as well as of the polypeptide or nucleic acid molecule used in the process of the invention that may exist in the population, the skilled artisan will further appreciate that changes can be introduced by mutation into a nucleotide sequence of the nucleic acid molecule encoding the polypeptide of the invention or used in the process of the present invention, thereby leading to changes in the amino acid sequence of the encoded said polypeptide, without altering the functional ability of the polypeptide, preferably not decreasing said activity.

For example, nucleotide substitutions leading to amino acid substitutions at "non-essential" amino acid residues can be made in a sequence of the nucleic acid molecule of the invention or used in the process of the invention, e.g. shown in table I, columns 5 and 7.

A "non-essential" amino acid residue is a residue that can be altered from the wild-type sequence of one without altering the activity of said polypeptide, whereas an "essential" amino acid residue is required for an activity as mentioned above, e.g. leading to increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait as compared to a corresponding, e.g. non-transformed, wild type plant cell, plant or part thereof in an organism after an increase of activity of the polypeptide. Other amino acid residues, however, (e.g., those that are not conserved or only semi-conserved in the domain having said activity) may not be essential for activity and thus are likely to be amenable to alteration without altering said activity.

Further, a person skilled in the art knows that the codon usage between organisms can differ. Therefore, he may adapt the codon usage in the nucleic acid molecule of the present invention to the usage of the organism or the cell compartment for example of the plastid or mitochondria in which the polynucleotide or polypeptide is expressed.

Accordingly, the invention relates to nucleic acid molecules encoding a polypeptide having above-mentioned activity, in an organisms or parts thereof by for example expression either in the cytsol or in an organelle such as a plastid or mitochondria or both, preferably in plastids that contain changes in amino acid residues that are not essential for said activity. Such polypeptides differ in amino acid sequence from a sequence contained in the sequences shown in table II, columns 5 and 7 yet retain said activity described herein. The nucleic acid molecule can comprise a nucleotide sequence encoding a polypeptide, wherein the polypeptide comprises an amino acid sequence at least about 50% identical to an amino acid sequence shown in table II, columns 5 and 7 and is capable of participation in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait as compared to a corresponding, e.g. non-transformed, wild type plant cell, plant or part thereof after increasing its activity, e.g. its expression by for example expression either in the cytsol or in an organelle such as a plastid or mitochondria or both, preferably in plastids. Preferably, the protein encoded by the nucleic acid molecule is at least about 60% identical to the sequence shown in table II, columns 5 and 7, more preferably at least about 70% identical to one of the sequences shown in table II, columns 5 and 7, even more preferably at least about 80%, 90%, 95% homologous to the sequence shown in table II, columns 5 and 7, and most preferably at least about 96%, 97%, 98%, or 99% identical to the sequence shown in table II, columns 5 and 7.

To determine the percentage homology (=identity, herein used interchangeably) of two amino acid sequences or of two nucleic acid molecules, the sequences are written one underneath the other for an optimal comparison (for example gaps may be inserted into the sequence of a protein or of a nucleic acid in order to generate an optimal alignment with the other protein or the other nucleic acid).

The amino acid residues or nucleic acid molecules at the corresponding amino acid positions or nucleotide positions are then compared. If a position in one sequence is occupied by the same amino acid residue or the same nucleic acid molecule as the corresponding position in the other sequence, the molecules are homologous at this position (i.e. amino acid or nucleic acid "homology" as used in the present context corresponds to amino acid or nucleic acid "identity". The percentage homology between the two sequences is a function of the number of identical positions shared by the sequences (i.e. % homology=number of identical positions/total number of positions×100). The terms "homology" and "identity" are thus to be considered as synonyms.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman, PNAS 85, 2444(1988); W. R. Pearson, Methods in Enzymology 183, 63 (1990); W. R. Pearson and D. J. Lipman, PNAS 85, 2444 (1988); W. R. Pearson, Enzymology 183, 63 (1990)). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the query. Nevertheless as this program is very efficient it can be used for the comparison of a huge number of sequences. The following settings are typically used for such a comparisons of sequences: -p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=−3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perfom gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351 (1987), Higgins et al., CABIOS 5, 151 (1989)) or preferably with the programs "Gap" and "Needle", which are both based on the algorithms of Needleman and Wunsch (J. Mol. Biol. 48; 443 (1970)), and "BestFit", which is based on the algorithm of Smith and Waterman (Adv. Appl. Math. 2; 482 (1981)). "Gap" and "BestFit" are part of the GCG software-package (Genetics Computer Group, 575 Science Drive, Madison, Wis., USA 53711 (1991); Altschul et al., (Nucleic Acids Res. 25, 3389 (1997)), "Needle" is part of the The European Molecular Biology Open Software Suite (EMBOSS) (Trends in Genetics 16 (6), 276 (2000)). Therefore preferably the calculations to determine the percentages of sequence homology are done with the programs "Gap" or "Needle" over the whole range of the sequences. The following standard adjustments for the comparison of nucleic acid sequences were used for "Needle": matrix: EDNAFULL, Gap_penalty: 10.0, Extend_penalty: 0.5. The following standard adjustments for the comparison of nucleic acid sequences were used for "Gap": gap weight: 50, length weight: 3, average match: 10.000, average mismatch: 0.000.

For example a sequence, which has 80% homology with sequence SEQ ID NO: 38 at the nucleic acid level is understood as meaning a sequence which, upon comparison with the sequence SEQ ID NO: 38 by the above program "Needle" with the above parameter set, has a 80% homology.

Homology between two polypeptides is understood as meaning the identity of the amino acid sequence over in each case the entire sequence length which is calculated by comparison with the aid of the above program "Needle" using Matrix: EBLOSUM62, Gap_penalty: 8.0, Extend_penalty: 2.0.

For example a sequence which has a 80% homology with sequence SEQ ID NO: 39 at the protein level is understood as meaning a sequence which, upon comparison with the sequence SEQ ID NO: 39 by the above program "Needle" with the above parameter set, has a 80% homology.

Functional equivalents derived from the nucleic acid sequence as shown in table I, columns 5 and 7 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, columns 5 and 7 according to the invention and encode polypeptides having essentially the same properties as the polypeptide as shown in table II, columns 5 and 7. Functional equivalents derived from one of the polypeptides as shown in table II, columns 5 and 7 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in table II, columns 5 and 7 according to the invention and having essentially the same properties as the polypeptide as shown in table II, columns 5 and 7.

"Essentially the same properties" of a functional equivalent is above all understood as meaning that the functional equivalent has above mentioned acitivty, by for example expression either in the cytsol or in an organelle such as a plastid or mitochondria or both, preferably in plastids while increasing the amount of protein, activity or function of said functional equivalent in an organism, e.g. a microorgansim, a plant or plant tissue or animal tissue, plant or animal cells or a part of the same.

A nucleic acid molecule encoding an homologous to a protein sequence of table II, columns 5 and 7 can be created by introducing one or more nucleotide substitutions, additions or deletions into a nucleotide sequence of the nucleic acid molecule of the present invention, in particular of table I, columns 5 and 7 such that one or more amino acid substitutions, additions or deletions are introduced into the encoded protein. Mutations can be introduced into the encoding sequences of table I, columns 5 and 7 by standard techniques, such as site-directed mutagenesis and PCR-mediated mutagenesis.

Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophane), beta-branched side chains (e.g., threonine, valine, isoleucine) and aromatic side chains (e.g., tyrosine, phenylalanine, tryptophane, histidine).

Thus, a predicted nonessential amino acid residue in a polypeptide of the invention or a polypeptide used in the process of the invention is preferably replaced with another amino acid residue from the same family. Alternatively, in another embodiment, mutations can be introduced randomly along all or part of a coding sequence of a nucleic acid molecule of the invention or used in the process of the invention, such as by saturation mutagenesis, and the resultant mutants can be screened for activity described herein to identify mutants that retain or even have increased above mentioned activity, e.g. conferring increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof.

Following mutagenesis of one of the sequences as shown herein, the encoded protein can be expressed recombinantly and the activity of the protein can be determined using, for example, assays described herein (see Examples).

The highest homology of the nucleic acid molecule used in the process according to the invention was found for the following database entries by Gap search.

Homologues of the nucleic acid sequences used, with the sequence shown in table I, columns 5 and 7, comprise also allelic variants with at least approximately 30%, 35%, 40% or 45% homology, by preference at least approximately 50%, 60% or 70%, more preferably at least approximately 90%, 91%, 92%, 93%, 94% or 95% and even more preferably at least approximately 96%, 97%, 98%, 99% or more homology with one of the nucleotide sequences shown or the abovementioned derived nucleic acid sequences or their homologues, derivatives or analogues or parts of these. Allelic variants encompass in particular functional variants which can be obtained by deletion, insertion or substitution of nucleotides from the sequences shown, preferably from table I, columns 5 and 7, or from the derived nucleic acid sequences, the intention being, however, that the enzyme activity or the biological activity of the resulting proteins synthesized is advantageously retained or increased.

In one embodiment of the present invention, the nucleic acid molecule of the invention or used in the process of the invention comprises the sequences shown in any of the table I, columns 5 and 7. It is preferred that the nucleic acid molecule comprises as little as possible other nucleotides not shown in any one of table I, columns 5 and 7. In one embodiment, the nucleic acid molecule comprises less than 500, 400, 300, 200, 100, 90, 80, 70, 60, 50 or 40 further nucleotides. In a further embodiment, the nucleic acid molecule comprises less than 30, 20 or 10 further nucleotides. In one embodiment, the nucleic acid molecule use in the process of the invention is identical to the sequences shown in table I, columns 5 and 7.

Also preferred is that the nucleic acid molecule used in the process of the invention encodes a polypeptide comprising the sequence shown in table II, columns 5 and 7. In one embodiment, the nucleic acid molecule encodes less than 150, 130, 100, 80, 60, 50, 40 or 30 further amino acids. In a further embodiment, the encoded polypeptide comprises less than 20, 15, 10, 9, 8, 7, 6 or 5 further amino acids. In one embodiment used in the inventive process, the encoded polypeptide is identical to the sequences shown in table II, columns 5 and 7.

In one embodiment, the nucleic acid molecule of the invention or used in the process encodes a polypeptide comprising the sequence shown in table II, columns 5 and 7 comprises less than 100 further nucleotides. In a further embodiment, said nucleic acid molecule comprises less than 30 further nucleotides. In one embodiment, the nucleic acid molecule used in the process is identical to a coding sequence of the sequences shown in table I, columns 5 and 7.

Polypeptides (=proteins), which still have the essential biological or enzymatic activity of the polypeptide of the present invention conferring increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, plant or part thereof i.e. whose activity is essentially not reduced, are polypeptides with at least 10% or 20%, by preference 30% or 40%, especially preferably 50% or 60%, very especially preferably 80% or 90 or more of the wild type biological activity or enzyme activity, advantageously, the activity is essentially not reduced in comparison with the activity of a polypeptide shown in table II, columns 5 and 7 expressed under identical conditions.

Homologues of table I, columns 5 and 7 or of the derived sequences of table II, columns 5 and 7 also mean truncated sequences, cDNA, single-stranded DNA or RNA of the coding and noncoding DNA sequence. Homologues of said sequences are also understood as meaning derivatives, which comprise noncoding regions such as, for example, UTRs, terminators, enhancers or promoter variants. The promoters upstream of the nucleotide sequences stated can be modified by one or more nucleotide substitution(s), insertion(s) and/or deletion(s) without, however, interfering with the functionality or activity either of the promoters, the open reading frame (=ORF) or with the 3'-regulatory region such as terminators or other 3'-regulatory regions, which are far away from the ORF. It is furthermore possible that the activity of the promoters is increased by modification of their sequence, or that they are replaced completely by more active promoters, even promoters from heterologous organisms. Appropriate promoters are known to the person skilled in the art and are mentioned herein below.

In addition to the nucleic acid molecules encoding the LTRRP or YRPs described above, another aspect of the invention pertains to negative regulators of the activity of a nucleic acid molecules selected from the group according to table I, column 5 and/or 7, preferably column 7. Antisense polynucleotides thereto are thought to inhibit the downregulating activity of those negative regulators by specifically binding the target polynucleotide and interfering with transcription, splicing, transport, translation, and/or stability of the target polynucleotide. Methods are described in the prior art for targeting the antisense polynucleotide to the chromosomal DNA, to a primary RNA transcript, or to a processed mRNA. Preferably, the target regions include splice sites, translation initiation codons, translation termination codons, and other sequences within the open reading frame.

The term "antisense," for the purposes of the invention, refers to a nucleic acid comprising a polynucleotide that is sufficiently complementary to all or a portion of a gene, primary transcript, or processed mRNA, so as to interfere with expression of the endogenous gene. "Complementary" polynucleotides are those that are capable of base pairing according to the standard Watson-Crick complementarity rules. bpecifically, purines will base pair with pyrimidines to form a combination of guanine paired with cytosine (G:C) and adenine paired with either thymine (A:T) in the case of DNA, or adenine paired with uracil (A:U) in the case of RNA. It is understood that two polynucleotides may hybridize to each other even if they are not completely complementary to each other, provided that each has at least one region that is substantially complementary to the other. The term "antisense nucleic acid" includes single stranded RNA as well as double-stranded DNA expression cassettes that can be transcribed to produce an antisense RNA. "Active" antisense nucleic acids are antisense RNA molecules that are capable of selectively hybridizing with a negative regulator of the activity of a nucleic acid molecules encoding a polypeptide having at least 80% sequence identity with the polypeptide selected from the group according to table II, column 5 and/or 7, preferably column 7.

The antisense nucleic acid can be complementary to an entire negative regulator strand, or to only a portion thereof. In an embodiment, the antisense nucleic acid molecule is antisense to a "noncoding region" of the coding strand of a nucleotide sequence encoding a LTRRP or YRP. The term "noncoding region" refers to 5' and 3' sequences that flank the coding region that are not translated into amino acids (i.e., also referred to as 5' and 3' untranslated regions). The antisense nucleic acid molecule can be complementary to only a portion of the noncoding region of LTRRP or YRP mRNA. For example, the antisense oligonucleotide can be complementary to the region surrounding the translation start site of LTRRP or YRP mRNA. An antisense oligonucleotide can be, for example, about 5, 10, 15, 20, 25, 30, 35, 40, 45 or 50 nucleotides in length. Typically, the antisense molecules of the present invention comprise an RNA having 60-100% sequence identity with at least 14 consecutive nucleotides of a noncoding region of one of the nucleic acid of table I. Preferably, the sequence identity will be at least 70%, more preferably at least 75%, 80%, 85%, 90%, 95%, 98% and most preferably 99%.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl)-uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, 5-methyl-2-thiouracil, 3-(3-amino-3-N-2-carboxypropyl)-uracil, acp3 and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

In yet another embodiment, the antisense nucleic acid molecule of the invention is an alpha-anomeric nucleic acid molecule. An alpha-anomeric nucleic acid molecule forms specific double-stranded hybrids with complementary RNA in which, contrary to the usual b-units, the strands run parallel to each other (Gaultier et al., Nucleic Acids. Res. 15, 6625 (1987)). The antisense nucleic acid molecule can also comprise a 2'-o-methylribonucleotide (Inoue et al., Nucleic Acids Res. 15, 6131 (1987)) or a chimeric RNA-DNA analogue (Inoue et al., FEBS Lett. 215, 327 (1987)).

The antisense nucleic acid molecules of the invention are typically administered to a cell or generated in situ such that they hybridize with or bind to cellular mRNA and/or genomic DNA. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic (including plant) promoter are preferred.

As an alternative to antisense polynucleotides, ribozymes, sense polynucleotides, or double stranded RNA (dsRNA) can be used to reduce expression of a LTRRP or YRP polypeptide. By "ribozyme" is meant a catalytic RNA-based enzyme with ribonuclease activity which is capable of cleaving a single-stranded nucleic acid, such as an mRNA, to which it has a complementary region. Ribozymes (e.g., hammerhead ribozymes described in Haselhoff and Gerlach, Nature 334, 585 (1988)) can be used to catalytically cleave LTRRP or YRP mRNA transcripts to thereby inhibit translation of LTRRP or YRP mRNA. A ribozyme having specificity for a LTRRP or YRP-encoding nucleic acid can be designed based upon the nucleotide sequence of a LTRRP or YRP cDNA, as disclosed herein or on the basis of a heterologous sequence to be isolated according to methods taught in this invention. For example, a derivative of a Tetrahymena L-19 IVS RNA can be constructed in which the nucleotide sequence of the active site is complementary to the nucleotide sequence to be cleaved in a LTRRP or YRP-encoding mRNA. See, e.g. U.S. Pat. Nos. 4,987,071 and 5,116,742 to Cech et al. Alternatively, LTRRP or YRP mRNA can be used to select a catalytic RNA having a specific ribonuclease activity from a pool of RNA molecules. See, e.g. Bartel D., and Szostak J. W., Science 261, 1411 (1993). In preferred embodiments, the ribozyme will contain a portion having at least 7, 8, 9, 10, 12, 14, 16, 18 or 20 nucleotides, and more preferably 7 or 8 nucleotides, that have 100% complementarity to a portion of the target RNA. Methods for making ribozymes are known to those skilled in the art. See, e.g. U.S. Pat. Nos. 6,025,167, 5,773,260 and 5,496,698.

The term "dsRNA," as used herein, refers to RNA hybrids comprising two strands of RNA. The dsRNAs can be linear or circular in structure. In a preferred embodiment, dsRNA is specific for a polynucleotide encoding either the polypeptide according to table II or a polypeptide having at least 70% sequence identity with a polypeptide according to table II. The hybridizing RNAs may be substantially or completely complementary. By "substantially complementary," is meant that when the two hybridizing RNAs are optimally aligned using the BLAST program as described above, the hybridizing portions are at least 95% complementary. Preferably, the dsRNA will be at least 100 base pairs in length. Typically, the hybridizing RNAs will be of identical length with no over hanging 5' or 3' ends and no gaps. However, dsRNAs having 5' or 3' overhangs of up to 100 nucleotides may be used in the methods of the invention.

The dsRNA may comprise ribonucleotides or ribonucleotide analogs, such as 2'-O-methyl ribosyl residues, or combinations thereof. See, e.g. U.S. Pat. Nos. 4,130,641 and 4,024,222. A dsRNA polyriboinosinic acid:polyribocytidylic acid is described in U.S. Pat. No. 4,283,393. Methods for making and using dsRNA are known in the art. One method comprises the simultaneous transcription of two complementary DNA strands, either in vivo, or in a single in vitro reaction mixture. See, e.g. U.S. Pat. No. 5,795,715. In one embodiment, dsRNA can be introduced into a plant or plant cell directly by standard transformation procedures. Alternatively, dsRNA can be expressed in a plant cell by transcribing two complementary RNAs.

Other methods for the inhibition of endogenous gene expression, such as triple helix formation (Moser et al., Science 238, 645 (1987), and Cooney et al., Science 241, 456 (1988)) and co-suppression (Napoli et al., The Plant Cell 2,279, 1990,) are known in the art. Partial and full-length cDNAs have been used for the c-o-suppression of endogenous plant genes. See, e.g. U.S. Pat. Nos. 4,801,340, 5,034, 323, 5,231,020, and 5,283,184; Van der Kroll et al., The Plant Cell 2, 291, (1990); Smith et al., Mol. Gen. Genetics 224, 477 (1990), and Napoli et al., The Plant Cell 2, 279 (1990).

For sense suppression, it is believed that introduction of a sense polynucleotide blocks transcription of the corresponding target gene. The sense polynucleotide will have at least 65% sequence identity with the target plant gene or RNA. Preferably, the percent identity is at least 80%, 90%, 95% or more. The introduced sense polynucleotide need not be full length relative to the target gene or transcript. Preferably, the sense polynucleotide will have at least 65% sequence identity with at least 100 consecutive nucleotides of one of the nucleic acids as depicted in table I, application no. 1. The regions of identity can comprise introns and and/or exons and untranslated regions. The introduced sense polynucleotide may be present in the plant cell transiently, or may be stably integrated into a plant chromosome or extra-chromosomal replicon.

Further, object of the invention is an expression vector comprising a nucleic acid molecule comprising a nucleic acid molecule selected from the group consisting of:

(a) a nucleic acid molecule encoding the polypeptide shown in column 5 or 7 of table II, application no. 1;
(b) a nucleic acid molecule shown in column 5 or 7 of table I, application no. 1;
(c) a nucleic acid molecule, which, as a result of the degeneracy of the genetic code, can be derived from a polypeptide sequence depicted in column 5 or 7 of table II, and confers an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(d) a nucleic acid molecule having at least 30% identity, preferably at least 40%, 50%, 60%, 70%, 75%, 80%, 85%, 90%, 95%, 96%, 97%, 98%, 99%, 99.5% with the nucleic acid molecule sequence of a polynucleotide comprising the nucleic acid molecule shown in column 5 or 7 of table I, and confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(e) a nucleic acid molecule encoding a polypeptide having at least 30% identity, preferably at least 40%, 50%, 60%, 70%, 75%, 80%, 85%, 90%, 95%, 96%, 97%, 98%, 99%, 99.5%, with the amino acid sequence of the polypeptide encoded by the nucleic acid molecule of (a), (b), (c) or (d) and having the activity represented by a nucleic acid molecule comprising a polynucleotide as depicted in column 5 of table I, and confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(f) nucleic acid molecule which hybridizes with a nucleic acid molecule of (a), (b), (c), (d) or (e) under stringent hybridization conditions and confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(g) a nucleic acid molecule encoding a polypeptide which can be isolated with the aid of monoclonal or polyclonal antibodies made against a polypeptide encoded by one of the nucleic acid molecules of (a), (b), (c), (d), (e) or (f) and having the activity represented by the nucleic acid molecule comprising a polynucleotide as depicted in column 5 of table I, application no. 1;
(h) a nucleic acid molecule encoding a polypeptide comprising the consensus sequence or one or more polypeptide motifs as shown in column 7 of table IV, and preferably having the activity represented by a protein comprising a polypeptide as depicted in column 5 of table II or IV, application no. 1;
(i) a nucleic acid molecule encoding a polypeptide having the activity represented by a protein as depicted in column 5 of table II, and confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof;
(j) nucleic acid molecule which comprises a polynucleotide, which is obtained by amplifying a cDNA library or a genomic library using the primers in column 7 of table III, and for example having the activity represented by a protein comprising a polypeptide as depicted in column 5 of table II or IV, application no. 1; and
(k) a nucleic acid molecule which is obtainable by screening a suitable nucleic acid library, especially a cDNA library and/or a genomic library, under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt, 500 nt, 750 or 1000 nt of a nucleic acid molecule complementary to a nucleic acid molecule sequence characterized in (a) to (e) and encoding a polypeptide having the activity represented by a protein comprising a polypeptide as depicted in column 5 of table II, application no. 1.

The invention further provides an isolated recombinant expression vector comprising a LTRRP or YRP encoding nucleic acid as described above, wherein expression of the vector or LTRRP or YRP encoding nucleic acid, respectively in a host cell results in an increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to the corresponding, e.g. non-transformed, wild type of the host cell. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Further types of vectors can be linearized nucleic acid sequences, such as transposons, which are pieces of DNA which can copy and insert themselves. There have been 2 types of transposons found: simple transposons, known as Insertion Sequences and composite transposons, which can have several genes as well as the genes that are required for transposition. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

A plant expression cassette preferably contains regulatory sequences capable of driving gene expression in plant cells and operably linked so that each sequence can fulfill its function, for example, termination of transcription by polyadenylation signals. Preferred polyadenylation signals are those originating from *Agrobacterium tumefaciens* T-DNA such as the gene 3 known as octopine synthase of the Ti-plasmid pTiACH5 (Gielen et al., EMBO J. 3, 835 1(984)) or functional equivalents thereof but also all other terminators functionally active in plants are suitable. As plant gene expression is very often not limited on transcriptional levels, a plant expression cassette preferably contains other operably linked sequences like translational enhancers such as the overdrive-sequence containing the 5'-untranslated leader sequence from tobacco mosaic virus enhancing the protein per RNA ratio (Gallie et al., Nucl. Acids Research 15, 8693 (1987)).

Plant gene expression has to be operably linked to an appropriate promoter conferring gene expression in a timely, cell or tissue specific manner. Preferred are promoters driving constitutive expression (Benfey et al., EMBO J. 8, 2195 (1989)) like those derived from plant viruses like the 35S CaMV (Franck et al., Cell 21, 285 (1980)), the 19S CaMV (see also U.S. Pat. No. 5,352,605 and PCT Application No. WO 84/02913) or plant promoters like those from Rubisco small subunit described in U.S. Pat. No. 4,962,028.

Additional advantageous regulatory sequences are, for example, included in the plant promoters such as CaMV/35S (Franck et al., Cell 21 285 (1980)), PRP1 (Ward et al., Plant. Mol. Biol. 22, 361 (1993)), SSU, OCS, lib4, usp, STLS1, B33, LEB4, nos, ubiquitin, napin or phaseolin promoter. Also advantageous in this connection are inducible promoters such as the promoters described in EP 388 186 (benzyl sulfonamide inducible), Gatz et al., Plant J. 2, 397 (1992) (tetracyclin inducible), EP-A-0 335 528 (abscisic acid inducible) or WO 93/21334 (ethanol or cyclohexenol inducible). Additional useful plant promoters are the cytoplasmic FBPase promotor or ST-LSI promoter of potato (Stockhaus et al., EMBO J. 8, 2445 (1989)), the phosphorybosyl phyrophoshate amido transferase promoter of *Glycine max* (gene bank accession No. U87999) or the noden specific promoter described in EP-A-0 249 676. Additional particularly advantageous promoters are seed specific promoters which can be used for monocotyledones or dicotyledones and are described in U.S. Pat. No. 5,608,152 (napin promoter from rapeseed), WO 98/45461 (phaseolin promoter from *Arabidopsis*), U.S. Pat. No. 5,504,200 (phaseolin promoter from *Phaseolus vulgaris*), WO 91/13980 (Bce4 promoter from *Brassica*) and Baeumlein et al., Plant J., 2 (2), 233 (1992) (LEB4 promoter from leguminosa). Said promoters are useful in dicotyledones. The following promoters are useful for example in monocotyledones Ipt-2- or Ipt-1-promoter from barley (WO 95/15389 and WO 95/23230) or hordein promoter from barley. Other useful promoters are described in WO 99/16890. It is possible in principle to use all natural promoters with their regulatory sequences like those mentioned above for the novel process. It is also possible and advantageous in addition to use synthetic promoters.

The gene construct may also comprise further genes which are to be inserted into the organisms and which are for example involved in stress tolerance and yield increase. It is possible and advantageous to insert and express in host organisms regulatory genes such as genes for inducers, repressors or enzymes which intervene by their enzymatic activity in the regulation, or one or more or all genes of a biosynthetic pathway. These genes can be heterologous or homologous in origin. The inserted genes may have their own promoter or else be under the control of same promoter as the sequences of the nucleic acid of table I or their homologs.

The gene construct advantageously comprises, for expression of the other genes present, additionally 3' and/or 5' terminal regulatory sequences to enhance expression, which are selected for optimal expression depending on the selected host organism and gene or genes.

These regulatory sequences are intended to make specific expression of the genes and protein expression possible as mentioned above. This may mean, depending on the host organism, for example that the gene is expressed or over-expressed only after induction, or that it is immediately expressed and/or over-expressed.

The regulatory sequences or factors may moreover preferably have a beneficial effect on expression of the introduced genes, and thus increase it. It is possible in this way for the regulatory elements to be enhanced advantageously at the transcription level by using strong transcription signals such as promoters and/or enhancers. However, in addition, it is also possible to enhance translation by, for example, improving the stability of the mRNA.

Other preferred sequences for use in plant gene expression cassettes are targeting-sequences necessary to direct the gene product in its appropriate cell compartment (for review see Kermode, Crit. Rev. Plant Sci. 15 (4), 285 (1996) and references cited therein) such as the vacuole, the nucleus, all types of plastids like amyloplasts, chloroplasts, chromoplasts, the extracellular space, mitochondria, the endoplasmic reticulum, oil bodies, peroxisomes and other compartments of plant cells.

Plant gene expression can also be facilitated via an inducible promoter (for review see Gatz, Annu. Rev. Plant Physiol. Plant Mol. Biol. 48, 89(1997)). Chemically inducible promoters are especially suitable if gene expression is wanted to occur in a time specific manner.

Table VI lists several examples of promoters that may be used to regulate transcription of the nucleic acid coding sequences of the present invention.

TABLE VI

Examples of tissue-specific and inducible promoters in plants

| Expression | Reference |
|---|---|
| Cor78-Cold, drought, salt, ABA, wounding-inducible | Ishitani, et al., Plant Cell 9, 1935 (1997), Yamaguchi-Shinozaki and Shinozaki, Plant Cell 6, 251 (1994) |
| Rci2A-Cold, dehydration-inducible | Capel et al., Plant Physiol 115, 569 (1997) |
| Rd22-Drought, salt | Yamaguchi-Shinozaki and Shinozaki, Mol. Gen. Genet. 238, 17 (1993) |
| Cor15A-Cold, dehydration, ABA | Baker et al., Plant Mol. Biol. 24, 701 (1994) |
| GH3-Auxin inducible | Liu et al., Plant Cell 6, 645 (1994) |
| ARSK1-Root, salt inducible | Hwang and Goodman, Plant J. 8, 37 (1995) |
| PtxA-Root, salt inducible | GenBank accession X67427 |
| SbHRGP3-Root specific | Ahn et al., Plant Cell 8, 1477 (1998). |
| KST1-Guard cell specific | Plesch et al., Plant Journal. 28(4), 455-(2001) |
| KAT1-Guard cell specific | Plesch et al., Gene 249, 83 (2000), Nakamura et al., Plant Physiol. 109, 371 (1995) |
| salicylic acid inducible | PCT Application No. WO 95/19443 |
| tetracycline inducible | Gatz et al., Plant J. 2, 397 (1992) |
| Ethanol inducible | PCT Application No. WO 93/21334 |
| Pathogen inducible PRP1 | Ward et al., Plant. Mol. Biol. 22, 361-(1993) |
| Heat inducible hsp80 | U.S. Pat. No. 5,187,267 |
| Cold inducible alpha-amylase | PCT Application No. WO 96/12814 |
| Wound-inducible pinII | European Patent No. 375 091 |
| RD29A-salt-inducible | Yamaguchi-Shinozalei et al. Mol. Gen. Genet. 236, 331 (1993) |
| Plastid-specific viral RNA-polymerase | PCT Application No. WO 95/16783, PCT Application WO 97/06250 |

Other promoters, e.g. super-promoter (Ni et al., Plant Journal 7, 661 (1995)), Ubiquitin promoter (Callis et al., J. Biol. Chem., 265, 12486 (1990); U.S. Pat. No. 5,510,474; U.S. Pat. No. 6,020,190; Kawalleck et al., Plant. Molecular Biology, 21, 673 (1993)) or 34S promoter (GenBank Accession numbers M59930 and X16673) were similar useful for the present invention and are known to a person skilled in the art. Developmental stage-preferred promoters are preferentially expressed at certain stages of development. Tissue and organ preferred promoters include those that are preferentially expressed in certain tissues or organs, such as leaves, roots, seeds, or xylem. Examples of tissue preferred and organ preferred promoters include, but are not limited to fruit-preferred, ovule-preferred, male tissue-preferred, seed-preferred, integument-preferred, tuber-preferred, stalk-preferred, pericarp-preferred, and leaf-preferred, stigma-preferred, pollen-preferred, anther-preferred, a petal-preferred, sepal-preferred, pedicel-preferred, silique-preferred, stem-preferred, root-preferred promoters, and the like. Seed preferred promoters are preferentially expressed during seed development and/or germination. For example, seed preferred promoters can be embryo-preferred, endosperm preferred, and seed coat-preferred. See Thompson et al., BioEssays 10, 108 (1989). Examples of seed preferred promoters include, but are not limited to, cellulose synthase (celA), Cim1, gamma-zein, globulin-1, maize 19 kD zein (cZ19B1), and the like.

Other promoters useful in the expression cassettes of the invention include, but are not limited to, the major chlorophyll a/b binding protein promoter, histone promoters, the Ap3 promoter, the β-conglycin promoter, the napin promoter, the soybean lectin promoter, the maize 15 kD zein promoter, the 22 kD zein promoter, the 27 kD zein promoter, the g-zein promoter, the waxy, shrunken 1, shrunken 2 and bronze promoters, the Zm13 promoter (U.S. Pat. No. 5,086,169), the maize polygalacturonase promoters (PG) (U.S. Pat. Nos. 5,412,085 and 5,545,546), and the SGB6 promoter (U.S. Pat. No. 5,470,359), as well as synthetic or other natural promoters.

Additional flexibility in controlling heterologous gene expression in plants may be obtained by using DNA binding domains and response elements from heterologous sources (i.e., DNA binding domains from non-plant sources). An example of such a heterologous DNA binding domain is the LexA DNA binding domain (Brent and Ptashne, Cell 43, 729 (1985)).

The invention further provides a recombinant expression vector comprising a LTRRP or YRP DNA molecule of the invention cloned into the expression vector in an antisense orientation. That is, the DNA molecule is operatively linked to a regulatory sequence in a manner that allows for expression (by transcription of the DNA molecule) of an RNA molecule that is antisense to a LTRRP or YRP mRNA. Regulatory sequences operatively linked to a nucleic acid molecule cloned in the antisense orientation can be chosen which direct the continuous expression of the antisense RNA molecule in a variety of cell types. For instance, viral promoters and/or enhancers, or regulatory sequences can be chosen which direct constitutive, tissue specific, or cell type specific expression of antisense RNA. The antisense expression vector can be in the form of a recombinant plasmid, phagemid, or attenuated virus wherein antisense nucleic acids are produced under the control of a high efficiency regulatory region. The activity of the regulatory region can be determined by the cell type into which the vector is introduced. For a discussion of the regulation of gene expression using antisense genes, see Weintraub H. et al., Reviews—Trends in Genetics, Vol. 1(1), 23 (1986) and Mol et al., FEBS Letters 268, 427 (1990).

Another aspect of the invention pertains to isolated LTRRP or YRPs, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of LTRRP or YRP in which the polypeptide is separated from some of the cellular components of the cells in which it is naturally or recombinantly produced. In one embodiment, the language "substantially free of cellular material" includes preparations of a LTRRP or YRP having less than about 30% (by dry weight) of non-LTRRP or YRP material (also referred to herein as a "contaminating polypeptide"), more preferably less than about 20% of non-LTRRP or YRP material, still more preferably less than about 10% of non-LTRRP or YRP material, and most preferably less than about 5% non-LTRRP or YRP material.

When the LTRRP or YRP or biologically active portion thereof is recombinantly produced, it is also preferably substantially free of culture medium, i.e., culture medium represents less than about 20%, more preferably less than about 10%, and most preferably less than about 5% of the volume of the polypeptide preparation. The language "substantially free of chemical precursors or other chemicals" includes preparations of LTRRP or YRP in which the polypeptide is separated from chemical precursors or other chemicals that are involved in the synthesis of the polypeptide. In one embodiment, the language "substantially free of chemical precursors or other chemicals" includes preparations of a LTRRP or YRP having less than about 30% (by dry weight) of chemical precursors or non-LTRRP or YRP chemicals, more preferably less than about 20% chemical precursors or non-LTRRP or YRP chemicals, still more preferably less than about 10% chemical precursors or non-LTRRP or YRP chemicals, and most preferably less than about 5% chemical precursors or non-LTRRP or YRP chemicals. In preferred embodiments, isolated polypeptides, or biologically active portions thereof, lack contaminating polypeptides from the same organism from which the LTRRP or YRP is derived. Typically, such polypeptides are produced by recombinant expression of, for example, a *S. cerevisiae, E. coli* or *A. thaliana, Brassica napus, Glycine max, Zea mays* or *Oryza sativa*, LTRRP or YRP, in an microorganism like *S. cerevisiae, E. coli, C. glutamicum*, ciliates, algae, fungi or plants, provided that the polypeptide is recombinant expressed in an organism being different to the original organism.

The nucleic acid molecules, polypeptides, polypeptide homologs, fusion polypeptides, primers, vectors, and host cells described herein can be used in one or more of the following methods: identification of *S. cerevisiae, E. coli* or *A. thaliana, Brassica napus, Glycine max, Zea mays* or *Oryza sativa*, and related organisms; mapping of genomes of organisms related to *S. cerevisiae, E. coli*; identification and localization of *S. cerevisiae, E. coli* or *A. thaliana, Brassica napus, Glycine max, Zea mays* or *Oryza sativa*, sequences of interest; evolutionary studies; determination of LTRRP or YRP regions required for function; modulation of a LTRRP or YRP activity; modulation of the metabolism of one or more cell functions; modulation of the transmembrane transport of one or more compounds; modulation of yield, e.g. of a yield-related trait, e.g. of tolerance to abiotic environmental stress, e.g. to low temperature tolerance, drought tolerance, water use efficiency, nutrient use efficiency and/or intrinsic yield; and modulation of expression of LTRRP or YRP nucleic acids.

The LTRRP or YRP nucleic acid molecules of the invention are also useful for evolutionary and polypeptide structural studies. The metabolic and transport processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the polypeptide that are essential for the functioning of the enzyme. This type of determination is of value for polypeptide engineering studies and may give an indication of what the polypeptide can tolerate in terms of mutagenesis without losing function.

Manipulation of the LTRRP or YRP nucleic acid molecules of the invention may result in the production of SRPs having functional differences from the wild-type LTRRP or YRPs. These polypeptides may be improved in efficiency or activity, may be present in greater numbers in the cell than is usual, or may be decreased in efficiency or activity.

There are a number of mechanisms by which the alteration of a LTRRP or YRP of the invention may directly affect yield, e.g. yield-related trait, for example tolerance to abiotic environmental stress, for example drought tolerance and/or low temperature tolerance, and/or nutrient use efficiency, intrinsic yield and/or another mentioned yield-related trait.

The effect of the genetic modification in plants regarding yield, e.g. yield-related trait, for example tolerance to abiotic environmental stress, for example drought tolerance and/or low temperature tolerance, and/or nutrient use efficiency, intrinsic yield and/or another mentioned yield-related trait can be assessed by growing the modified plant under less than suitable conditions and then analyzing the growth characteristics and/or metabolism of the plant. Such analysis techniques are well known to one skilled in the art, and include dry weight, fresh weight, polypeptide synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, Vol. 17; Rehm et al., 1993 Biotechnology, Vol. 3, Chapter III: Product recovery and purification, page 469-714, VCH: Weinheim; Belter P. A. et al., 1988, Bioseparations: downstream processing for biotechnology, John Wiley and Sons; Kennedy J. F., and Cabral J. M. S., 1992, Recovery processes for biological materials, John Wiley and Sons; Shaeiwitz J. A. and Henry J. D., 1988, Biochemical separations, in Ulmann's Encyclopedia of Industrial Chemistry, Vol. B3, Chapter 11, page 1-27, VCH: Weinheim; and Dechow F. J., 1989, Separation and purification techniques in biotechnology, Noyes Publications).

For example, yeast expression vectors comprising the nucleic acids disclosed herein, or fragments thereof, can be constructed and transformed into *S. cerevisiae* using standard protocols. The resulting transgenic cells can then be assayed for generation or alteration of their yield, e.g. their yield-related traits, for example tolerance to abiotic environmental stress, for example drought tolerance and/or low temperature tolerance, and/or nutrient use efficiency, intrinsic yield and/or another mentioned yield-related trait. Similarly, plant expression vectors comprising the nucleic acids disclosed herein, or fragments thereof, can be constructed and transformed into an appropriate plant cell such as *Arabidopsis*, soy, rape, maize, cotton, rice, wheat, Medicago truncatula, etc., using standard protocols. The resulting transgenic cells and/or plants derived therefrom can then be assayed for generation or alteration of their yield, e.g. their yield-related traits, for example tolerance to abiotic environmental stress, for example drought tolerance and/or low temperature tolerance, and/or nutrient use efficiency, intrinsic yield and/or another mentioned yield-related trait.

The engineering of one or more genes according to table I and coding for the LTRRP or YRP of table II of the invention may also result in LTRRP or YRPs having altered activities which indirectly and/or directly impact the tolerance to abiotic environmental stress of algae, plants, ciliates, fungi, or other microorganisms like *C. glutamicum*.

Additionally, the sequences disclosed herein, or fragments thereof, can be used to generate knockout mutations in the genomes of various organisms, such as bacteria, mammalian cells, yeast cells, and plant cells (Girke, T., The Plant Journal 15, 39(1998)). The resultant knockout cells can then be evaluated for their ability or capacity for increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait, their response to various abiotic environmental stress conditions, and the effect on the phenotype and/or genotype of the mutation. For other methods of gene inactivation, see U.S. Pat. No. 6,004,804 and Puttaraju et al., Nature Biotechnology 17, 246 (1999).

The aforementioned mutagenesis strategies for LTRRP or YRPs resulting in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait are not meant to be limiting; variations on these strategies will be readily apparent to one skilled in the art. Using such strategies, and incorporating the mechanisms disclosed herein, the nucleic acid and polypeptide molecules of the invention may be utilized to generate algae, ciliates, plants, fungi, or other microorganisms like *C. glutamicum* expressing mutated LTRRP or YRP nucleic acid and polypeptide molecules such that the tolerance to abiotic environmental stress and/or yield is improved.

The present invention also provides antibodies that specifically bind to a LTRRP or YRP, or a portion thereof, as encoded by a nucleic acid described herein. Antibodies can be made by many well-known methods (see, e.g. Harlow and Lane, "Antibodies; A Laboratory Manual", Cold Spring Harbor Laboratory, Cold Spring Harbor, N.Y., (1988)). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced. See, for example, Kelly et al., Bio/Technology 10, 163 (1992); Bebbington et al., Bio/Technology 10, 169 (1992).

The phrases "selectively binds" and "specifically binds" with the polypeptide refer to a binding reaction that is determinative of the presence of the polypeptide in a heterogeneous population of polypeptides and other biologics. Thus, under designated immunoassay conditions, the specified antibodies bound to a particular polypeptide do not bind in a significant amount to other polypeptides present in the sample. Selective binding of an antibody under such conditions may require an antibody that is selected for its specificity for a particular polypeptide. A variety of immunoassay formats may be used to select antibodies that selectively bind with a particular polypeptide. For example, solid-phase ELISA immunoassays are routinely used to select antibodies selectively immunoreactive with a polypeptide. See Harlow and Lane, "Antibodies, A Laboratory Manual," Cold Spring Harbor Publications, New York, (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., eds., "Basic and Clinical Immunology," (Lange Medical Publications, Los Altos, Calif., Fourth Edition) and references cited therein, and in Harlow and Lane, "Antibodies, A Laboratory Manual," Cold Spring Harbor Publications, New York, (1988).

Gene expression in plants is regulated by the interaction of protein transcription factors with specific nucleotide sequences within the regulatory region of a gene. One example of transcription factors are polypeptides that contain zinc finger (ZF) motifs. Each ZF module is approximately 30 amino acids long folded around a zinc ion. The DNA recognition domain of a ZF protein is a α-helical structure that inserts into the major grove of the DNA double helix. The module contains three amino acids that bind to the DNA with each amino acid contacting a single base pair in the target DNA sequence. ZF motifs are arranged in a modular repeating fashion to form a set of fingers that recognize a contiguous DNA sequence. For example, a three-fingered ZF motif will recognize 9 bp of DNA. Hundreds of proteins have been shown to contain ZF motifs with between 2 and 37 ZF modules in each protein (Isalan M. et al., Biochemistry 37 (35), 12026 (1998); Moore M. et al., Proc. Natl. Acad. Sci. USA 98 (4), 1432 (2001) and Moore M. et al., Proc. Natl. Acad. Sci. USA 98 (4), 1437 (2001); U.S. Pat. No. 6,007,988 and U.S. Pat. No. 6,013,453).

The regulatory region of a plant gene contains many short DNA sequences (cis-acting elements) that serve as recognition domains for transcription factors, including ZF proteins. Similar recognition domains in different genes allow the coordinate expression of several genes encoding enzymes in a metabolic pathway by common transcription factors. Variation in the recognition domains among members of a gene family facilitates differences in gene expression within the same gene family, for example, among tissues and stages of development and in response to environmental conditions.

Typical ZF proteins contain not only a DNA recognition domain but also a functional domain that enables the ZF protein to activate or repress transcription of a specific gene. Experimentally, an activation domain has been used to activate transcription of the target gene (U.S. Pat. No. 5,789,538 and patent application WO 95/19431), but it is also possible to link a transcription repressor domain to the ZF and thereby inhibit transcription (patent applications WO 00/47754 and WO 01/002019). It has been reported that an enzymatic function such as nucleic acid cleavage can be linked to the ZF (patent application WO 00/20622).

The invention provides a method that allows one skilled in the art to isolate the regulatory region of one or more LTRRP or YRP encoding genes from the genome of a plant cell and to design zinc finger transcription factors linked to a functional domain that will interact with the regulatory region of the gene. The interaction of the zinc finger protein with the plant gene can be designed in such a manner as to alter expression of the gene and preferably thereby to confer increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait.

In particular, the invention provides a method of producing a transgenic plant with a LTRRP or YRP coding nucleic acid, wherein expression of the nucleic acid(s) in the plant results in in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait as compared to a wild type plant comprising: (a) transforming a plant cell with an expression vector comprising a LTRRP or YRP encoding nucleic acid, and (b) generating from the plant cell a transgenic plant with enhanced tolerance to abiotic environmental stress and/or increased yield as compared to a wild type plant. For such plant transformation, binary vectors such as pBinAR can be used (Höfgen and Willmitzer, Plant Science 66, 221 (1990)). Moreover suitable binary vectors are for example pBIN19, pBI101, pGPTV or pPZP (Hajukiewicz P. et al., Plant Mol. Biol., 25, 989 (1994)).

Construction of the binary vectors can be performed by ligation of the cDNA into the T-DNA. 5' to the cDNA a plant promoter activates transcription of the cDNA. A polyadenylation sequence is located 3' to the cDNA. Tissue-specific expression can be achieved by using a tissue specific promoter as listed above. Also, any other promoter element can be used. For constitutive expression within the whole plant, the CaMV 35S promoter can be used. The expressed protein can be targeted to a cellular compartment using a signal peptide, for example for plastids, mitochondria or endoplasmic reticulum (Kermode, Crit. Rev. Plant Sci. 4 (15), 285 (1996)). The signal peptide is cloned 5' in frame to the cDNA to archive subcellular localization of the fusion protein. One skilled in the art will recognize that the promoter used should be operatively linked to the nucleic acid such that the promoter causes transcription of the nucleic acid which results in the synthesis of a mRNA which encodes a polypeptide.

Alternate methods of transfection include the direct transfer of DNA into developing flowers via electroporation or *Agrobacterium* mediated gene transfer. *Agrobacterium* mediated plant transformation can be performed using for example the GV3101(pMP90) (Koncz and Schell, Mol. Gen. Genet. 204, 383 (1986)) or LBA4404 (Ooms et al., Plasmid, 7, 15 (1982); Hoekema et al., Nature, 303, 179 (1983)) *Agrobacterium tumefaciens* strain. Transformation can be performed by standard transformation and regeneration techniques (Deblaere et al., Nucl. Acids. Res. 13, 4777 (1994); Gelvin and Schilperoort, Plant Molecular Biology Manual, $2^{nd}$ Ed.— Dordrecht: Kluwer Academic Publ., 1995.—in Sect., Ringbuc Zentrale Signatur: BT11-P ISBN 0-7923-2731-4; Glick B. R. and Thompson J. E., Methods in Plant Molecular Biology and Biotechnology, Boca Raton: CRC Press, 1993.—360 S., ISBN 0-8493-5164-2). For example, rapeseed can be transformed via cotyledon or hypocotyl transformation (Moloney et al., Plant Cell Reports 8, 238 (1989); De Block et al., Plant Physiol. 91, 694 (1989)). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., Plant Cell Report 13, 282 (1994)). Additionally, transformation of soybean can be performed using for example a technique described in European Patent No. 424 047, U.S. Pat. No. 5,322,783, European Patent No. 397 687, U.S. Pat. No. 5,376,543 or U.S. Pat. No. 5,169,770. Transformation of maize can be achieved by particle bombardment, polyethylene glycol mediated DNA uptake or via the silicon carbide fiber technique (see, for example, Freeling and Walbot "The maize handbook" Springer Verlag: New York (1993) ISBN 3-540-97826-7). A specific example of maize transformation is found in U.S. Pat. No. 5,990,387 and a specific example of wheat transformation can be found in PCT Application No. WO 93/07256.

Growing the modified plants under defined N-conditions, in an especial embodiment under abiotic environmental stress conditions, and then screening and analyzing the growth characteristics and/or metabolic activity assess the effect of the genetic modification in plants on increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait. Such analysis techniques are well known to one skilled in the art. They include beneath to screening (Römpp Lexikon Biotechnologie, Stuttgart/New York: Georg Thieme Verlag 1992, "screening" p. 701) dry weight, fresh weight, protein synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, Vol. 17; Rehm et al., 1993 Biotechnology, Vol. 3, Chapter III: Product recovery and purification, page 469-714, VCH: Weinheim; Belter, P. A. et al., 1988 Bioseparations: downstream processing for biotechnology, John Wiley and Sons; Kennedy J. F. and Cabral J. M. S., 1992 Recovery processes for biological materials, John Wiley and Sons; Shaeiwitz J. A. and Henry J. D., 1988 Biochemical separations, in: Ullmann's Encyclopedia of Industrial Chemistry, Vol. B3, Chapter 11, page 1-27, VCH: Weinheim; and Dechow F. J. (1989) Separation and purification techniques in biotechnology, Noyes Publications).

In one embodiment, the present invention relates to a method for the identification of a gene product conferring in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait as compared to a corresponding, e.g. non-transformed, wild type cell in a cell of an organism for example plant, comprising the following steps:

(a) contacting, e.g. hybridizing, some or all nucleic acid molecules of a sample, e.g. cells, tissues, plants or microorganisms or a nucleic acid library, which can contain a candidate gene encoding a gene product conferring increasing yield, e.g. increasing a yield-related trait, for example enhancing tolerance to abiotic environmental stress, for example increasing drought tolerance and/or low temperature tolerance and/or increasing nutrient use efficiency, increasing i, with a nucleic acid molecule as shown in column 5 or 7 of table I A or B, or a functional homologue thereof;
(b) identifying the nucleic acid molecules, which hybridize under relaxed stringent conditions with said nucleic acid molecule, in particular to the nucleic acid molecule sequence shown in column 5 or 7 of table I, and, optionally, isolating the full length cDNA clone or complete genomic clone;
(c) identifying the candidate nucleic acid molecules or a fragment thereof in host cells, preferably in a plant cell;
(d) increasing the expressing of the identified nucleic acid molecules in the host cells for which enhanced tolerance to abiotic environmental stress and/or increased yield are desired;
(e) assaying the level of enhanced tolerance to abiotic environmental stress and/or increased yield of the host cells; and
(f) identifying the nucleic acid molecule and its gene product which confers increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait in the host cell compared to the wild type.

Relaxed hybridization conditions are: After standard hybridization procedures washing steps can be performed at low to medium stringency conditions usually with washing conditions of 40°-55° C. and salt conditions between 2×SSC and 0.2×SSC with 0.1% SDS in comparison to stringent washing conditions as e.g. 60° to 68° C. with 0.1% SDS. Further examples can be found in the references listed above for the stringent hybridization conditions. Usually washing steps are repeated with increasing stringency and length until a useful signal to noise ratio is detected and depend on many factors as the target, e.g. its purity, GC-content, size etc, the probe, e.g. its length, is it a RNA or a DNA probe, salt conditions, washing or hybridization temperature, washing or hybridization time etc.

In another embodiment, the present invention relates to a method for the identification of a gene product the expression of which confers increased yield, e.g. an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait in a cell, comprising the following steps:
(a) identifying a nucleic acid molecule in an organism, which is at least 20%, preferably 25%, more preferably 30%, even more preferred are 35%. 40% or 50%, even more preferred are 60%, 70% or 80%, most preferred are 90% or 95% or more homolog to the nucleic acid molecule encoding a protein comprising the polypeptide molecule as shown in column 5 or 7 of table II, or comprising a consensus sequence or a polypeptide motif as shown in column 7 of table IV, or being encoded by a nucleic acid molecule comprising a polynucleotide as shown in column 5 or 7 of table I application no. 1, or a homologue thereof as described herein, for example via homology search in a data bank;
(b) enhancing the expression of the identified nucleic acid molecules in the host cells;
(c) assaying the level of enhancement of in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait in the host cells; and
(d) identifying the host cell, in which the enhanced expression confers in increasing yield, e.g. increasing a yield-related trait, for example enhancing tolerance to abiotic environmental stress, for example increasing drought tolerance and/or low temperature tolerance and/or increasing nutrient use efficiency, increasing intrinsic yield and/or another mentioned yield-related trait in the host cell compared to a wild type.

Further, the nucleic acid molecule disclosed herein, in particular the nucleic acid molecule shown column 5 or 7 of table I A or B, may be sufficiently homologous to the sequences of related species such that these nucleic acid molecules may serve as markers for the construction of a genomic map in related organism or for association mapping. Furthermore natural variation in the genomic regions corresponding to nucleic acids disclosed herein, in particular the nucleic acid molecule shown column 5 or 7 of table I A or B, or homologous thereof may lead to variation in the activity of the proteins disclosed herein, in particular the proteins comprising polypeptides as shown in column 5 or 7 of table II A or B, or comprising the consensus sequence or the polypeptide motif as shown in column 7 of table IV, and their homolgous and in consequence in a natural variation of an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait.

In consequence natural variation eventually also exists in form of more active allelic variants leading already to a relative increase in yield, e.g. an increase in an yield-related trait, for example enhanced tolerance to abiotic environmental stress, for example drought tolerance and/or low temperature tolerance and/or nutrient use efficiency, and/or another mentioned yield-related trait. Different variants of the nucleic acids molecule disclosed herein, in particular the nucleic acid comprising the nucleic acid molecule as shown column 5 or 7 of table I A or B, which corresponds to different levels of increased yield, e.g. different levels of increased yield-related trait, for example different enhancing tolerance to abiotic environmental stress, for example increased drought tolerance and/or low temperature tolerance and/or increasing nutrient use efficiency, increasing intrinsic yield and/or another mentioned yield-related trait, can be indentified and used for marker assisted breeding for an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait.

Accordingly, the present invention relates to a method for breeding plants with an increased yield, e.g. an increased yield-related trait, for example enhanced tolerance to abiotic environmental stress, for example an increased drought tolerance and/or low temperature tolerance and/or an increased nutrient use efficiency, and/or increased intrinsic yield and/or another yield-related trait, comprising (a) selecting a first plant variety with an increased yield, e.g. an increased yield-related trait, for example enhanced tolerance to abiotic environmental stress, for example an increased drought tolerance and/or low temperature tolerance and/or an increased nutrient use efficiency, and/or increased intrinsic yield and/or anotanother yield-related trait based on increased expression of a nucleic acid of the invention as disclosed herein, in particular of a nucleic acid molecule comprising a nucleic acid molecule as shown in column 5 or 7 of table I A or B, or a polypeptide comprising a polypeptide as shown in column 5 or 7 of table II A or B, or comprising a consensus sequence or a polypeptide motif as shown in column 7 of table IV, or a homologue thereof as described herein;

(b) associating the level of increased yield, e.g. increased yield-related trait, for example enhanced tolerance to abiotic environmental stress, for example increased drought tolerance and/or low temperature tolerance and/or an increased nutrient use efficiency, intrinsic yield and/or another mentioned yield-related trait with the expression level or the genomic structure of a gene encoding said polypeptide or said nucleic acid molecule;

(c) crossing the first plant variety with a second plant variety, which significantly differs in its level of increased yield, e.g. increased yield-related trait, for example enhanced tolerance to abiotic environmental stress, for example an increased drought tolerance and/or low temperature tolerance and/or an increased nutrient use efficiency, and/or another mentioned yield-related trait; and (d) identifying, which of the offspring varieties has got increased levels of an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait by the expression level of said polypeptide or nucleic acid molecule or the genomic structure of the genes encoding said polypeptide or nucleic acid molecule of the invention.

In one embodiment, the expression level of the gene according to step (b) is increased.

Yet another embodiment of the invention relates to a process for the identification of a compound conferring an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait as compared to a corresponding, e.g. non-transformed, wild type plant cell, a plant or a part thereof in a plant cell, a plant or a part thereof, a plant or a part thereof, comprising the steps:

(a) culturing a plant cell; a plant or a part thereof maintaining a plant expressing the polypeptide as shown in column 5 or 7 of table II, or being encoded by a nucleic acid molecule comprising a polynucleotide as shown in column 5 or 7 of table I, or a homologue thereof as described herein or a polynucleotide encoding said polypeptide and conferring with increased yield, e.g. with an increased yield-related trait, for example enhanced tolerance to abiotic environmental stress, for example an increased drought tolerance and/or low temperature tolerance and/or an increased nutrient use efficiency, intrinsic yield and/or another mentioned yield-related trait as compared to a corresponding, e.g. non-transformed, wild type plant cell, a plant or a part thereof; a non-transformed wild type plant or a part thereof and providing a readout system capable of interacting with the polypeptide under suitable conditions which permit the interaction of the polypeptide with this readout system in the presence of a chemical compound or a sample comprising a plurality of chemical compounds and capable of providing a detectable signal in response to the binding of a chemical compound to said polypeptide under conditions which permit the expression of said readout system and of the protein as shown in column 5 or 7 of table II, or being encoded by a nucleic acid molecule comprising a polynucleotide as shown in column 5 or 7 of table I application no. 1, or a homologue thereof as described herein; and (b) identifying if the chemical compound is an effective agonist by detecting the presence or absence or decrease or increase of a signal produced by said readout system.

Said compound may be chemically synthesized or microbiologically produced and/or comprised in, for example, samples, e.g., cell extracts from, e.g., plants, animals or microorganisms, e.g. pathogens. Furthermore, said compound(s) may be known in the art but hitherto not known to be capable of suppressing the polypeptide of the present invention. The reaction mixture may be a cell free extract or may comprise a cell or tissue culture. Suitable set ups for the process for identification of a compound of the invention are known to the person skilled in the art and are, for example, generally described in Alberts et al., Molecular Biology of the Cell, third edition (1994), in particular Chapter 17. The compounds may be, e.g., added to the reaction mixture, culture medium, injected into the cell or sprayed onto the plant.

If a sample containing a compound is identified in the process, then it is either possible to isolate the compound from the original sample identified as containing the compound capable of activating or enhancing or increasing the yield, e.g. yield-related trait, for example tolerance to abiotic environmental stress, for example drought tolerance and/or low temperature tolerance and/or increased nutrient use efficiency, and/or another mentioned yield-related trait as compared to a corresponding, e.g. non-transformed, wild type, or one can further subdivide the original sample, for example, if it consists of a plurality of different compounds, so as to reduce the number of different substances per sample and repeat the method with the subdivisions of the original sample. Depending on the complexity of the samples, the steps described above can be performed several times, preferably until the sample identified according to the said process only comprises a limited number of or only one substance(s). Preferably said sample comprises substances of similar chemical and/or physical properties, and most preferably said substances are identical. Preferably, the compound identified according to the described method above or its derivative is further formulated in a form suitable for the application in plant breeding or plant cell and tissue culture.

The compounds which can be tested and identified according to said process may be expression libraries, e.g., cDNA expression libraries, peptides, proteins, nucleic acids, antibodies, small organic compounds, hormones, peptidomimetics, PNAs or the like (Milner, Nature Medicine 1, 879 (1995); Hupp, Cell 83, 237 (1995); Gibbs, Cell 79, 193 (1994), and references cited supra). Said compounds can also be functional derivatives or analogues of known inhibitors or activators. Methods for the preparation of chemical derivatives and analogues are well known to those skilled in the art and are described in, for example, Beilstein, Handbook of Organic Chemistry, Springer, New York Inc., 175 Fifth Avenue, New York, N.Y. 10010 U.S.A. and Organic Synthesis, Wiley, New York, USA. Furthermore, said derivatives and analogues can be tested for their effects according to methods known in the art. Furthermore, peptidomimetics and/or computer aided design of appropriate derivatives and analogues can be used, for example, according to the methods described above. The cell or tissue that may be employed in the process preferably is a host cell, plant cell or plant tissue of the invention described in the embodiments hereinbefore.

Thus, in a further embodiment the invention relates to a compound obtained or identified according to the method for identifying an agonist of the invention said compound being an antagonist of the polypeptide of the present invention.

Accordingly, in one embodiment, the present invention further relates to a compound identified by the method for identifying a compound of the present invention.

In one embodiment, the invention relates to an antibody specifically recognizing the compound or agonist of the present invention.

The invention also relates to a diagnostic composition comprising at least one of the aforementioned nucleic acid molecules, antisense nucleic acid molecule, RNAi, snRNA, dsRNA, siRNA, miRNA, ta-siRNA, co-suppression molecule, ribozyme, vectors, proteins, antibodies or compounds of the invention and optionally suitable means for detection.

The diagnostic composition of the present invention is suitable for the isolation of mRNA from a cell and contacting the mRNA so obtained with a probe comprising a nucleic acid probe as described above under hybridizing conditions, detecting the presence of mRNA hybridized to the probe, and thereby detecting the expression of the protein in the cell. Further methods of detecting the presence of a protein according to the present invention comprise immunotechniques well known in the art, for example enzyme linked immunoadsorbent assay. Furthermore, it is possible to use the nucleic acid molecules according to the invention as molecular markers or primers in plant breeding. Suitable means for detection are well known to a person skilled in the art, e.g. buffers and solutions for hybridization assays, e.g. the aforementioned solutions and buffers, further and means for Southern-, Western-, Northern- etc. -blots, as e.g. described in Sambrook et al. are known. In one embodiment diagnostic composition contain PCR primers designed to specifically detect the presence or the expression level of the nucleic acid molecule to be reduced in the process of the invention, e.g. of the nucleic acid molecule of the invention, or to discriminate between different variants or alleles of the nucleic acid molecule of the invention or which activity is to be reduced in the process of the invention.

In another embodiment, the present invention relates to a kit comprising the nucleic acid molecule, the vector, the host cell, the polypeptide, or the antisense, RNAi, snRNA, dsRNA, siRNA, miRNA, ta-siRNA, co-suppression molecule, or ribozyme molecule, or the viral nucleic acid molecule, the antibody, plant cell, the plant or plant tissue, the harvestable part, the propagation material and/or the compound and/or agonist identified according to the method of the invention.

The compounds of the kit of the present invention may be packaged in containers such as vials, optionally with/in buffers and/or solution. If appropriate, one or more of said components might be packaged in one and the same container. Additionally or alternatively, one or more of said components might be adsorbed to a solid support as, e.g. a nitrocellulose filter, a glass plate, a chip, or a nylon membrane or to the well of a micro titer plate. The kit can be used for any of the herein described methods and embodiments, e.g. for the production of the host cells, transgenic plants, pharmaceutical compositions, detection of homologous sequences, identification of antagonists or agonists, as food or feed or as a supplement thereof or as supplement for the treating of plants, etc. Further, the kit can comprise instructions for the use of the kit for any of said embodiments. In one embodiment said kit comprises further a nucleic acid molecule encoding one or more of the aforementioned protein, and/or an antibody, a vector, a host cell, an antisense nucleic acid, a plant cell or plant tissue or a plant. In another embodiment said kit comprises PCR primers to detect and discriminate the nucleic acid molecule to be reduced in the process of the invention, e.g. of the nucleic acid molecule of the invention.

In a further embodiment, the present invention relates to a method for the production of an agricultural composition providing the nucleic acid molecule for the use according to the process of the invention, the nucleic acid molecule of the invention, the vector of the invention, the antisense, RNAi, snRNA, dsRNA, siRNA, miRNA, ta-siRNA, co-suppression molecule, ribozyme, or antibody of the invention, the viral nucleic acid molecule of the invention, or the polypeptide of the invention or comprising the steps of the method according to the invention for the identification of said compound or agonist; and formulating the nucleic acid molecule, the vector or the polypeptide of the invention or the agonist, or compound identified according to the methods or processes of the present invention or with use of the subject matters of the present invention in a form applicable as plant agricultural composition.

In another embodiment, the present invention relates to a method for the production of the plant culture composition comprising the steps of the method of the present invention; and formulating the compound identified in a form acceptable as agricultural composition.

Under "acceptable as agricultural composition" is understood, that such a composition is in agreement with the laws regulating the content of fungicides, plant nutrients, herbicides, etc. Preferably such a composition is without any harm for the protected plants and the animals (humans included) fed therewith.

Throughout this application, various publications are referenced. The disclosures of all of these publications and those references cited within those publications in their entireties are hereby incorporated by reference into this application in order to more fully describe the state of the art to which this invention pertains.

It should also be understood that the foregoing relates to preferred embodiments of the present invention and that numerous changes and variations may be made therein without departing from the scope of the invention. The invention is further illustrated by the following examples, which are not to be construed in any way as limiting. On the contrary, it is to be clearly understood that various other embodiments, modifications and equivalents thereof, which, after reading the description herein, may suggest themselves to those skilled in the art without departing from the spirit of the present invention and/or the scope of the claims.

In one embodiment, the increased yield results in an increase of the production of a specific ingredient including, without limitation, an enhanced and/or improved sugar content or sugar composition, an enhanced or improved starch content and/or starch composition, an enhanced and/or improved oil content and/or oil composition (such as enhanced seed oil content), an enhanced or improved protein content and/or protein composition (such as enhanced seed protein content), an enhanced and/or improved vitamin content and/or vitamin composition, or the like.

Incorporated by reference are further the following applications of which the present applications claims the priority: EP07116983.3, EP 07119635.6, 08153046.1, EP 08157331.3, and EP08162290.4.

Accordingly, the present invention relates to also to method for producing a transgenic plant cell, a plant or a part thereof with enhanced tolerance and/or resistance to abiotic environmental stress and/or increased yield as compared to a corresponding, e.g. non-transformed, wild type plant cell, a plant or a part thereof by increasing or generating, in said plant cell or plant or part thereof, one or more activities selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein.

Accordingly, the present invention relates to also to a method for producing a transgenic plant cell, a plant or a part thereof with enhanced tolerance and/or resistance to abiotic environmental stress and/or increased yield as compared to a corresponding, e.g. non-transformed, wild type plant cell, a plant or a part thereof by increasing or generating, in said plant cell or plant or part thereof, one or more activities of at least one polypeptide comprising a polypeptide selected from the group consisting of:
(i) a polypeptide comprising a polypeptide, a consensus sequence or at least one polypeptide motif as depicted in column 5 or 7 of table II or of table IV, respectively; or
(ii) an expression product of a nucleic acid molecule comprising a polynucleotide as depicted in column 5 or 7 of table I,
(iii) or a functional equivalent of (i) or (ii).

Accordingly, the present invention relates to further to a method for producing a transgenic plant cell, a plant or a part thereof with enhanced tolerance and/or resistance to abiotic environmental stress and/or increased yield as compared to a corresponding, e.g. non-transformed, wild type plant cell, a plant or a part thereof by increasing or generating, in said plant cell or plant or part thereof, one or more activities by increasing the expression of at least one nucleic acid molecule comprising a nucleic acid molecule selected from the group consisting of:

(a) a nucleic acid molecule encoding the polypeptide shown in column 5 or 7 of table II;
(b) a nucleic acid molecule shown in column 5 or 7 of table I;
(c) a nucleic acid molecule, which, as a result of the degeneracy of the genetic code, can be derived from a polypeptide sequence depicted in column 5 or 7 of table II and confers an enhanced tolerance and/or resistance to abiotic environmental stress and/or increased yield as compared to a corresponding, e.g. non-transformed, wild type plant cell, a plant or a part thereof;
(d) a nucleic acid molecule having at least 30% identity with the nucleic acid molecule sequence of a polynucleotide comprising the nucleic acid molecule shown in column 5 or 7 of table I and confers an enhanced tolerance and/or resistance to abiotic environmental stress and/or increased yield as compared to a corresponding, e.g. non-transformed, wild type plant cell, a plant or a part thereof;
(e) a nucleic acid molecule encoding a polypeptide having at least 30% identity with the amino acid sequence of the polypeptide encoded by the nucleic acid molecule of (a) to (c) and having the activity represented by a nucleic acid molecule comprising a polynucleotide as depicted in column 5 of table I and confers an enhanced tolerance and/or resistance to abiotic environmental stress and/or increased yield as compared to a corresponding, e.g. non-transformed, wild type plant cell, a plant or a part thereof;
(f) nucleic acid molecule which hybridizes with a nucleic acid molecule of (a) to (c) under stringent hybridization conditions and confers an enhanced tolerance and/or resistance to abiotic environmental stress and/or increased yield as compared to a corresponding, e.g. non-transformed, wild type plant cell, a plant or a part thereof;
(g) a nucleic acid molecule encoding a polypeptide which can be isolated with the aid of monoclonal or polyclonal antibodies made against a polypeptide encoded by one of the nucleic acid molecules of (a) to (e) and having the activity represented by the nucleic acid molecule comprising a polynucleotide as depicted in column 5 of table I;
(h) a nucleic acid molecule encoding a polypeptide comprising the consensus sequence or one or more polypeptide motifs as shown in column 7 of table IV and preferably having the activity represented by a nucleic acid molecule comprising a polynucleotide as depicted in column 5 of table II or IV;
(i) a nucleic acid molecule encoding a polypeptide having the activity represented by a protein as depicted in column 5 of table II and confers enhanced tolerance and/or resistance to abiotic environmental stress and/or increased yield as compared to a corresponding, e.g. non-transformed, wild type plant cell, a plant or a part thereof;
(j) nucleic acid molecule which comprises a polynucleotide, which is obtained by amplifying a cDNA library or a genomic library using the primers in column 7 of table III which do not start at their 5'-end with the nucleotides ATA and preferably having the activity represented by a nucleic acid molecule comprising a polynucleotide as depicted in column 5 of table II or IV; and
(k) a nucleic acid molecule which is obtainable by screening a suitable nucleic acid library under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt or 500 nt of a nucleic acid molecule complementary to a nucleic acid molecule sequence characterized in (a) to (e) and encoding a polypeptide having the activity represented by a protein comprising a polypeptide as depicted in column 5 of table II.

Accordingly, the present invention relates to also to the method of the invention, wherein the one or more activities increased or generated are selected from the group consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein.

Accordingly, the present invention relates to also to a trangenic plant cell, a plant or a part thereof with enhanced tolerance and/or resistance to abiotic environmental stress and/or increased yield as compared to a corresponding, e.g. non-transformed, wild type plant cell, a plant or a part thereof produced by a method of the invention.

Accordingly, the present invention relates to also to the transgenic plant cell, a plant or a part thereof of the invention derived from a monocotyledonous plant.

Accordingly, the present invention relates to also to the transgenic plant cell, a plant or a part thereof of the invention derived from a dicotyledonous plant.

Accordingly, the present invention relates to also to the transgenic plant cell, a plant or a part thereof of the invention, wherein the plant is selected from the group consisting of corn (maize), wheat, rye, oat, triticale, rice, barley, soybean, peanut, cotton, oil seed rape, including canola and winter oil seed rape, manihot, pepper, sunflower, flax, borage, safflower, linseed, primrose, rapeseed, turnip rape, tagetes, solanaceous plants comprising potato, tobacco, eggplant, tomato; *Vicia* species, pea, alfalfa, coffee, cacao, tea, *Salix* species, oil palm, coconut, perennial grass, forage crops and *Arabidopsis thaliana*.

Accordingly, the present invention relates to also to the transgenic plant cell, a plant or a part thereof of the invention, wherein the plant is selected from the group consisting of corn, soy, oil seed rape (including canola and winter oil seed rape), cotton, wheat and rice.

Accordingly, the present invention relates to also to a seed produced by a transgenic plant of the invention, wherein the seed is genetically homozygous for a transgene conferring enhanced tolerance and/or resistance to abiotic environmental stress and/or increased yield as compared to a corresponding, e.g. non-transformed, wild type plant cell, a plant or a part thereof.

Accordingly, the present invention relates to also to an isolated nucleic acid molecule comprising a nucleic acid molecule selected from the group consisting of:

(a) a nucleic acid molecule encoding the polypeptide shown in column 5 or 7 of table II B;
(b) a nucleic acid molecule shown in column 5 or 7 of table I B;
(c) a nucleic acid molecule, which, as a result of the degeneracy of the genetic code, can be derived from a polypeptide sequence depicted in column 5 or 7 of table II and confers an enhanced tolerance and/or resistance to abiotic environmental stress and/or increased yield as compared to a corresponding, e.g. non-transformed, wild type plant cell, a plant or a part thereof;
(d) a nucleic acid molecule having at least 30% identity with the nucleic acid molecule sequence of a polynucleotide comprising the nucleic acid molecule shown in column 5 or 7 of table I and confers an enhanced tolerance and/or resistance to abiotic environmental stress and/or increased yield as compared to a corresponding, e.g. non-transformed, wild type plant cell, a plant or a part thereof;
(e) a nucleic acid molecule encoding a polypeptide having at least 30% identity with the amino acid sequence of the polypeptide encoded by the nucleic acid molecule of (a) to (c) and having the activity represented by a nucleic acid molecule comprising a polynucleotide as depicted in column 5 of table I and confers an enhanced tolerance and/or resistance to abiotic environmental stress and/or increased yield as compared to a corresponding, e.g. non-transformed, wild type plant cell, a plant or a part thereof;
(f) nucleic acid molecule which hybridizes with a nucleic acid molecule of (a) to (c) under stringent hybridization conditions and confers an enhanced tolerance and/or resistance to abiotic environmental stress and/or increased yield as compared to a corresponding, e.g. non-transformed, wild type plant cell, a plant or a part thereof;
(g) a nucleic acid molecule encoding a polypeptide which can be isolated with the aid of monoclonal or polyclonal antibodies made against a polypeptide encoded by one of the nucleic acid molecules of (a) to (e) and having the activity represented by the nucleic acid molecule comprising a polynucleotide as depicted in column 5 of table I;
(h) a nucleic acid molecule encoding a polypeptide comprising the consensus sequence or one or more polypeptide motifs as shown in column 7 of table IV and preferably having the activity represented by a nucleic acid molecule comprising a polynucleotide as depicted in column 5 of table II or IV;
(i) a nucleic acid molecule encoding a polypeptide having the activity represented by a protein as depicted in column 5 of table II and confers an enhanced tolerance and/or resistance to abiotic environmental stress and/or increased yield as compared to a corresponding, e.g. non-transformed, wild type plant cell, a plant or a part thereof;
(j) nucleic acid molecule which comprises a polynucleotide, which is obtained by amplifying a cDNA library or a genomic library using the primers in column 7 of table III which do not start at their 5'-end with the nucleotides ATA and preferably having the activity represented by a nucleic acid molecule comprising a polynucleotide as depicted in column 5 of table II or IV; and
(k) a nucleic acid molecule which is obtainable by screening a suitable nucleic acid library under stringent hybridization conditions with a probe comprising a complementary sequence of a nucleic acid molecule of (a) or (b) or with a fragment thereof, having at least 15 nt, preferably 20 nt, 30 nt, 50 nt, 100 nt, 200 nt or 500 nt of a nucleic acid molecule complementary to a nucleic acid molecule sequence characterized in (a) to (e) and encoding a polypeptide having the activity represented by a protein comprising a polypeptide as depicted in column 5 of table II;

whereby the nucleic acid molecule according to (a) to (k) is at least in one or more nucleotides different from the sequence depicted in column 5 or 7 of table I A and preferably which encodes a protein which differs at least in one or more amino acids from the protein sequences depicted in column 5 or 7 of table II A.

Accordingly, the present invention also relates to a nucleic acid construct which confers the expression of said nucleic acid molecule of the invention, comprising one or more regulatory elements, whereby expression of the nucleic acid in a host cell results in enhanced tolerance and/or resistance to abiotic environmental stress and/or increased yield as compared to a corresponding, e.g. non-transformed, wild type plant cell, a plant or a part thereof.

Accordingly, the present invention also relates to a vector comprising the nucleic acid molecule of the invention or the nucleic acid construct of the invention, whereby expression of said coding nucleic acid in a host cell results in enhanced tolerance and/or resistance to abiotic environmental stress and/or increased yield as compared to a corresponding, e.g. non-transformed, wild type plant cell, a plant or a part thereof.

Accordingly, the present invention also relates to a host cell, which has been transformed stably or transiently with the vector of the invention or the nucleic acid molecule of the invention or the nucleic acid construct of the invention and which shows due to the transformation an enhanced tolerance and/or resistance to abiotic environmental stress and/or increased yield as compared to a corresponding, e.g. non-transformed, wild type plant cell, a plant or a part thereof.

Accordingly, the present invention also relates to a process for producing a polypeptide, wherein the polypeptide is expressed in a host cell of the invention.

Accordingly, the present invention also relates to a polypeptide produced by the process of the invention or encoded by the nucleic acid molecule of the invention whereby the polypeptide distinguishes over the sequence as shown in table II by one or more amino acids Accordingly, the present invention also relates to an antibody, which binds specifically to the polypeptide of the invention.

Accordingly, the present invention also relates to a plant tissue, propagation material, harvested material or a plant comprising the host cell of the invention.

Accordingly, the present invention also relates to a process for the identification of a compound conferring an enhanced tolerance and/or resistance to abiotic environmental stress and/or increased yield as compared to a corresponding, e.g. non-transformed, wild type plant cell, a plant or a part thereof in a plant cell, a plant or a part thereof, a plant or a part thereof, comprising the steps:

(a) culturing a plant cell; a plant or a part thereof maintaining a plant expressing the polypeptide encoded by the nucleic acid molecule of the invention conferring an enhanced tolerance and/or resistance to abiotic environmental stress and/or increased yield as compared to a corresponding, e.g. non-transformed, wild type plant cell, a plant or a part thereof; a non-transformed wild type plant or a part thereof and a readout system capable of interacting with the polypeptide under suitable conditions which permit the interaction of the polypeptide with said readout system in the presence of a compound or a sample comprising a plurality of compounds and capable of providing a detectable signal in response to the binding of a compound to said polypeptide under conditions which permit the expression of said readout system and of the polypeptide encoded by the nucleic acid molecule of the invention conferring an enhanced tolerance and/or resistance to abiotic environmental stress and/or increased yield as compared to a corresponding, e.g. non-transformed, wild type plant cell, a plant or a part thereof; a non-transformed wild type plant or a part thereof;

(b) identifying if the compound is an effective agonist by detecting the presence or absence or increase of a signal produced by said readout system.

Accordingly, the present invention also relates to a method for the production of an agricultural composition comprising the steps of the method of the invention and formulating the compound identified in said method of the invention for identification of such a compound in a form acceptable for an application in agriculture.

Accordingly, the present invention also relates to a composition comprising the nucleic acid molecule of any of the invention, the polypeptide of the invention, the nucleic acid construct of the invention, the vector of the invention, the compound of the invention, the antibody of the invention, and optionally an agricultural acceptable carrier.

Accordingly, the present invention also relates to an isolated polypeptide as depicted in table II, preferably table II B which is selected from yeast, preferably *Saccharomyces cerevisiae*, or *E. coli*.

Accordingly, the present invention also relates to a method of producing a transgenic plant cell, a plant or a part thereof with enhanced tolerance and/or resistance to abiotic environmental stress and/or increased yield compared to a corresponding non transformed wild type plant cell, a plant or a part thereof, wherein the enhanced tolerance and/or resistance to abiotic environmental stress and/or increased yield is increased by expression of a polypeptide encoded by a nucleic acid according to the invention and results in enhanced tolerance and/or resistance to abiotic environmental stress and/or increased yield as compared to a corresponding, e.g. non-transformed, wild type plant cell, a plant or a part thereof, comprising (a) transforming a plant cell, or a part of a plant with an vector according to the invention and
(b) generating from the plant cell or the part of a plant a transgenic plant with enhanced tolerance and/or resistance to abiotic environmental stress and/or increased yield as compared to a corresponding, e.g. non-transformed, wild type plant.

Accordingly, the present invention also relates to a method of producing a transgenic plant with increased yield compared to a corresponding non transformed wild type plant under conditions of low temperature by increasing or generating one or more activities selected from the group of "Low Temperature Resistance/Tolerance-related Proteins" (LTRRP) consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein.

Accordingly, the present invention also relates to a method according to invention comprising
(a) transforming a plant cell or a part of a plant with an vector according to the invention; and
(b) generating from the plant cell or the part of a plant a transgenic plant with an enhanced tolerance and/or resistance to abiotic environmental stress and/or increased yield as compared to a corresponding, e.g. non-transformed, wild type plant.

Accordingly, the present invention also relates to an use of a LTRRP encoding nucleic acid molecule selected from the group comprising the nucleic acid of the invention for preparing a plant cell, plant or part thereof with enhanced tolerance and/or resistance to abiotic environmental stress and/or increased yield as compared to a corresponding, e.g. non-transformed, wild type plant cell, a plant or part of a plant.

Accordingly, the present invention also relates to an use of a LTRRP encoding nucleic acid molecule selected from the group comprising the nucleic acid of the invention or parts thereof as markers for selection of plants or plant cells with an enhanced tolerance and/or resistance to abiotic environmental stress and/or increased yield as compared to a corresponding, e.g. non-transformed, wild type plant cell; a non-transformed wild type plant or a part thereof.

Accordingly, the present invention also relates to an use of a LTRRP encoding nucleic acid molecule selected from the group comprising the nucleic acid of the invention or parts thereof as markers for detection of stress tolerance in plants or plant cells.

Accordingly, the present invention also relates to a transgenic plant cell comprising a nucleic acid molecule encoding a polypeptide having a activity selected from the group of LTRRP consisting of (DL)-glycerol-3-phosphatase, 2-deoxyglucose-6-phosphate phosphatase, 3-methyl-2-oxobutanoate hydroxymethyltransferase, alcohol acetyltransferase, amino acid permease, aminomethyltransferase, ammonium transporter, aquaporin, Arabinose transport system ATP-binding protein, Argininosuccinate synthase, aspartate aminotransferase, B1906-protein, B3410-protein, cardiolipin synthetase, CoA-transferase-like protein (NAD(P)-binding), cobalt transport protein, DNA and protein binding protein for controlling the proteome at post-transcriptional level, Enoyl CoA hydratase, enoyl-CoA hydratase, enoyl-CoA isomerase, ethanolamine kinase, formate acetyltransferase 1, glucitol/sorbitol-specific enzyme IIA component protein, glutamine synthetase, glutathione S-transferase, glycerol dehydrogenase, Glycogen synthesis initiator protein, GTP-binding protein, Heat shock protein, hexose transporter, holo-[acyl-carrier-protein] synthase, inorganic phosphate transporter, lanosterol synthase, Molybdenum-binding subunit of aldehyde oxidases and xanthine dehydrogenases, multidrug resistance protein, multiple drug resistance protein, NADH dehydrogenase/NAD(P)H nitroreductase, oxidoreductase, peptidyl-prolyl cis-trans isomerase, Peroxisomal targeting signal 2 receptor, Phosphoadenosine phosphosulfate reductase, Phosphocarrier protein, Pirin-like protein, precorrin-6y methylase, protein required for degradation of glycoproteins, pyrimidine deaminase/reductase, Regulator of cell morphogenesis and NO signaling, serine acetyltransferase, signalosome complex subunit, SLR1094-protein, subunit of TORC1, thiol-specific monooxygenase, transcriptional regulatory protein, transketolase, two-module transport protein, uridine diphosphate-N-acetylglucosamine transporter, yer175w-a-protein, yhr213w-a-protein, YML079W-protein, YMR157C-protein, YNL024C-protein, and YNR040W-protein, wherein said polypeptide confers an enhanced tolerance and/or resistance to abiotic environmental stress and/or increased yield as compared to a corresponding, e.g. non-transformed, wild type plant cell, a plant or part thereof, preferably when said polypeptide is overexpressed.

Accordingly, the present invention also relates to the method, transgenic plant cell, plant or part thereof, seed, isolated nucleic acid construct, vector, host cell, process, polypeptide, antibody, plant tissue, propagation material, harvested material or plant, composition, isolated polypeptide or use according to any of the invention, wherein the tolerance to abiotic environmental stress is selected from the group consisting of tolerance to salt stress, drought stress, heat stress and/or low temperature stress.

Accordingly, the present invention also relates to the method, transgenic plant cell, plant or part thereof, seed, isolated nucleic acid construct, vector, host cell, process, polypeptide, antibody, plant tissue, propagation material, harvested material or plant, composition, isolated polypeptide or use of the invention, wherein the tolerance to abiotic stress is low temperature stress.

Accordingly, the present invention also relates to the method, transgenic plant cell, plant or part thereof, seed, isolated nucleic acid construct, vector, host cell, process, polypeptide, antibody, plant tissue, propagation material, harvested material or plant, composition, isolated polypeptide or use of the invention, wherein the tolerance and/or resistance to low temperature stress is tolerance and/or resistance to chilling stress and/or freezing stress.

Accordingly, the present invention also relates to the method, transgenic plant cell, plant or part thereof, seed, isolated nucleic acid construct, vector, host cell, process, polypeptide, antibody, plant tissue, propagation material, harvested material or plant, composition, isolated polypeptide or use of the invention, wherein low temperature tolerance is manifested in that the percentage of seeds germinating under such low temperature conditions is higher than in the (non-transformed) starting or wild-type organism.

Accordingly, the present invention also relates to a method, transgenic plant cell, plant or part thereof, seed, isolated nucleic acid construct, vector, host cell, process, polypeptide, antibody, plant tissue, propagation material, harvested material or plant, composition, isolated polypeptide or use of the invention, wherein low temperature is such temperature that it would be limiting for growth compared to a (non-transformed) starting or wild-type organism.

Example 1

Engineering *Arabidopsis* plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait by over-expressing YLR protein genes, e.g. expressing genes of the present invention.

Cloning of the sequences of the present invention as shown in table I, column 5 and 7, for the expression in plants.

Unless otherwise specified, standard methods as described in Sambrook et al., Molecular Cloning: A laboratory manual, Cold Spring Harbor 1989, Cold Spring Harbor Laboratory Press are used.

The inventive sequences as shown in table I, column 5 and 7, were amplified by PCR as described in the protocol of the Pfu Ultra, Pfu Turbo or Herculase DNA polymerase (Stratagene). The composition for the protocol of the Pfu Ultra, Pfu Turbo or Herculase DNA polymerase was as follows: 1× PCR buffer (Stratagene), 0.2 mM of each dNTP, 100 ng genomic DNA of *Saccharomyces cerevisiae* (strain S288C; Research Genetics, Inc., now Invitrogen), *Escherichia coli* (strain MG1655; *E. coli* Genetic Stock Center), *Synechocystis* sp. (strain PCC6803), *Azotobacter vinelandii* (strain N. R. Smith, 16), *Thermus thermophilus* (HB8) or 50 ng cDNA from various tissues and development stages of *Arabidopsis thaliana* (ecotype Columbia), *Physcomitrella patens, Glycine max* (variety Resnick), or *Zea mays* (variety B73, Mo17, A188), 50 pmol forward primer, 50 pmol reverse primer, with or without 1 M Betaine, 2.5 u Pfu Ultra, Pfu Turbo or Herculase DNA polymerase.

The amplification cycles were as follows:

1 cycle of 2-3 minutes at 94-95° C., then 25-36 cycles with 30-60 seconds at 94-95° C., 30-45 seconds at 50-60° C. and 210-480 seconds at 72° C., followed by 1 cycle of 5-10 minutes at 72° C., then 4-16° C.—preferably for *Saccharomyces cerevisiae, Escherichia coli, Synechocystis* sp., *Azotobacter vinelandii, Thermus thermophilus.*

In case of *Arabidopsis thaliana, Brassica napus, Glycine max, Oryza sativa, Physcomitrella patens, Zea mays* the amplification cycles were as follows:

1 cycle with 30 seconds at 94° C., 30 seconds at 61° C., 15 minutes at 72° C., then 2 cycles with 30 seconds at 94° C., 30 seconds at 60° C., 15 minutes at 72° C., then 3 cycles with 30 seconds at 94° C., 30 seconds at 59° C., 15 minutes at 72° C., then 4 cycles with 30 seconds at 94° C., 30 seconds at 58° C., 15 minutes at 72° C., then 25 cycles with 30 seconds at 94° C., 30 seconds at 57° C., 15 minutes at 72° C., then 1 cycle with 10 minutes at 72° C., then finally 4-16° C.

RNA were generated with the RNeasy Plant Kit according to the standard protocol (Qiagen) and Superscript II Reverse Transkriptase was used to produce double stranded cDNA according to the standard protocol (Invitrogen).

ORF specific primer pairs for the genes to be expressed are shown in table III, column 7. The following adapter sequences were added to *Saccharomyces cerevisiae* ORF specific primers (see table III) for cloning purposes:

```
                                              SEQ ID NO: 7
i)  forward primer:    5'-GGAATTCCAGCTGACCACC-3'

SEQ ID NO: 8
ii) reverse primer:    5'-GATCCCCGGGAATTGCCATG-3'
```

These adaptor sequences allow cloning of the ORF into the various vectors containing the Resgen adaptors, see table column E of table VII.

The following adapter sequences were added to *Saccharomyces cerevisiae, Escherichia coli, Synechocystis* sp., *Azotobacter vinelandii, Thermus thermophilus, Arabidopsis thaliana, Brassica napus, Glycine max, Oryza sativa, Physcomitrella patens,* or *Zea mays* ORF specific primers for cloning purposes:

```
iii)
forward primer:   5'-TTGCTCTTCC-3'   SEQ ID NO: 9 iiii)
reverse primer:   5'-TTGCTCTTCG-3'   SEQ ID NO: 10
```

The adaptor sequences allow cloning of the ORF into the various vectors containing the Colic adaptors, see table column E of table VII.

Therefore for amplification and cloning of *Saccharomyces cerevisiae* SEQ ID NO: 382, a primer consisting of the adaptor sequence i) and the ORF specific sequence SEQ ID NO: 398 and a second primer consisting of the adaptor sequence ii) and the ORF specific sequence SEQ ID NO: 399 were used.

For amplification and cloning of *Escherichia coli* SEQ ID NO: 38, a primer consisting of the adaptor sequence iii) and the ORF specific sequence SEQ ID NO: 136 and a second primer consisting of the adaptor sequence iiii) and the ORF specific sequence SEQ ID NO: 137 were used.

For amplification and cloning of *Synechocystis* sp. SEQ ID NO: 7591, a primer consisting of the adaptor sequence iii) and the ORF specific sequence SEQ ID NO: 7667 and a second primer consisting of the adaptor sequence iiii) and the ORF specific sequence SEQ ID NO: 7668 were used.

For amplification and cloning of *Arabidopsis thaliana* SEQ ID NO: 8563, a primer consisting of the adaptor sequence iii) and the ORF specific sequence SEQ ID NO: 8639 and a second primer consisting of the adaptor sequence iiii) and the ORF specific sequence SEQ ID NO: 8640 were used.

Following these examples every sequence disclosed in table I, preferably column 5, can be cloned by fusing the adaptor sequences to the respective specific primers sequences as disclosed in table III, column 7 using the respective vectors shown in Table VII.

TABLE VII

Overview of the different vectors used for cloning the ORFs and shows their SEQIDs (column A), their vector names (column B), the promotors they contain for expression of the ORFs (column C), the additional artificial targeting sequence column D), the adapter sequence (column E), the expression type conferred by the promoter mentioned in column B (column F) and the figure number (column G).

| A SeqID | B Vector Name | C Promoter Name | D Target Sequence | E Adapter Sequence | F Expression Type | G FIG. |
|---|---|---|---|---|---|---|
| 1 | VC-MME220-1 | Super | | Colic | non targeted constitutive expression preferentially in green tissues | 1a |
| 2 | VC-MME221-1 | PcUbi | | Colic | non targeted constitutive expression preferentially in green tissues | 2a |
| 3 | VC-MME354-1 | Super | FNR | Resgen | plastidic targeted constitutive expression preferentially in green tissues | 3a |
| 5 | VC-MME432-1 | Super | FNR | Colic | plastidic targeted constitutive expression preferentially in green tissues | 4a |
| 15 | VC-MME489-1p | Super | | Resgen | non targeted constitutive expression preferentially in green tissues | 5a |
| 16 | pMTX0270p | Super | | Colic | non targeted constitutive expression preferentially in green tissues | 6 |
| 6054 | pMTX155 | Big35S | | Resgen | non targeted constitutive expression preferentially in green tissues | 7 |
| 6055 | VC-MME354-1QCZ | Super | FNR | Resgen | plastidic targeted constitutive expression preferentially in green tissues | 3b |
| 6057 | VC-MME356-1QCZ | Super | IVD | Resgen | mitochondric targeted constitutive expression preferentially in green tissues | 8 |
| 6059 | VC-MME301-1QCZ | USP | | Resgen | non targeted expression preferentially in seeds | 9 |
| 6060 | pMTX461korrp | USP | FNR | Resgen | plastidic targeted expression preferentially in seeds | 10 |
| 6062 | VC-MME462-1QCZ | USP | IVD | Resgen | mitochondric targeted expression preferentially in seeds | 11 |
| 6064 | VC-MME220-1qcz | Super | | Colic | non targeted constitutive expression preferentially in green tissues | 1b |
| 6065 | VC-MME432-1qcz | Super | FNR | Colic | plastidic targeted constitutive expression preferentially in green tissues | 4b |
| 6067 | VC-MME431-1qcz | Super | IVD | Colic | mitochondric targeted constitutive expression preferentially in green tissues | 12 |
| 6069 | VC-MME221-1qcz | PcUbi | | Colic | non targeted constitutive expression preferentially in green tissues | 2b |
| 6070 | pMTX447korr | PcUbi | FNR | Colic | plastidic targeted constitutive expression preferentially in green tissues | 13 |
| 6072 | VC-MME445-1qcz | PcUbi | IVD | Colic | mitochondric targeted constitutive expression preferentially in green tissues | 14 |
| 6074 | VC-MME289-1qcz | USP | | Colic | non targeted expression preferentially in seeds | 15 |
| 6075 | VC-MME464-1qcz | USP | FNR | Colic | plastidic targeted expression preferentially in seeds | 16 |
| 6077 | VC-MME465-1qcz | USP | IVD | Colic | mitochondric targeted expression in preferentially seeds | 17 |
| 6079 | VC-MME489-1QCZ | Super | | Resgen | non targeted constitutive expression preferentially in green tissues | 5b |

Example 1b

Construction of Binary Vectors for Non-Targeted Expression of Proteins

"Non-targeted" expression in this context means, that no additional targeting sequence were added to the ORF to be expressed.

For non-targeted expression the binary vectors used for cloning were VC-MME220-1 SEQ ID NO 1 (FIG. 1a) and VC-MME220-1qcz SEQ ID NO 6064 (FIG. 1b) VC-MME221-1 SEQ ID NO 2 (FIG. 2a) and VC-MME221-1qcz SEQ ID NO 6069 (FIG. 2b), and VC-MME489-1p SEQ ID NO 15 (FIG. 5a) and VC-MME489-1QCZ SEQ ID NO: 6079 (FIG. 5b), respectively. The binary vectors used for cloning the targeting sequence were VC-MME489-1p SEQ ID NO 15 (FIG. 5a) and VC-MME489-1QCZ SEQ ID NO: 6079 (FIG. 5b), and pMTX0270p SEQ ID NO 16 (FIG. 6), respectively. Other useful binary vectors are known to the skilled worker; an overview of binary vectors and their use can be found in Hellens R., Mullineaux P. and Klee H., (Trends in Plant Science, 5 (10), 446 (2000)). Such vectors have to be equally equipped with appropriate promoters and targeting sequences.

Example 1c

Amplification of the plastidic targeting sequence of the gene FNR from *Spinacia oleracea* and construction of vector for plastid-targeted expression in preferential green tissues or preferential in seeds.

In order to amplify the targeting sequence of the FNR gene from *S. oleracea*, genomic DNA was extracted from leaves of 4 weeks old *S. oleracea* plants (DNeasy Plant Mini Kit, Qiagen, Hilden). The gDNA was used as the template for a PCR.

To enable cloning of the transit sequence into the vector VC-MME489-1 p, VC-MME489-1QCZ and VC-MME301-1QCZ an EcoRI restriction enzyme recognition sequence was added to both the forward and reverse primers, whereas for cloning in the vectors pMTX0270p, VC-MME220-1, VC-MME220-1qcz, VC-MME221-1, VC-MME221-1qcz and VC-MME289-1qcz a PmeI restriction enzyme recognition sequence was added to the forward primer and a NcoI site was added to the reverse primer.

```
FNR5EcoResgen
                                        SEQ ID NO: 11
ATA GAA TTC GCA TAA ACT TAT CTT CAT AGT TGC C FNR3EcoResgen
                                        SEQ ID NO: 12
ATA GAA TTC AGA GGC GAT CTG GGC CCT RNR5PmeColic
                                        SEQ ID NO: 13
ATA GTT TAA ACG CAT AAA CTT ATC TTC ATA GTT GCC FNR3NcoColic
                                        SEQ ID NO: 14
ATA CCA TGG AAG AGC AAG AGG CGA TCT GGG CCC T
```

The resulting sequence SEQ ID NO: 36 amplified from genomic spinach DNA, comprised a 5'UTR (bp 1-165), and the coding region (bp 166-273 and 351-419). The coding sequence is interrupted by an intronic sequence from by 274 to by 350:

```
                                        (SEQ ID NO: 36)
gcataaacttatcttcatagttgccactccaatttgctccttgaatctcc tccacccaatacataatccactcctccatcacccacttcactactaaatc aaacttaactctgttttctctctcctcctttcatttcttattcttccaa tcatcgtactccgccatgaccaccgctgtcaccgccgctgtttctttccc ctctaccaaaaccacctctctctccgcccgaagctcctccgtcatttccc ctgacaaaatcagctacaaaaaggtgattcccaatttcactgtgttttt attaataatttgttattttgatgatgagatgattaatttgggtgctgcag gttcctttgtactacaggaatgtatctgcaactgggaaaatgggaccat cagggcccagatcgcctct
```

The PCR fragment derived with the primers FNR5EcoResgen and FNR3EcoResgen was digested with EcoRI and ligated in the vectors VC-MME489-1p or VC-MME489-1QCZ and VC-MME301-1QCZ, that had also been digested with EcoRI. The correct orientation of the FNR targeting sequence was tested by sequencing. The vector generated in this ligation step were VC-MME354-1 or VC-MME354-1QCZ and pMTX461korrp, respectively.

The PCR fragment derived with the primers FNR5PmeColic and FNR3NcoColic was digested with PmeI and NcoI and ligated in the vectors pMTX0270p, VC-MME220-1 or VC-MME220-1qcz, VC-MME221-1 or VC-MME221-1qcz and VC-MME289-1qcz that had been digested with SmaI and NcoI. The vectors generated in this ligation step were VC-MME432-1 or VC-MME432-1qcz, VC-MME464-1qcz and pMTX447korr, respectively.

For plastidic-targeted constitutive expression in preferentially green tissues an artifical promoter A(ocs)3AmasPmas promoter (Super promotor)) (Ni et al., Plant Journal 7, 661 (1995), WO 95/14098) was used in context of the vector VC-MME354-1 or VC-MME354-1QCZ for ORFs from *Saccharomyces cerevisiae* and in context of the vector VC-MME432-1 or VC-MME432-1qcz for ORFs from *Escherichia coli*, resulting in each case in an "in-frame" fusion of the FNR targeting sequence with the ORFs.

For plastidic-targeted expression in preferentially seeds the USP promoter (Bäumlein et al., Mol Gen Genet. 225(3): 459-67 (1991)) was used in context of either the vector pMTX461 korrp for ORFs from *Saccharomyces cerevisiae* or in context of the vector VC-MME464-1qcz for ORFs from *Escherichia coli*, resulting in each case in an "in-frame" fusion of the FNR targeting sequence with the ORFs.

For plastidic-targeted constitutive expression in preferentially green tissues and seeds the PcUbi promoter was used in context of the vector pMTX447korr for ORFs from *Saccharomyces cerevisiae, Escherichia coli, Synechocystis* sp., *Azotobacter vinelandii, Thermus thermophilus, Arabidopsis thaliana, Brassica napus, Glycine max, Oryza sativa, Physcomitrella patens,* or *Zea mays*, resulting in each case in an "in-frame" fusion of the FNR targeting sequence with the ORFs.

Example 1d

Construction of Binary Vectors for Mitochondric-Targeted Expression of Proteins Amplification of the mitochondrial targeting sequence of the gene IVD from *Arabidopsis thaliana* and construction of vector for mitochondrial-targeted expression in preferential green tissues or preferential in seeds.

In order to amplify the targeting sequence of the IVD gene from *A. thaliana*, genomic DNA was extracted from leaves of *A. thaliana* plants (DNeasy Plant Mini Kit, Qiagen, Hilden). The gDNA was used as the template for a PCR.

To enable cloning of the transit sequence into the vectors VC-MME489-1QCZ and VC-MME301-1QCZ an EcoRI restriction enzyme recognition sequence was added to both the forward and reverse primers, whereas for cloning in the vectors VC-MME220-1qcz, VC-MME221-1qcz and VC-MME289-1qcz a PmeI restriction enzyme recognition sequence was added to the forward primer and a NcoI site was added to the reverse primer.

```
                                         SEQ ID NO: 6080
IVD5EcoResgen ATA GAA TTC ATG CAG AGG TTT TTC
              TCC GC SEQ ID NO: 6081
IVD5EcoResgen ATAg AAT TCC gAA gAA CgA gAA gAg AAA
              g SEQ ID NO: 6082
IVD5PmeColic  ATA GTT TAA ACA TGC AGA GGT TTT TCT
              CCG C SEQ ID NO: 6083
IVD3NcoColic  ATA CCA TGG AAG AGC AAA GGA GAG ACG
              AAG AAC GAG
```

The resulting sequence (SEQ ID NO: 6084) amplified from genomic *A. thaliana* DNA with IVD5EcoResgen and IVD3EcoResgen comprised 81 bp:

```
                                         SEQ ID NO: 6084
atgcagaggttttctccgccagatcgattctcggttacgccgtcaagacg cggaggaggtctttctcttctcgttcttcg
```

The resulting sequence (SEQ ID NO: 6085) amplified from genomic *A. thaliana* DNA with IVD5PmeColic and IVD3NcoColic comprised 89 bp:

```
                                         SEQ ID NO: 6085
atgcagaggttttctccgccagatcgattctcggttacgccgtcaagac gcggaggaggtctttctcttctcgttcttcgtctctcct
```

The PCR fragment derived with the primers IVD5EcoResgen and IVD3EcoResgen was digested with EcoRI and ligated in the vectors VC-MME489-1QCZ and VC-MME301-1QCZ that had also been digested with EcoRI. The correct orientation of the IVD targeting sequence was tested by sequencing. The vectors generated in this ligation step were VC-MME356-1QCZ and VC-MME462-1QCZ, respectively.

The PCR fragment derived with the primers IVD5PmeColic and IVD3NcoColic was digested with PmeI and NcoI and ligated in the vectors VC-MME220-1qcz, VC-MME221-1qcz and VC-MME289-1qcz that had been digested with SmaI and NcoI. The vectors generated in this ligation step were VC-MME431-1qcz, VC-MME465-1qcz and VC-MME445-1qcz, respectively. For mitochondrial-targeted constitutive expression in preferentially green tissues an artifical promoter A(ocs)3AmasPmas promoter (Super promoter) (Ni et al., Plant Journal 7, 661 (1995), WO 95/14098) was used in context of the vector VC-MME356-1QCZ for ORFs from *Saccharomyces cerevisiae* and in context of the vector VC-MME431-1qcz for ORFs from *Escherichia coli*, resulting in each case in an "in-frame" fusion between the IVD sequence and the respective ORFs.

For mitochondrial-targeted constitutive expression in preferentially seeds the USP promoter (Bäumlein et al., Mol Gen Genet. 225(3):459-67 (1991)) was used in context of the vector VC-MME462-1QCZ for ORFs from *Saccharomyces cerevisiae* and in context of the vector VC-MME465-1qcz for ORFs from *Escherichia coli*, resulting in each case in an "in-frame" fusion between the IVD sequence and the respective ORFs.

For mitochondrial-targeted constitutive expression in preferentially green tissues and seeds the PcUbi promoter was used in context of the vector VC-MME445-1qcz for ORFs from *Saccharomyces cerevisiae*, *Escherichia coli*, *Synechocystis* sp., *Azotobacter vinelandii*, *Thermus thermophilus*, *Arabidopsis thaliana*, *Brassica napus*, *Glycine max*, *Oryza sativa*, *Physcomitrella patens*, or *Zea mays*, resulting in each case in an "in-frame" fusion between the IVD sequence and the respective ORFs.

Other useful binary vectors are known to the skilled worker; an overview of binary vectors and their use can be found in Hellens R., Mullineaux P. and Klee H., (Trends in Plant Science, 5 (10), 446 (2000)). Such vectors have to be equally equipped with appropriate promoters and targeting sequences.

Example 1e

Cloning of inventive sequences as shown in table I, column 5 and 7 in the different expression vectors.

For cloning the ORFs of SEQ ID NO: 382, from *S. cerevisiae* into vectors containing the Resgen adaptor sequence the respective vector DNA was treated with the restriction enzyme NcoI. For cloning of ORFs from *Saccharomyces cerevisiae* into vectors containing the Colic adaptor sequence, the respective vector DNA was treated with the restriction enzymes PacI and NcoI following the standard protocol (MBI Fermentas). For cloning of ORFs from *Escherichia coli*, *Synechocystis* sp., *Azotobacter vinelandii*, *Thermus thermophilus*, *Arabidopsis thaliana*, *Brassica napus*, *Glycine max*, *Oryza sativa*, *Physcomitrella patens*, or *Zea mays* the vector DNA was treated with the restriction enzymes PacI and NcoI following the standard protocol (MBI Fermentas). In all cases the reaction was stopped by inactivation at 70° C. for 20 minutes and purified over QIAquick or NucleoSpin Extract II columns following the standard protocol (Qiagen or Macherey-Nagel).

Then the PCR-product representing the amplified ORF with the respective adapter sequences and the vector DNA were treated with T4 DNA polymerase according to the standard protocol (MBI Fermentas) to produce single stranded overhangs with the parameters 1 unit T4 DNA polymerase at 37° C. for 2-10 minutes for the vector and 1-2 u T4 DNA polymerase at 15-17° C. for 10-60 minutes for the PCR product representing SEQ ID NO: 382.

The reaction was stopped by addition of high-salt buffer and purified over QIAquick or Nucleo-Spin Extract II columns following the standard protocol (Qiagen or Macherey-Nagel).

According to this example the skilled person is able to clone all sequences disclosed in table I, preferably column 5.

Approximately 30-60 ng of prepared vector and a defined amount of prepared amplificate were mixed and hybridized at 65° C. for 15 minutes followed by 37° C. 0.1° C./1 seconds, followed by 37° C. 10 minutes, followed by 0.1° C./1 seconds, then 4-10° C.

The ligated constructs were transformed in the same reaction vessel by addition of competent E. coli cells (strain DH5alpha) and incubation for 20 minutes at 1° C. followed by a heat shock for 90 seconds at 42° C. and cooling to 1-4° C. Then, complete medium (SOC) was added and the mixture was incubated for 45 minutes at 37° C. The entire mixture was subsequently plated onto an agar plate with 0.05 mg/ml kanamycin and incubated overnight at 37° C.

The outcome of the cloning step was verified by amplification with the aid of primers which bind upstream and downstream of the integration site, thus allowing the amplification of the insertion. The amplifications were carried out as described in the protocol of Taq DNA polymerase (Gibco-BRL).

The amplification cycles were as follows:

1 cycle of 1-5 minutes at 94° C., followed by 35 cycles of in each case 15-60 seconds at 94° C., 15-60 seconds at 50-66° C. and 5-15 minutes at 72° C., followed by 1 cycle of 10 minutes at 72° C., then 4-16° C.

Several colonies were checked, but only one colony for which a PCR product of the expected size was detected was used in the following steps.

A portion of this positive colony was transferred into a reaction vessel filled with complete medium (LB) supplemented with kanamycin and incubated overnight at 37° C.

The plasmid preparation was carried out as specified in the Qiaprep or NucleoSpin Multi-96 Plus standard protocol (Qiagen or Macherey-Nagel).

Generation of transgenic plants which express SEQ ID NO: 382 or any other sequence disclosed in table I, preferably column 5

1-5 ng of the plasmid DNA isolated was transformed by electroporation or transformation into competent cells of Agrobacterium tumefaciens, of strain GV 3101 pMP90 (Koncz and Schell, Mol. Gen. Gent. 204, 383 (1986)). Thereafter, complete medium (YEP) was added and the mixture was transferred into a fresh reaction vessel for 3 hours at 28° C. Thereafter, all of the reaction mixture was plated onto YEP agar plates supplemented with the respective antibiotics, e.g. rifampicine (0.1 mg/ml), gentamycine (0.025 mg/ml and kanamycin (0.05 mg/ml) and incubated for 48 hours at 28° C.

The agrobacteria that contains the plasmid construct were then used for the transformation of plants.

A colony was picked from the agar plate with the aid of a pipette tip and taken up in 3 ml of liquid TB medium, which also contained suitable antibiotics as described above. The preculture was grown for 48 hours at 28° C. and 120 rpm.

400 ml of LB medium containing the same antibiotics as above were used for the main culture. The preculture was transferred into the main culture. It was grown for 18 hours at 28° C. and 120 rpm. After centrifugation at 4 000 rpm, the pellet was re-suspended in infiltration medium (MS medium, 10% sucrose).

In order to grow the plants for the transformation, dishes (Piki Saat 80, green, provided with a screen bottom, 30×20×4.5 cm, from Wiesauplast, Kunststofftechnik, Germany) were half-filled with a GS 90 substrate (standard soil, Werkverband E. V., Germany). The dishes were watered overnight with 0.05% Proplant solution (Chimac-Apriphar, Belgium). A. thaliana C24 seeds (Nottingham Arabidopsis Stock Centre, UK; NASC Stock N906) were scattered over the dish, approximately 1 000 seeds per dish. The dishes were covered with a hood and placed in the stratification facility (8 h, 110 μmol/m²s¹, 22° C.; 16 h, dark, 6° C.). After 5 days, the dishes were placed into the short-day controlled environment chamber (8 h, 130 μmol/m²s¹, 22° C.; 16 h, dark, 20° C.), where they remained for approximately 10 days until the first true leaves had formed.

The seedlings were transferred into pots containing the same substrate (Teku pots, 7 cm, LC series, manufactured by Poppelmann GmbH & Co, Germany). Five plants were pricked out into each pot. The pots were then returned into the short-day controlled environment chamber for the plant to continue growing.

After 10 days, the plants were transferred into the greenhouse cabinet (supplementary illumination, 16 h, 340 μE/m²s, 22° C.; 8 h, dark, 20° C.), where they were allowed to grow for further 17 days.

For the transformation, 6-week-old Arabidopsis plants, which had just started flowering were immersed for 10 seconds into the above-described agrobacterial suspension which had previously been treated with 10 μl Silwett L77 (Crompton S. A., Osi Specialties, Switzerland). The method in question is described by Clough J. C. and Bent A. F. (Plant J. 16, 735 (1998)).

The plants were subsequently placed for 18 hours into a humid chamber. Thereafter, the pots were returned to the greenhouse for the plants to continue growing. The plants remained in the greenhouse for another 10 weeks until the seeds were ready for harvesting.

Depending on the tolerance marker used for the selection of the transformed plants the harvested seeds were planted in the greenhouse and subjected to a spray selection or else first sterilized and then grown on agar plates supplemented with the respective selection agent. Since the vector contained the bar gene as the tolerance marker, plantlets were sprayed four times at an interval of 2 to 3 days with 0.02% BASTA® and transformed plants were allowed to set seeds.

The seeds of the transgenic A. thaliana plants were stored in the freezer (at −20° C.).

Plant Screening (Arabidopsis) for growth under limited nitrogen supply Two different procedures were used for screening:

—Procedure 1). Per transgenic construct 4 independent transgenic lines (=events) were tested (22-28 plants per construct). Arabidopsis thaliana seeds are sown in pots containing a 1:1 (v:v) mixture of nutrient depleted soil ("Einheitserde Typ 0", 30% clay, Tantau, Wansdorf Germany) and sand. Germination is induced by a four day period at 4° C., in the dark. Subsequently the plants are grown under standard growth conditions (photoperiod of 16 h light and 8 h dark, 20° C., 60% relative humidity, and a photon flux density of 200 μE). The plants are grown and cultured, inter alia they are watered every second day with a N-depleted nutrient solution. The N-depleted nutrient solution e.g. contains beneath water

| mineral nutrient | final concentration |
| --- | --- |
| KCl | 3.00 mM |
| $MgSO_4 \times 7H_2O$ | 0.5 mM |
| $CaCl_2 \times 6H_2O$ | 1.5 mM |
| $K_2SO_4$ | 1.5 mM |
| $NaH_2PO_4$ | 1.5 mM |
| Fe-EDTA | 40 μM |
| $H_3BO_3$ | 25 μM |
| $MnSO_4 \times H_2O$ | 1 μM |
| $ZnSO_4 \times 7H_2O$ | 0.5 μM |
| $Cu_2SO_4 \times 5H_2O$ | 0.3 μM |
| $Na_2MoO_4 \times 2H_2O$ | 0.05 μM |

After 9 to 10 days the plants are individualized. After a total time of 28 to 31 days the plants are harvested and rated by the fresh weight of the aerial parts of the plants. The biomass increase has been measured as ratio of the fresh weight of the aerial parts of the respective transgenic plant and the non-transgenic wild type plant.

—Procedure 2). For screening of transgenic plants a specific culture facility was used. For high-throughput purposes plants were screened for biomass production on agar plates with limited supply of nitrogen (adapted from Estelle and Somerville, 1987). This screening pipeline consists of two level. Transgenic lines are subjected to subsequent level if biomass production was significantly improved in comparison to wild type plants. With each level number of replicates and statistical stringency was increased.

For the sowing, the seeds were removed from the Eppendorf tubes with the aid of a toothpick and transferred onto the above-mentioned agar plates, with limited supply of nitrogen (0.05 mM $KNO_3$). In total, approximately 15-30 seeds were distributed horizontally on each plate (1×12 cm).

After the seeds had been sown, plates are subjected to stratification for 2-4 days in the dark at 4° C. After the stratification, the test plants were grown for 22 to 25 days at a 16-h-light, 8-h-dark rhythm at 20° C., an atmospheric humidity of 60% and a $CO_2$ concentration of approximately 400 ppm. The light sources used generate a light resembling the solar color spectrum with a light intensity of approximately 100 $\mu E/m^2 s$. After 10 to 11 days the plants are individualized. Improved growth under nitrogen limited conditions was assessed by biomass production of shoots and roots of transgenic plants in comparison to wild type control plants after 20-25 days growth. Transgenic lines showing a significant improved biomass production in comparison to wild type plants are subjected to following experiment of the subsequent level on soil as described in procedure 1, however, 3-6 lines per construct were tested (up to 60 plants per construct).

Biomass production of transgenic *Arabidopsis thaliana* grown under limited nitrogen supply is shown in Table VIIIa: Biomass production was measured by weighing plant rosettes. Biomass increase was calculated as ratio of average weight for transgenic plants compared to average weight of wild type control plants from the same experiment. The mean biomass increase of transgenic constructs is given (significance value <0.3 and biomass increase >5% (ratio >1.05))

TABLE VIII-A (NUE)

| SeqID | Target | Locus | Biomass Increase |
|---|---|---|---|
| 38 | cytoplasmic | B0414 | 1.610 |
| 147 | cytoplasmic | B2931 | 1.209 |
| 172 | cytoplasmic | B3945 | 1.457 |
| 382 | cytoplasmic | Yel004w | 1.370 |
| 917 | cytoplasmic | Yhr204w | 1.469 |
| 952 | cytoplasmic | Yll053c | 1.525 |
| 1320 | cytoplasmic | Yml123c | 1.597 |
| 1648 | cytoplasmic | Ynl142w | 1.593 |
| 2081 | cytoplasmic | Ypr035w | 1.237 |
| 2406 | plastidic | B0903 | 1.397 |
| 2841 | plastidic | B2704 | 1.140 |
| 3978 | plastidic | Ydr142c | 1.305 |
| 4051 | plastidic | Ygr289c | 1.256 |
| 4495 | cytoplasmic | Yil053w | 1.498 |
| 4622 | cytoplasmic | Ylr027c | 1.172 |
| 5070 | cytoplasmic | Yml079w | 1.057 |
| 5159 | cytoplasmic | Yol058w | 1.172 |
| 5746 | cytoplasmic | Ypl180w | 1.169 |
| 6581 | cytoplasmic | B1906 | 1.321 |
| 6609 | cytoplasmic | B2371 | 1.261 |
| 6949 | cytoplasmic | B2881 | 1.202 |
| 7078 | cytoplasmic | B3106 | 1.533 |
| 7467 | cytoplasmic | B3410 | 1.286 |

TABLE VIII-A-continued (NUE)

| SeqID | Target | Locus | Biomass Increase |
|---|---|---|---|
| 7492 | plastidic | B4209 | 1.232 |
| 7591 | cytoplasmic | SLL1545 | 1.406 |
| 7670 | Mitochondric | SLR1348 | 1.268 |
| 8648 | plastidic | B1600 | 1.616 |
| 8760 | plastidic | B1900 | 1.318 |
| 8861 | cytoplasmic | SLL0099 | 1.582 |
| 9046 | cytoplasmic | SLL0383 | 1.432 |
| 9307 | cytoplasmic | SLR1520 | 1.441 |
| 9479 | cytoplasmic | YDR147W | 1.117 |
| 9553 | plastidic | YPL148C | 1.226 |
| 10404 | plastidic | B1008 | 1.166 |
| 10591 | plastidic | B3347 | 1.339 |
| 11501 | cytoplasmic | YHR176W | 1.330 |
| 11564 | cytoplasmic | B2881_2 | 1.202 |
| 11695 | cytoplasmic | B3945_2 | 1.457 |
| 11907 | cytoplasmic | Yhr204w_2 | 1.469 |
| 11944 | cytoplasmic | Ynl142w_2 | 1.593 |
| 12357 | cytoplasmic | Yol058w_2 | 1.172 (cytoplasmic) |
| 12936 | cytoplasmic | Ypr035w_2 | 1.237 |

Plant Screening for Growth Under Low Temperature Conditions

In a standard experiment soil was prepared as 3.5:1 (v/v) mixture of nutrient rich soil (GS90, Tantau, Wansdorf, Germany) and sand. Pots were filled with soil mixture and placed into trays. Water was added to the trays to let the soil mixture take up appropriate amount of water for the sowing procedure. The seeds for transgenic *A. thaliana* plants were sown in pots (6 cm diameter). Pots were collected until they filled a tray for the growth chamber. Then the filled tray was covered with a transparent lid and transferred into the shelf system of the precooled (4° C.-5° C.) growth chamber. Stratification was established for a period of 2-3 days in the dark at 4° C.-5° C. Germination of seeds and growth was initiated at a growth condition of 20° C., 60% relative humidity, 16 h photoperiod and illumination with fluorescent light at 200 $\mu mol/m2\ s$. Covers were removed 7 days after sowing. BASTA selection was done at day 9 after sowing by spraying pots with plantlets from the top. Therefore, a 0.07% (v/v) solution of BASTA concentrate (183 g/l glufosinate-ammonium) in tap water was sprayed. Transgenic events and wildtype control plants were distributed randomly over the chamber. The location of the trays inside the chambers was changed on working days from day 7 after sowing. Watering was carried out every two days after covers were removed from the trays. Plants were individualized 12-13 days after sowing by removing the surplus of seedlings leaving one seedling in a pot. Cold (chilling to 11° C.-12° C.) was applied 14 days after sowing until the end of the experiment. For measuring biomass performance, plant fresh weight was determined at harvest time (29-30 days after sowing) by cutting shoots and weighing them. Beside weighing, phenotypic information was added in case of plants that differ from the wild type control. Plants were in the stage prior to flowering and prior to growth of inflorescence when harvested. Significance values for the statistical significance of the biomass changes were calculated by applying the 'student's' t test (parameters: two-sided, unequal variance).

Three successive experiments were conducted. In the first experiment, one individual of each transformed line was tested.

In the second experiment, the event that had been determined as chilling tolerant or resistant in the first experiment, i.e. showed increased yield, in this case increased biomass production, in comparison to wild type, were put through a confirmation screen according to the same experimental procedures. In this experiment, max. 10 plants of each tolerant or resistant event were grown, treated and measured as before.

In the first two experiments, chilling tolerance or tolerance and biomass production was compared to wild type plants.

In the third experiment up to 20 replicates of each confirmed tolerant event, i.e. those that had been scored as tolerant or resistant in the second experiment, were grown, treated and scored as before. The results thereof are summarized in table VIII.

Table VIIIB: Biomass Production of Transgenic *A. Thaliana* after Imposition of Chilling Stress.

Biomass production was measured by weighing plant rosettes. Biomass increase was calculated as ratio of average weight for trangenic plants compared to average weight of wild type control plants. The minimum and maximum biomass increase seen within the group of transgenic events is given for a locus with all events showing a significance value <0.1 and a biomass increase >1.1.

TABLE VIII-B (LT with min/max values)

| SeqID | Target | Locus | Biomass Increase min | Biomass Increase max |
|---|---|---|---|---|
| 38 | cytoplasmic | B0414 | 1.334 | 1.361 |
| 147 | cytoplasmic | B2931 | 1.209 | 1.357 |
| 172 | cytoplasmic | B3945 | 1.192 | 1.353 |
| 382 | cytoplasmic | Yel004w | 1.368 | 1.575 |
| 406 | cytoplasmic | Yer177w | 1.222 | 1.300 |
| 917 | cytoplasmic | Yhr204w | 1.383 | 1.697 |
| 952 | cytoplasmic | Yll053c | 1.302 | 1.353 |
| 1320 | cytoplasmic | Yml123c | 1.311 | 1.405 |
| 1648 | cytoplasmic | Ynl142w | 1.380 | 1.808 |
| 2065 | cytoplasmic | Ynr040w | 1.276 | 1.390 |
| 2081 | cytoplasmic | Ypr035w | 1.370 | 1.451 |
| 2406 | plastidic | B0903 | 1.326 | 1.391 |
| 2564 | cytoplasmic | B1393 | 1.186 | 1.224 |
| 2841 | plastidic | B2704 | 1.233 | 1.462 |
| 2879 | cytoplasmic | B2905 | 1.246 | 1.289 |
| 3109 | plastidic | B3206 | 1.193 | 1.304 |
| 3403 | cytoplasmic | B3659 | 1.325 | 1.696 |
| 3441 | cytoplasmic | B3871 | 1.233 | 1.611 |
| 3978 | plastidic | Ydr142c | 1.205 | 1.274 |
| 4047 | cytoplasmic | Yer175w-a | 1.502 | 2.340 |
| 4051 | plastidic | Ygr289c | 1.218 | 1.271 |
| 4131 | plastidic | Yhr044c | 1.215 | 1.215 |
| 4217 | cytoplasmic | YHR072W | 1.387 | 1.387 |
| 4491 | cytoplasmic | Yhr213w-a | 1.284 | 1.570 |
| 4495 | cytoplasmic | Yil053w | 1.463 | 1.523 |
| 4558 | plastidic | Yjl103c | 1.269 | 1.296 |
| 4589 | plastidic | Yjl137c | 1.395 | 1.48 |
| 4622 | cytoplasmic | Ylr027c | 1.342 | 1.848 |
| 5070 | plastidic | Yml079w | 1.296 | 1.331 |
| 5102 | plastidic | Ymr157c | 1.190 | 1.267 |
| 5115 | plastidic | Ynl024c | 1.191 | 1.376 |
| 5159 | plastidic | Yol058w | 1.235 | 1.300 |
| 5746 | cytoplasmic | Ypl180w | 1.247 | 2.471 |
| 5756 | plastidic | Ypr167c | 1.295 | 1.303 |
| 6086 | plastidic | B0036 | 1.220 | 1.336 |
| 6581 | cytoplasmic | B1906 | 1.137 | 1.290 |
| 6609 | cytoplasmic | B2371 | 1.207 | 1.328 |
| 6949 | cytoplasmic | B2881 | 1.157 | 1.230 |
| 7078 | cytoplasmic | B3106 | 1.241 | 1.381 |
| 7270 | plastidic | B3400 | 1.176 | 1.394 |
| 7467 | cytoplasmic | B3410 | 1.168 | 1.420 |
| 7492 | plastidic | B4209 | 1.112 | 1.489 |
| 7591 | cytoplasmic | SLL1545 | 1.248 | 1.293 |
| 7670 | Mitochondric | SLR1348 | 1.349 | 1.413 |
| 8236 | plastidic | YGR191W | 1.159 | 1.298 |
| 8563 | cytoplasmic | AT1G22920 | 1.149 | 1.610 |
| 8648 | plastidic | B1600 | 1.276 | 1.293 |
| 8760 | plastidic | B1900 | 1.264 | 1.341 |
| 8861 | cytoplasmic | SLL0099 | 1.199 | 1.310 |
| 9046 | cytoplasmic | SLL0383 | 1.158 | 1.415 |
| 9280 | cytoplasmic | SLR1094 | 1.122 | 1.352 |
| 9307 | cytoplasmic | SLR1520 | 1.284 | 1.361 |
| 9430 | cytoplasmic | YDL142C | 1.187 | 1.503 |
| 9479 | cytoplasmic | YDR147W | 1.142 | 1.167 |
| 9500 | plastidic | YLR284C | 1.150 | 1.306 |
| 9553 | plastidic | YPL148C | 1.127 | 1.276 |
| 9574 | plastidic | YPR074C | 1.222 | 1.287 |
| 10404 | plastidic | B1008 | 1.512 | 1.585 |
| 10503 | plastidic | B1529 | 1.119 | 1.426 |
| 10591 | plastidic | B3347 | 1.136 | 1.480 |
| 10934 | cytoplasmic | YBR176W | 1.132 | 1.429 |
| 11461 | cytoplasmic | YGR177C | 1.229 | 1.416 |
| 11501 | cytoplasmic | YHR176W | 1.167 | 1.621 |
| 11564 | cytoplasmic | B2881_2 | 1.157 | 1.230 |
| 11695 | cytoplasmic | B3945_2 | 1.192 | 1.353 |
| 11907 | cytoplasmic | Yhr204w_2 | 1.383 | 1.697 |
| 11944 | cytoplasmic | Ynl142w_2 | 1.380 | 1.808 |
| 12357 | plastidic | Yol058w_2 | 1.235 | 1.300 |
| 12936 | cytoplasmic | Ypr035w_2 | 1.370 | 1.451 |

Plant Screening for Growth Under Cycling Drought Conditions

In the cycling drought assay repetitive stress is applied to plants without leading to desiccation. In a standard experiment soil is prepared as 1:1 (v/v) mixture of nutrient rich soil (GS90, Tantau, Wansdorf, Germany) and quarz sand. Pots (6 cm diameter) were filled with this mixture and placed into trays. Water was added to the trays to let the soil mixture take up appropriate amount of water for the sowing procedure (day 1) and subsequently seeds of transgenic *A. thaliana* plants and their wild-type controls were sown in pots. Then the filled tray was covered with a transparent lid and transferred into a precooled (4° C.-5° C.) and darkened growth chamber. Stratification was established for a period of 3 days in the dark at 4° C.-5° C. or, alternatively, for 4 days in the dark at 4° C. Germination of seeds and growth was initiated at a growth condition of 20° C., 60% relative humidity, 16 h photoperiod and illumination with fluorescent light at approximately 200 μmol/m2 s. Covers were removed 7-8 days after sowing. BASTA selection was done at day 10 or day 11 (9 or 10 days after sowing) by spraying pots with plantlets from the top. In the standard experiment, a 0.07% (v/v) solution of BASTA concentrate (183 g/l glufosinate-ammonium) in tap water was sprayed once or, alternatively, a 0.02% (v/v) solution of BASTA was sprayed three times. The wild-type control plants were sprayed with tap water only (instead of spraying with BASTA dissolved in tap water) but were otherwise treated identically. Plants were individualized 13-14 days after sowing by removing the surplus of seedlings and leaving one seedling in soil. Transgenic events and wild-type control plants were evenly distributed over the chamber.

The water supply throughout the experiment was limited and plants were subjected to cycles of drought and re-watering. Watering was carried out at day 1 (before sowing), day 14 or day 15, day 21 or day 22, and, finally, day 27 or day 28. For measuring biomass production, plant fresh weight was determined one day after the final watering (day 28 or day 29) by cutting shoots and weighing them. Besides weighing, phenotypic information was added in case of plants that differ from the wild type control. Plants were in the stage prior to flowering and prior to growth of inflorescence when harvested. Significance values for the statistical significance of the biomass changes were calculated by applying the 'student's' t test (parameters: two-sided, unequal variance).

Up to five lines (events) per transgenic construct were tested in successive experimental levels (up to 4). Only constructs that displayed positive performance were subjected to the next experimental level. Usually in the first level five plants per construct were tested and in the subsequent levels 30-60 plants were tested. Biomass performance was evaluated as described above. Data are shown for constructs that displayed increased biomass performance in at least two successive experimental levels.

Biomass production of transgenic *A. thaliana* developed under cycling drought growth conditions is shown in Table VIIIc: Biomass production was measured by weighing plant rosettes. Biomass increase was calculated as ratio of average weight for transgenic plants compared to average weight of wild type control plants from the same experiment. The mean biomass increase of transgenic constructs is given (significance value <0.3 and biomass increase >5% (ratio >1.05)).

TABLE VIII-C (CD)

| SeqID | Target | Locus | Biomass Increase |
|---|---|---|---|
| 2065 | cytoplasmic | Ynr040w | 1.496 |
| 2406 | plastidic | B0903 | 1.276 |
| 2564 | cytoplasmic | B1393 | 1.244 |
| 2841 | plastidic | B2704 | 1.192 |
| 2879 | cytoplasmic | B2905 | 1.233 |
| 3403 | cytoplasmic | B3659 | 1.128 |
| 4051 | plastidic | Ygr289c | 1.324 |

Plant screening for yield increase under standardized growth conditions In this experiment, a plant screening for yield increase (in this case: biomass yield increase) under standardised growth conditions in the absence of substantial abiotic stress has been performed. In a standard experiment soil is prepared as 3.5:1 (v/v) mixture of nutrient rich soil (GS90, Tantau, Wansdorf, Germany) and quarz sand. Alternatively, plants were sown on nutrient rich soil (GS90, Tantau, Germany). Pots were filled with soil mixture and placed into trays. Water was added to the trays to let the soil mixture take up appropriate amount of water for the sowing procedure. The seeds for transgenic *A. thaliana* plants and their non-trangenic wild-type controls were sown in pots (6 cm diameter). Then the filled tray was covered with a transparent lid and transferred into a precooled (4° C.-5° C.) and darkened growth chamber. Stratification was established for a period of 3-4 days in the dark at 4° C.-5° C. Germination of seeds and growth was initiated at a growth condition of 20° C., 60% relative humidity, 16 h photoperiod and illumination with fluorescent light at approximately 200 µmol/m2 s. Covers were removed 7-8 days after sowing. BASTA selection was done at day 10 or day 11 (9 or 10 days after sowing) by spraying pots with plantlets from the top. In the standard experiment, a 0.07% (v/v) solution of BASTA concentrate (183 g/l glufosinate-ammonium) in tap water was sprayed once or, alternatively, a 0.02% (v/v) solution of BASTA was sprayed three times. The wild-type control plants were sprayed with tap water only (instead of spraying with BASTA dissolved in tap water) but were otherwise treated identically. Plants were individualized 13-14 days after sowing by removing the surplus of seedlings and leaving one seedling in soil. Transgenic events and wild-type control plants were evenly distributed over the chamber.

Watering was carried out every two days after removing the covers in a standard experiment or, alternatively, every day. For measuring biomass performance, plant fresh weight was determined at harvest time (24-29 days after sowing) by cutting shoots and weighing them. Plants were in the stage prior to flowering and prior to growth of inflorescence when harvested. Transgenic plants were compared to the non-transgenic wild-type control plants. Significance values for the statistical significance of the biomass changes were calculated by applying the 'student's' t test (parameters: two-sided, unequal variance).

Two different types of experimental procedures were performed:

—Procedure 1). Per transgenic construct 3-4 independent transgenic lines (=events) were tested (22-30 plants per construct) and biomass performance was evaluated as described above.

—Procedure 2.) Up to five lines per transgenic construct were tested in successive experimental levels (up to 4). Only constructs that displayed positive performance were subjected to the next experimental level. Usually in the first level five plants per construct were tested and in the subsequent levels 30-60 plants were tested. Biomass performance was evaluated as described above. Data from this type of experiment (Procedure 2) are shown for constructs that displayed increased biomass performance in at least two successive experimental levels.

Biomass production of transgenic *A. thaliana* grown under standardised growth conditions is shown in Table VIIId: Biomass production was measured by weighing plant rosettes. Biomass increase was calculated as ratio of average weight of transgenic plants compared to average weight of wild-type control plants from the same experiment. The mean biomass increase of transgenic constructs is given (significance value <0.3 and biomass increase >5% (ratio >1.05)).

TABLE VIII-D (BM)

| SeqID | Target | Locus | Biomass Increase |
|---|---|---|---|
| 38 | cytoplasmic | B0414 | 1.168 |
| 147 | cytoplasmic | B2931 | 1.088 |
| 172 | cytoplasmic | B3945 | 1.191 |
| 382 | cytoplasmic | Yel004w | 1.306 |
| 406 | cytoplasmic | Yer177w | 1.340 |
| 917 | cytoplasmic | Yhr204w | 1.369 |
| 952 | cytoplasmic | Yll053c | 1.162 |
| 1320 | cytoplasmic | Yml123c | 1.327 |
| 1648 | cytoplasmic | Ynl142w | 1.214 |
| 2065 | cytoplasmic | Ynr040w | 1.069 |
| 2081 | cytoplasmic | Ypr035w | 1.236 |
| 2406 | plastidic | B0903 | 1.260 |
| 2406 | cytoplasmic | B0903 | 1.286 |
| 2841 | plastidic | B2704 | 1.133 |
| 2879 | cytoplasmic | B2905 | 1.104 |
| 3109 | plastidic | B3206 | 1.160 |
| 3403 | cytoplasmic | B3659 | 1.435 |
| 3978 | plastidic | Ydr142c | 1.476 |
| 4047 | cytoplasmic | Yer175w-a | 1.370 |
| 4051 | plastidic | Ygr289c | 1.398 |
| 4491 | cytoplasmic | Yhr213w-a | 1.407 |
| 4495 | cytoplasmic | Yil053w | 1.383 |
| 4558 | plastidic | Yjl103c | 1.175 |
| 4589 | plastidic | Yjl137c | 1.065 |
| 4622 | cytoplasmic | Ylr027c | 1.329 |
| 5070 | plastidic | Yml079w | 1.066 |
| 5102 | plastidic | Ymr157c | 1.211 |
| 5115 | plastidic | Ynl024c | 1.068 |
| 5159 | plastidic | Yol058w | 1.091 |
| 5746 | cytoplasmic | Ypl180w | 1.326 |
| 5756 | plastidic | Ypr167c | 1.219 |
| 6086 | plastidic | B0036 | 1.117 |
| 6581 | cytoplasmic | B1906 | 1.092 |
| 6609 | cytoplasmic | B2371 | 1.121 |
| 6949 | cytoplasmic | B2881 | 1.074 |
| 7078 | cytoplasmic | B3106 | 1.082 |

TABLE VIII-D-continued (BM)

| SeqID | Target | Locus | Biomass Increase |
|---|---|---|---|
| 7270 | plastidic | B3400 | 1.191 |
| 7467 | cytoplasmic | B3410 | 1.167 |
| 7492 | plastidic | B4209 | 1.137 |
| 7591 | cytoplasmic | SLL1545 | 1.208 |
| 7670 | Mitochondric | SLR1348 | 1.376 |
| 8236 | plastidic | YGR191W | 1.156 |
| 8563 | cytoplasmic | AT1G22920 | 1.385 |
| 8648 | plastidic | B1600 | 1.401 |
| 8760 | plastidic | B1900 | 1.136 |
| 8861 | cytoplasmic | SLL0099 | 1.178 |
| 9046 | cytoplasmic | SLL0383 | 1.383 |
| 9280 | cytoplasmic | SLR1094 | 1.104 |
| 9307 | cytoplasmic | SLR1520 | 1.103 |
| 9430 | cytoplasmic | YDL142C | 1.200 |
| 9500 | plastidic | YLR284C | 1.229 |
| 9553 | plastidic | YPL148C | 1.276 |
| 9574 | plastidic | YPR074C | 1.245 |
| 10404 | plastidic | B1008 | 1.200 |
| 10591 | plastidic | B3347 | 1.188 |
| 11501 | cytoplasmic | YHR176W | 1.258 |
| 11564 | cytoplasmic | B2881_2 | 1.074 |
| 11695 | cytoplasmic | B3945_2 | 1.191 |
| 11907 | cytoplasmic | Yhr204w_2 | 1.369 |
| 11944 | cytoplasmic | Ynl142w_2 | 1.214 |
| 12357 | plastidic | Yol058w_2 | 1.091 |
| 12936 | cytoplasmic | Ypr035w_2 | 1.236 |

Example 2

Engineering *Arabidopsis* plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait by over-expressing, the yield-increasing, e.g. LTRRP or YRP-protein, e.g. low temperature resistance and/or tolerance related protein encoding genes from *Saccharomyces cereviesae* or *Synechocystis* or *E. coli* using tissue-specific and/or stress inducible promoters.

Transgenic *Arabidopsis* plants are created as in example 1 to express the LTRRP or YRP, e.g. yield increasing, e.g. low temperature resistance and/or tolerance related protein encoding transgenes under the control of a tissue-specific and/or stress inducible promoter.

T2 generation plants are produced and are grown under stress conditions, preferably conditions of low temperature. Biomass production is determined after a total time of 29 to 30 days starting with the sowing. The transgenic *Arabidopsis* plant produces more biomass than non-transgenic control plants.

Example 3

Over-expression of the yield-increasing, e.g. LTRRP or YRP-protein, e.g. low temperature resistance and/or tolerance related protein, e.g. stress related genes from *S. cerevisiae* or *E. coli* or *Synechocystis* provides tolerance of multiple abiotic stresses Plants that exhibit tolerance of one abiotic stress often exhibit tolerance of another environmental stress. This phenomenon of cross-tolerance is not understood at a mechanistic level (McKersie and Leshem, 1994). Nonetheless, it is reasonable to expect that plants exhibiting enhanced tolerance to low temperature, e.g. chilling temperatures and/or freezing temperatures, due to the expression of a transgene might also exhibit tolerance to drought and/or salt and/or other abiotic stresses. In support of this hypothesis, the expression of several genes are up or down-regulated by multiple abiotic stress factors including low temperature, drought, salt, osmoticum, ABA, etc. (e.g. Hong et al., Plant Mol Biol 18, 663 (1992); Jagendorf and Takabe, Plant Physiol 127, 1827 (2001)); Mizoguchi et al., Proc Natl Acad Sci USA 93, 765 (1996); Zhu, Curr Opin Plant Biol 4, 401 (2001)).

To determine salt tolerance, seeds of *A. thaliana* are sterilized (100% bleach, 0.1% TritonX for five minutes two times and rinsed five times with ddH2O). Seeds were plated on non-selection media (½ MS, 0.6% phytagar, 0.5 g/L MES, 1% sucrose, 2 µg/ml benamyl). Seeds are allowed to germinate for approximately ten days. At the 4-5 leaf stage, transgenic plants were potted into 5.5 cm diameter pots and allowed to grow (22° C., continuous light) for approximately seven days, watering as needed. To begin the assay, two liters of 100 mM NaCl and ⅛ MS are added to the tray under the pots. To the tray containing the control plants, three liters of ⅛ MS are added. The concentrations of NaCl supplementation are increased stepwise by 50 mM every 4 days up to 200 mM. After the salt treatment with 200 mM, fresh and survival and biomass production of the plants is determined.

To determine drought tolerance, seeds of the transgenic and low temperature lines are germinated and grown for approximately 10 days to the 4-5 leaf stage as above. The plants are then transferred to drought conditions and can be grown through the flowering and seed set stages of development. Photosynthesis can be measured using chlorophyll fluorescence as an indicator of photosynthetic fitness and integrity of the photosystems. Survival and plant biomass production as an indicators for seed yield is determined.

Plants that have tolerance to salinity or low temperature have higher survival rates and biomass production including seed yield and dry matter production than susceptible plants.

Example 4

Engineering alfalfa plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait, e.g. enhanced abiotic environmental stress tolerance and/or increased biomass production by over-expressing yield-increasing, e.g. LTRRP or YRP-protein-coding, e.g. low temperature resistance and/or tolerance related genes from *S. cerevisiae* or *E. coli* or *Synechocystis*

A regenerating clone of alfalfa (*Medicago sativa*) is transformed using state of the art methods (e.g. McKersie et al., Plant Physiol 119, 839(1999)). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D. C. W. and Atanassov A. (Plant Cell Tissue Organ Culture 4, 111(1985)). Alternatively, the RA3 variety (University of Wisconsin) is selected for use in tissue culture (Walker et al., Am. J. Bot. 65, 654 (1978)).

Petiole explants are cocultivated with an overnight culture of *Agrobacterium tumefaciens* C58C1 pMP90 (McKersie et al., Plant Physiol 119, 839(1999)) or LBA4404 containing a binary vector. Many different binary vector systems have been described for plant transformation (e.g. An G., in *Agrobacterium* Protocols, Methods in Molecular Biology, Vol 44, pp 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) is used to provide constitutive expression of the trait gene.

The explants are cocultivated for 3 days in the dark on SH induction medium containing 288 mg/L Pro, 53 mg/L thioproline, 4.35 g/L $K_2SO_4$, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

T1 or T2 generation plants are produced and subjected to low temperature experiments, e.g. as described above in example 1. For the assessment of yield increase, e.g. tolerance to low temperature, biomass production, intrinsic yield and/or dry matter production and/or seed yield is compared to plants lacking the transgene, e.g. corresponding non-transgenic wild type plants.

Example 5

Engineering ryegrass plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait e.g. enhanced stress tolerance, preferably tolerance to low temperature, and/or increased biomass production by over-expressing yield-increasing, e.g. LTRRP or YRP-protein-coding, e.g. tolerance to low temperature related genes from *S. cerevisiae* or *E. coli* or *Synechocystis*

Seeds of several different ryegrass varieties may be used as explant sources for transformation, including the commercial variety Gunne available from Svalöf Weibull seed company or the variety Affinity. Seeds are surface-sterilized sequentially with 1% Tween-20 for 1 minute, 100% bleach for 60 minutes, 3 rinses with 5 minutes each with deionized and distilled $H_2O$, and then germinated for 3-4 days on moist, sterile filter paper in the dark. Seedlings are further sterilized for 1 minute with 1% Tween-20, 5 minutes with 75% bleach, and rinsed 3 times with dd $H_2O$, 5 min each.

Surface-sterilized seeds are placed on the callus induction medium containing Murashige and Skoog basal salts and vitamins, 20 g/L sucrose, 150 mg/L asparagine, 500 mg/L casein hydrolysate, 3 g/L Phytagel, 10 mg/L BAP, and 5 mg/L dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, maintained in culture for another 4 weeks, and then transferred to MSO medium in light for 2 weeks. Several pieces of callus (11-17 weeks old) are either strained through a 10 mesh sieve and put onto callus induction medium, or cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve collected the cells. The fraction collected on the sieve is plated and cultured on solid ryegrass callus induction medium for 1 week in the dark at 25° C. The callus is then transferred to and cultured on MS medium containing 1% sucrose for 2 weeks.

Transformation can be accomplished with either *Agrobacterium* of with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/L sucrose is added to the filter paper. Gold particles (1.0 µm in size) are coated with plasmid DNA according to method of Sanford et al., 1993 and delivered to the embryogenic callus with the following parameters: 500 µg particles and 2 µg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/L PPT or 50 mg/L kanamycin. Shoots resistant to the selection agent are appearing and once rotted are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

T1 or T2 generation plants are produced and subjected to low temperature experiments, e.g. as described above in example 1. For the assessment of t yield increase, e.g. tolerance to low temperature, biomass production, intrinsic yield and/or dry matter production and/or seed yield is compared to plants lacking the transgene, e.g. corresponding non-transgenic wild type plants.

Example 6

Engineering soybean plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait e.g. enhanced stress tolerance, preferably tolerance to low temperature, and/or increased biomass production by over-expressing yield-increasing, e.g. LTRRP or YRP-protein coding, e.g. tolerance to low temperature related genes from *S. cerevisiae* or *E. coli* or *Synechocystis*.

Soybean is transformed according to the following modification of the method described in the Texas A&M U.S. Pat. No. 5,164,310. Several commercial soybean varieties are amenable to transformation by this method. The cultivar Jack (available from the Illinois Seed Foundation) is a commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Seven-day seedlings are propagated by removing the radicle, hypocotyl and one cotyledon from each seedling. Then, the epicotyl with one cotyledon is transferred to fresh germination media in petri dishes and incubated at 25° C. under a 16-h photoperiod (approx. 100 µmol/m$^2$s) for three weeks. Axillary nodes (approx. 4 mm in length) were cut from 3-4 week-old plants. Axillary nodes are excised and incubated in *Agrobacterium* LBA4404 culture.

Many different binary vector systems have been described for plant transformation (e.g. An G., in *Agrobacterium* Protocols. Methods in Molecular Biology Vol. 44, p. 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

T1 or T2 generation plants are produced and subjected to low temperature experiments, e.g. as described above in example 1. For the assessment of yield increase, e.g. tolerance to low temperature, biomass production, intrinsic yield and/or dry matter production and/or seed yield is compared to plants lacking the transgene, e.g. corresponding non-transgenic wild type plants.

Example 7

Engineering Rapeseed/Canola plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait, e.g. enhanced stress tolerance, preferably tolerance to low temperature, and/or increased biomass production by over-expressing yield-increasing, e.g. LTRRP or YRP-protein coding, e.g. tolerance to low temperature related genes from *S. cerevisiae* or *E. coli* or *Synechocystis*

Cotyledonary petioles and hypocotyls of 5-6 day-old young seedlings are used as explants for tissue culture and transformed according to Babic et al. (Plant Cell Rep 17, 183 (1998)). The commercial cultivar Westar (Agriculture Canada) is the standard variety used for transformation, but other varieties can be used.

*Agrobacterium tumefaciens* LBA4404 containing a binary vector can be used for canola transformation. Many different binary vector systems have been described for plant transformation (e.g. An G., in *Agrobacterium* Protocols. Methods in Molecular Biology Vol. 44, p. 47-62, Gartland K. M. A. and Davey M. R. eds. Humana Press, Totowa, N.J.). Many are based on the vector pBIN19 described by Bevan (Nucleic Acid Research. 12, 8711(1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) can be used to provide constitutive expression of the trait gene.

Canola seeds are surface-sterilized in 70% ethanol for 2 min., and then in 30% Clorox with a drop of Tween-20 for 10 min, followed by three rinses with sterilized distilled water. Seeds are then germinated in vitro 5 days on half strength MS medium without hormones, 1% sucrose, 0.7% Phytagar at 23° C., 16 h light. The cotyledon petiole explants with the cotyledon attached are excised from the in vitro seedlings, and inoculated with *Agrobacterium* by dipping the cut end of the petiole explant into the bacterial suspension. The explants are then cultured for 2 days on MSBAP-3 medium containing 3 mg/L BAP, 3% sucrose, 0.7% Phytagar at 23° C., 16 h light. After two days of co-cultivation with *Agrobacterium*, the petiole explants are transferred to MSBAP-3 medium containing 3 mg/L BAP, cefotaxime, carbenicillin, or timentin (300 mg/L) for 7 days, and then cultured on MSBAP-3 medium with cefotaxime, carbenicillin, or timentin and selection agent until shoot regeneration. When the shoots were 5-10 mm in length, they are cut and transferred to shoot elongation medium (MSBAP-0.5, containing 0.5 mg/L BAP). Shoots of about 2 cm in length are transferred to the rooting medium (MSO) for root induction.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

T1 or T2 generation plants are produced and subjected to low temperature experiments, e.g. as described above in example 1. For the assessment of yield increase, e.g. tolerance to low temperature, biomass production, intrinsic yield and/ or dry matter production and/or seed yield is compared to plants lacking the transgene, e.g. corresponding non-transgenic wild type plants.

Example 8

Engineering corn plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait, e.g. enhanced stress tolerance, preferably tolerance to low temperature, and/or increased biomass production by over-expressing yield-increasing, e.g. LTRRP or YRP-protein coding, e.g. low temperature resistance and/or tolerance related genes from S. cerevisiae or E. coli or Synechocystis Transformation of maize (Zea Mays L.) is performed with a modification of the method described by Ishida et al. (Nature Biotech 14745 (1996)). Transformation is genotype-dependent in corn and only specific genotypes are amenable to transformation and regeneration. The inbred line A188 (University of Minnesota) or hybrids with A188 as a parent are good sources of donor material for transformation (Fromm et al. Biotech 8, 833 (1990)), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO 94/00977 and WO 95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

Excised embryos are grown on callus induction medium, then maize regeneration medium, containing imidazolinone as a selection agent. The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants are then evaluated for their enhanced stress tolerance, like tolerance to low temperature, and/or increased biomass production according to the method described in Example 1. The T1 generation of single locus insertions of the T-DNA will segregate for the transgene in a 3:1 ratio. Those progeny containing one or two copies of the transgene are tolerant regarding the imidazolinone herbicide, and exhibit an increased yield, e.g. an increased yield-related trait, for example an enhancement of stress tolerance, like tolerance to low temperature, and/or increased biomass production than those progeny lacking the transgenes.

T1 or T2 generation plants are produced and subjected to low temperature experiments, e.g. as described above in example 2. For the assessment of yield increase, e.g. tolerance to low temperature, biomass production, intrinsic yield and/or dry matter production and/or seed yield is compared to e.g. corresponding non-transgenic wild type plants.

Homozygous T2 plants exhibited similar phenotypes. Hybrid plants (F1 progeny) of homozygous transgenic plants and non-transgenic plants also exhibited increased yield, e.g. an increased yield-related trait, for example enhanced tolerance to abiotic environmental stress, for example an increased drought tolerance and/or an increased nutrient use efficiency, and/or another mentioned yield-related trait, e.g. enhanced tolerance to low temperature.

Example 9

Engineering wheat plants with an increased yield, e.g. an increased yield-related trait, for example enhanced tolerance to abiotic environmental stress, for example an increased drought tolerance and/or low temperature tolerance and/or an increased nutrient use efficiency, and/or another mentioned yield-related trait, e.g. enhanced stress tolerance, preferably tolerance to low temperature, and/or increased biomass production by over-expressing yield-increasing, e.g. LTRRP or YRP-protein coding, e.g. low temperature resistance and/or tolerance related genes from S. cerevisiae or E. coli or Synechocystis Transformation of wheat is performed with the method described by Ishida et al. (Nature Biotech. 14745 (1996)). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO patents WO 94/00977 and WO 95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

After incubation with *Agrobacterium*, the embryos are grown on callus induction medium, then regeneration medium, containing imidazolinone as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants are then evaluated for their enhanced tolerance to low temperature and/or increased biomass production according to the method described in example 2. The T1 generation of single locus insertions of the T-DNA will segregate for the transgene in a 3:1 ratio. Those progeny containing one or two copies of the transgene are tolerant regarding the imidazolinone herbicide, and exhibit an increased yield, e.g. an increased yield-related trait, for example an enhanced tolerance to low temperature and/or increased biomass production compared to the progeny lacking the transgenes. Homozygous T2 plants exhibit similar phenotypes.

For the assessment of yield increase, e.g. tolerance to low temperature, biomass production, intrinsic yield and/or dry matter production and/or seed yield is compared to e.g. corresponding non-transgenic wild type plants. For example, plants with an increased yield, e.g. an increased yield-related trait, e.g. higher tolerance to stress, e.g. with an increased nutrient use efficiency or an increased intrinsic yield, and e.g. with higher tolerance to low temperature may show increased biomass production and/or dry matter production and/or seed yield under low temperature when compared to plants lacking the transgene, e.g. to corresponding non-transgenic wild type plants.

Example 10

Identification of Identical and Heterologous Genes

Gene sequences can be used to identify identical or heterologous genes from cDNA or genomic libraries. Identical genes (e.g. full-length cDNA clones) can be isolated via nucleic acid hybridization using for example cDNA libraries. Depending on the abundance of the gene of interest, 100,000 up to 1,000,000 recombinant bacteriophages are plated and transferred to nylon membranes. After denaturation with alkali, DNA is immobilized on the membrane by e.g. UV cross linking. Hybridization is carried out at high stringency conditions. In aqueous solution, hybridization and washing is performed at an ionic strength of 1 M NaCl and a temperature of 68° C. Hybridization probes are generated by e.g. radioactive ($^{32}$P) nick transcription labeling (High Prime, Roche, Mannheim, Germany). Signals are detected by autoradiography.

Partially identical or heterologous genes that are related but not identical can be identified in a manner analogous to the above-described procedure using low stringency hybridization and washing conditions. For aqueous hybridization, the ionic strength is normally kept at 1 M NaCl while the temperature is progressively lowered from 68 to 42° C.

Isolation of gene sequences with homology (or sequence identity/similarity) only in a distinct domain of (for example 10-20 amino acids) can be carried out by using synthetic radio labeled oligonucleotide probes. Radiolabeled oligonucleotides are prepared by phosphorylation of the 5-prime end of two complementary oligonucleotides with T4 polynucleotide kinase. The complementary oligonucleotides are annealed and ligated to form concatemers. The double stranded concatemers are than radiolabeled by, for example, nick transcription. Hybridization is normally performed at low stringency conditions using high oligonucleotide concentrations.

Oligonucleotide hybridization solution:
6×SSC
0.01 M sodium phosphate
1 mM EDTA (pH 8)
0.5% SDS
100 µg/ml denatured salmon sperm DNA
0.1% nonfat dried milk During hybridization, temperature is lowered stepwise to 5-10° C. below the estimated oligonucleotide $T_m$ or down to room temperature followed by washing steps and autoradiography. Washing is performed with low stringency such as 3 washing steps using 4×SSC. Further details are described by Sambrook J. et al., 1989, "Molecular Cloning: A Laboratory Manual," Cold Spring Harbor Laboratory Press or Ausubel F. M. et al., 1994, "Current Protocols in Molecular Biology," John Wiley & Sons.

Example 11

Identification of Identical Genes by Screening Expression Libraries with Antibodies c-DNA clones can be used to produce recombinant polypeptide for example in *E. coli* (e.g. Qiagen QIAexpress pQE system). Recombinant polypeptides are then normally affinity purified via Ni-NTA affinity chromatography (Qiagen). Recombinant polypeptides are then used to produce specific antibodies for example by using standard techniques for rabbit immunization. Antibodies are affinity purified using a Ni-NTA column saturated with the recombinant antigen as described by Gu et al., BioTechniques 17, 257 (1994). The antibody can than be used to screen expression cDNA libraries to identify identical or heterologous genes via an immunological screening (Sambrook, J. et al., 1989, "Molecular Cloning: A Laboratory Manual," Cold Spring Harbor Laboratory Press or Ausubel, F. M. et al., 1994, "Current Protocols in Molecular Biology", John Wiley & Sons).

Example 12

In Vivo Mutagenesis

In vivo mutagenesis of microorganisms can be performed by passage of plasmid (or other vector) DNA through *E. coli* or other microorganisms (e.g. *Bacillus* spp. or yeasts such as *S. cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp W. D., DNA repair mechanisms, in: *E. coli* and *Salmonella*, p. 2277-2294, ASM, 1996, Washington.) Such strains are well known to those skilled in the art. The use of such strains is illustrated, for example, in Greener A. and Callahan M., Strategies 7, 32 (1994). Transfer of mutated DNA molecules into plants is preferably done after selection and testing in microorganisms. Transgenic plants are generated according to various examples within the exemplification of this document.

Example 13

Engineering *Arabidopsis* plants with increased yield, e.g. an increased yield-related trait, for example an enhanced stress tolerance, preferably tolerance to low temperature, and/or increased biomass production by over-expressing LTRRP or YRP encoding genes for example from *A. thaliana, Brassica napus, Glycine max, Zea mays* or *Oryza sativa*, using tissue-specific or stress-inducible promoters.

Transgenic *Arabidopsis* plants over-expressing LTRRP genes or YRP genes, e.g. low temperature resistance and/or tolerance related protein encoding genes, from for example *A. thaliana, Brassica napus, Glycine max, Zea mays* and *Oryza sativa* are created as described in example 1 to express the LTRRP or YRP encoding transgenes under the control of a tissue-specific or stress-inducible promoter. T2 generation plants are produced and grown under stress or non-stress conditions, e.g. low temperature conditions. Plants with an increased yield, e.g. an increased yield-related trait, e.g. higher tolerance to stress, e.g. low temperature, or with an increased nutrient use efficiency or an increased intrinsic yield, show increased biomass production and/or dry matter production and/or seed yield under low temperature conditions when compared to plants lacking the transgene, e.g. to corresponding non-transgenic wild type plants.

Example 14

Engineering alfalfa plants with increased yield, e.g. an increased yield-related trait, for example an enhanced stress tolerance, preferably tolerance to low temperature, and/or increased biomass production by over-expressing LTRRP genes or YRP genes, e.g. low temperature resistance and/or tolerance related genes for example from *A. thaliana*, *Brassica napus*, *Glycine max*, *Zea mays* or *Oryza sativa*, for example A regenerating clone of alfalfa (*Medicago sativa*) is transformed using the method of McKersie et al., (Plant Physiol. 119, 839 (1999)). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown and Atanassov (Plant Cell Tissue Organ Culture 4, 111 (1985)). Alternatively, the RA3 variety (University of Wisconsin) has been selected for use in tissue culture (Walker et al., Am. J. Bot. 65, 54 (1978)). Petiole explants are cocultivated with an overnight culture of *Agrobacterium tumefaciens* C58C1 pMP90 (McKersie et al., Plant Physiol 119, 839 (1999)) or LBA4404 containing a binary vector. Many different binary vector systems have been described for plant transformation (e.g. An G., in *Agrobacterium* Protocols. Methods in Molecular Biology Vol. 44, p. 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) was used to provide constitutive expression of the trait gene.

The explants are cocultivated for 3 days in the dark on SH induction medium containing 288 mg/L Pro, 53 mg/L thioproline, 4.35 g/L $K_2SO_4$, and 100 μm acetosyringinone. The explants were washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. T1 or T2 generation plants are produced and subjected to experiments comprising stress or non-stress conditions, e.g. low temperature conditions as described in previous examples.

For the assessment of yield increase, e.g. tolerance to low temperature, biomass production, intrinsic yield and/or dry matter production and/or seed yield is compared to e.g. corresponding non-transgenic wild type plants.

For example, plants with an increased yield, e.g. an increased yield-related trait, e.g. higher tolerance to stress, e.g. with an increased nutrient use efficiency or an increased intrinsic yield, and e.g. with higher tolerance to low temperature may show increased biomass production and/or dry matter production and/or seed yield under low temperature when compared to plants lacking the transgene, e.g. to corresponding non-transgenic wild type plants.

Example 15

Engineering ryegrass plants with increased yield, e.g. an increased yield-related trait, for example an enhanced stress tolerance, preferably tolerance to low temperature, and/or increased biomass production by over-expressing LTRRP genes or YRP genes, e.g. low temperature resistance and/or tolerance related genes for example from *A. thaliana*, *Brassica napus*, *Glycine max*, *Zea mays* or *Oryza sativa*, Seeds of several different ryegrass varieties may be used as explant sources for transformation, including the commercial variety Gunne available from Svalöf Weibull seed company or the variety Affinity. Seeds are surface-sterilized sequentially with 1% Tween-20 for 1 minute, 100% bleach for 60 minutes, 3 rinses of 5 minutes each with deionized and distilled $H_2O$, and then germinated for 3-4 days on moist, sterile filter paper in the dark. Seedlings are further sterilized for 1 minute with 1% Tween-20, 5 minutes with 75% bleach, and rinsed 3 times with double destilled $H_2O$, 5 min each.

Surface-sterilized seeds are placed on the callus induction medium containing Murashige and Skoog basal salts and vitamins, 20 g/L sucrose, 150 mg/L asparagine, 500 mg/L casein hydrolysate, 3 g/L Phytagel, 10 mg/L BAP, and 5 mg/L dicamba. Plates are incubated in the dark at 25° C. for 4 weeks for seed germination and embryogenic callus induction.

After 4 weeks on the callus induction medium, the shoots and roots of the seedlings are trimmed away, the callus is transferred to fresh media, maintained in culture for another 4 weeks, and then transferred to MSO medium in light for 2 weeks. Several pieces of callus (11-17 weeks old) are either strained through a 10 mesh sieve and put onto callus induction medium, or cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve collect the cells. The fraction collected on the sieve is plated and cultured on solid ryegrass callus induction medium for 1 week in the dark at 25° C. The callus is then transferred to and cultured on MS medium containing 1% sucrose for 2 weeks.

Transformation can be accomplished with either *Agrobacterium* of with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile filter paper in a Petri dish. An aliquot of liquid MSO with 10 g/l sucrose is added to the filter paper. Gold particles (1.0 μm in size) are coated with plasmid DNA according to method of Sanford et al., 1993 and delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/L PPT or 50 mg/L kanamycin. Shoots resistant to the selection agent appeared and once rooted are transferred to soil.

Samples of the primary transgenic plants (TO) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. T1 or T2 generation plants are produced and subjected to stress or non-stress conditions, e.g. low temperature experiments, e.g. as described above in example 1.

For the assessment of yield increase, e.g. tolerance to low temperature, biomass production, intrinsic yield and/or dry matter production and/or seed yield is compared to e.g. corresponding non-transgenic wild type plants. For example, plants with an increased yield, e.g. an increased yield-related trait, e.g. higher tolerance to stress, e.g. with an increased nutrient use efficiency or an increased intrinsic yield, and e.g. with higher tolerance to low temperature may show increased biomass production and/or dry matter production and/or seed yield under low temperature when compared to plants lacking the transgene, e.g. to corresponding non-transgenic wild type plants.

Example 16

Engineering soybean plants with increased yield, e.g. an increased yield-related trait, for example an enhanced stress tolerance, preferably tolerance to low temperature, and/or increased biomass production by over-expressing LTRRP genes or YRP genes, e.g. low temperature resistance and/or tolerance related genes, for example from *A. thaliana, Brassica napus, Glycine max, Zea mays* or *Oryza sativa*.

Soybean is transformed according to the following modification of the method described in the Texas A&M U.S. Pat. No. 5,164,310. Several commercial soybean varieties are amenable to transformation by this method. The cultivar Jack (available from the Illinois Seed Foundation) is a commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Seven-day old seedlings are propagated by removing the radicle, hypocotyl and one cotyledon from each seedling. Then, the epicotyl with one cotyledon is transferred to fresh germination media in petri dishes and incubated at 25° C. under a 16 h photoperiod (approx. 100 μmol/ms) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An G., in *Agrobacterium* Protocols. Methods in Molecular Biology Vol 44, p. 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA.

These results are confirmed by Southern hybridization in which DNA is electrophoresed on a 1% agarose gel and transferred to a positively charged nylon membrane (Roche Diagnostics).

The PCR DIG Probe Synthesis Kit (Roche Diagnostics) is used to prepare a digoxigenin-labelled probe by PCR, and used as recommended by the manufacturer.

Soybea plants over-expressing LTRRP genes or YRP genes, e.g. low temperature resistance and/or tolerance related genes from *A. thaliana, Brassica napus, Glycine max, Zea mays* or *Oryza sativa*, show increased yield, for example, have higher seed yields.

T1 or T2 generation plants are produced and subjected to stress and non-stress conditions, e.g. low temperature experiments, e.g. as described above in example 1.

For the assessment of yield increase, e.g. tolerance to low temperature, biomass production, intrinsic yield and/or dry matter production and/or seed yield is compared to e.g. corresponding non-transgenic wild type plants. For example, plants with an increased yield, e.g. an increased yield-related trait, e.g. higher tolerance to stress, e.g. with an increased nutrient use efficiency or an increased intrinsic yield, and e.g. with higher tolerance to low temperature may show increased biomass production and/or dry matter production and/or seed yield under low temperature when compared to plants lacking the transgene, e.g. to corresponding non-transgenic wild type plants.

Example 17

Engineering rapeseed/canola plants with increased yield, e.g. an increased yield-related trait, for example an enhanced stress tolerance, preferably tolerance to low temperature, and/or increased biomass production by over-expressing LTRRP genes or YRP genes, e.g. low temperature resistance and/or tolerance related genes for example from *A. thaliana, Brassica napus, Glycine max, Zea mays* or *Oryza sativa*

Cotyledonary petioles and hypocotyls of 5-6 day-old young seedlings are used as explants for tissue culture and transformed according to Babic et al. (Plant Cell Rep 17, 183(1998)). The commercial cultivar Westar (Agriculture Canada) is the standard variety used for transformation, but other varieties can be used.

*Agrobacterium tumefaciens* LBA4404 containing a binary vector is used for canola transformation. Many different binary vector systems have been described for plant transformation (e.g. An G., in *Agrobacterium* Protocols. Methods in Molecular Biology Vol. 44, p. 47-62, Gartland K. M. A. and Davey M. R. eds. Humana Press, Totowa, N.J.). Many are based on the vector pBIN19 described by Bevan (Nucleic Acid Research. 12, 8711 (1984)) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,7673,666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

Canola seeds are surface-sterilized in 70% ethanol for 2 min., and then in 30% Clorox with a drop of Tween-20 for 10 min, followed by three rinses with sterilized distilled water. Seeds are then germinated in vitro 5 days on half strength MS medium without hormones, 1% sucrose, 0.7% Phytagar at 23° C., 16 h light. The cotyledon petiole explants with the cotyledon attached are excised from the in vitro seedlings, and inoculated with *Agrobacterium* by dipping the cut end of the petiole explant into the bacterial suspension. The explants are then cultured for 2 days on MSBAP-3 medium containing 3 mg/L BAP, 3% sucrose, 0.7% Phytagar at 23° C., 16 h light. After two days of co-cultivation with *Agrobacterium*, the petiole explants are transferred to MSBAP-3 medium containing 3 mg/l BAP, cefotaxime, carbenicillin, or timentin (300 mg/L) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/L BAP). Shoots of about 2 cm in length are transferred to the rooting medium (MSO) for root induction.

Samples of the primary transgenic plants (TO) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

The transgenic plants are then evaluated for their increased yield, e.g. an increased yield-related trait, e.g. higher tolerance to stress, e.g. enhanced tolerance to low temperature and/or increased biomass production according to the method described in Example 2. It is found that transgenic rapeseed/canola over-expressing LTRRP genes or YRP genes, e.g. low temperature resistance and/or tolerance related genes, from *Brassica napus, Glycine max, Zea mays* or *Oryza sativa* show increased yield, for example show an increased yield, e.g. an increased yield-related trait, e.g. higher tolerance to stress, e.g. with enhanced tolerance to low temperature and/or increased biomass production compared to plants without the transgene, e.g. corresponding non-transgenic control plants.

Example 18

Engineering corn plants with increased yield, e.g. an increased yield-related trait, for example an enhanced stress tolerance, preferably tolerance to low temperature, and/or increased biomass production by over-expressing LTRRP genes or YRP genes, e.g. tolerance to low temperature related genes for example from *A. thaliana, Brassica napus, Glycine max, Zea mays* or *Oryza sativa*

Transformation of corn (*Zea mays* L.) is performed with a modification of the method described by Ishida et al. (Nature Biotech 14745(1996)). Transformation is genotype-dependent in corn and only specific genotypes are amenable to transformation and regeneration. The inbred line A188 (University of Minnesota) or hybrids with A188 as a parent are good sources of donor material for transformation (Fromm et al. Biotech 8, 833 (1990), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO 94/00977 and WO 95/06722. Vectors are constructed as described. Various selection marker genes can be used including the corn gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

Excised embryos are grown on callus induction medium, then corn regeneration medium, containing imidazolinone as a selection agent. The Petri plates were incubated in the light at 25° C. for 2-3 weeks, or until shoots develop. The green shoots from each embryo are transferred to corn rooting medium and incubated at 25° C. for 2-3 weeks, until roots develop. The rooted shoots are transplanted to soil in the greenhouse. T1 seeds are produced from plants that exhibit tolerance to the imidazolinone herbicides and are PCR positive for the transgenes. The T1 transgenic plants are then evaluated for increased yield, e.g. an increased yield-related trait, e.g. higher tolerance to stress, e.g. with enhanced tolerance to low temperature and/or increased biomass production according to the methods described in Example 2. The T1 generation of single locus insertions of the T-DNA will segregate for the transgene in a 1:2:1 ratio. Those progeny containing one or two copies of the transgene (¾ of the progeny) are tolerant regarding the imidazolinone herbicide, and exhibit an increased yield, e.g. an increased yield-related trait, e.g. higher tolerance to stress, e.g. with enhanced tolerance to low temperature and/or increased biomass production compared to those progeny lacking the transgenes. Tolerant plants have higher seed yields. Homozygous T2 plants exhibited similar phenotypes. Hybrid plants (F1 progeny) of homozygous transgenic plants and non-transgenic plants also exhibited an increased yield, e.g. an increased yield-related trait, e.g. higher tolerance to stress, e.g. with enhanced tolerance to low temperature and/or increased biomass production.

Example 19

Engineering wheat plants with increased yield, e.g. an increased yield-related trait, for example an enhanced stress tolerance, preferably tolerance to low temperature, and/or increased biomass production by over-expressing LTRRP genes or YRP genes, e.g. low temperature resistance and/or tolerance related genes, for example from *A. thaliana, Brassica napus, Glycine max, Zea mays* or *Oryza sativa*

Transformation of wheat is performed with the method described by Ishida et al. (Nature Biotech. 14745 (1996)). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO patents WO 94/00977 and WO 95/06722. Vectors are constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

After incubation with *Agrobacterium*, the embryos are grown on callus induction medium, then regeneration medium, containing imidazolinone as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants are then evaluated for their increased yield, e.g. an increased yield-related trait, e.g. higher tolerance to stress, e.g. with enhanced tolerance to low temperature and/or increased biomass production according to the method described in example 2. The T1 generation of single locus insertions of the T-DNA will segregate for the transgene in a 1:2:1 ratio. Those progeny containing one or two copies of the transgene (¾ of the progeny) are tolerant regarding the imidazolinone herbicide, and exhibit an increased yield, e.g. an increased yield-related trait, e.g. higher tolerance to stress, e.g. with enhanced tolerance to low temperature and/or increased biomass production compared to those progeny lacking the transgenes.

For the assessment of yield increase, e.g. tolerance to low temperature, biomass production, intrinsic yield and/or dry matter production and/or seed yield is compared to e.g. corresponding non-transgenic wild type plants. For example, plants with an increased yield, e.g. an increased yield-related trait, e.g. higher tolerance to stress, e.g. with an increased nutrient use efficiency or an increased intrinsic yield, and e.g. with higher tolerance to low temperature may show increased biomass production and/or dry matter production and/or seed yield under low temperature when compared plants lacking the transgene, e.g. to corresponding non-transgenic wild type plants.

Example 20

Engineering rice plants with increased yield under condition of transient and repetitive abiotic stress, e.g. an increased yield-related trait, for example an enhanced stress tolerance, preferably tolerance to low temperature, and/or increased biomass production by over-expressing LTRRP genes or YRP genes, e.g. low temperature resistance and/or tolerance related genes, by over-expressing stress related genes from *Saccharomyces cerevisiae* or *E. coli* or *Synechocystis*

Rice Transformation

The *Agrobacterium* containing the expression vector of the invention is used to transform *Oryza sativa* plants. Mature dry seeds of the rice japonica cultivar Nipponbare are dehusked. Sterilization is carried out by incubating for one minute in 70% ethanol, followed by 30 minutes in 0.2% $HgCl_2$, followed by a 6 times 15 minutes wash with sterile distilled water. The sterile seeds are then germinated on a medium containing 2,4-D (callus induction medium). After incubation in the dark for four weeks, embryogenic, scutellum-derived calli are excised and propagated on the same medium. After two weeks, the calli are multiplied or propagated by subculture on the same medium for another 2 weeks. Embryogenic callus pieces are sub-cultured on fresh medium 3 days before co-cultivation (to boost cell division activity).

*Agrobacterium* strain LBA4404 containing the expression vector of the invention is used for co-cultivation. *Agrobacterium* is inoculated on AB medium with the appropriate antibiotics and cultured for 3 days at 28° C. The bacteria are then collected and suspended in liquid co-cultivation medium to a density ($OD_{600}$) of about 1. The suspension is then transferred to a Petri dish and the calli immersed in the suspension for 15 minutes. The callus tissues are then blotted dry on a filter paper and transferred to solidified, co-cultivation medium and incubated for 3 days in the dark at 25° C. Co-cultivated calli are grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential is released and shoots developed in the next four to five weeks. Shoots are excised from the calli and incubated for 2 to 3 weeks on an auxin-containing medium from which they are transferred to soil. Hardened shoots are grown under high humidity and short days in a greenhouse.

Approximately 35 independent T0 rice transformants are generated for one construct. The primary transformants are transferred from a tissue culture chamber to a greenhouse. After a quantitative PCR analysis to verify copy number of the T-DNA insert, only single copy transgenic plants that exhibit tolerance to the selection agent are kept for harvest of T1 seed. Seeds are then harvested three to five months after transplanting. The method yielded single locus transformants at a rate of over 50% (Aldemita and Hodges 1996, Chan et al. 1993, Hiei et al. 1994).

For the assessment of yield increase, e.g. tolerance to low temperature, biomass production, intrinsic yield and/or dry matter production and/or seed yield is compared to e.g. corresponding non-transgenic wild type plants. For example, plants with an increased yield, e.g. an increased yield-related trait, e.g. higher tolerance to stress, e.g. with an increased nutrient use efficiency or an increased intrinsic yield, and e.g. with higher tolerance to low temperature may show increased biomass production and/or dry matter production and/or seed yield under low temperature when compared plants lacking the transgene, e.g. to corresponding non-transgenic wild type plants.

E.g., for the cycling drought assay repetitive stress is applied to plants without leading to desiccation. The water supply throughout the experiment is limited and plants are subjected to cycles of drought and re-watering. For measuring biomass production, plant fresh weight is determined one day after the final watering by cutting shoots and weighing them.

Example 21

Engineering rice plants with increased yield under condition of transient and repetitive abiotic stress, e.g. an increased yield-related trait, for example an enhanced stress tolerance, preferably tolerance to low temperature, and/or increased biomass production by over-expressing LTRRP genes or YRP genes, e.g. low temperature resistance and/or tolerance related genes, by over-expressing yield and stress related genes for example from *A. thaliana, Brassica napus, Glycine max, Zea mays* or *Oryza sativa* for example Rice transformation The *Agrobacterium* containing the expression vector of the invention is used to transform *Oryza sativa* plants. Mature dry seeds of the rice japonica cultivar Nipponbare are dehusked. Sterilization is carried out by incubating for one minute in 70% ethanol, followed by 30 minutes in 0.2% $HgCl_2$, followed by a 6 times 15 minutes wash with sterile distilled water. The sterile seeds are then germinated on a medium containing 2,4-D (callus induction medium). After incubation in the dark for four weeks, embryogenic, scutellum-derived calli are excised and propagated on the same medium. After two weeks, the calli are multiplied or propagated by subculture on the same medium for another 2 weeks. Embryogenic callus pieces are sub-cultured on fresh medium 3 days before co-cultivation (to boost cell division activity).

*Agrobacterium* strain LBA4404 containing the expression vector of the invention is used for co-cultivation. *Agrobacterium* is inoculated on AB medium with the appropriate antibiotics and cultured for 3 days at 28° C. The bacteria are then collected and suspended in liquid co-cultivation medium to a density (OD600) of about 1. The suspension is then transferred to a Petri dish and the calli immersed in the suspension for 15 minutes. The callus tissues are then blotted dry on a filter paper and transferred to solidified, co-cultivation medium and incubated for 3 days in the dark at 25° C. Co-cultivated calli are grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential is released and shoots developed in the next four to five weeks. Shoots are excised from the calli and incubated for 2 to 3 weeks on an auxin-containing medium from which they are transferred to soil. Hardened shoots are grown under high humidity and short days in a greenhouse.

Approximately 35 independent T0 rice transformants are generated for one construct. The primary transformants are transferred from a tissue culture chamber to a greenhouse. After a quantitative PCR analysis to verify copy number of the T-DNA insert, only single copy transgenic plants that exhibit tolerance to the selection agent are kept for harvest of T1 seed. Seeds are then harvested three to five months after transplanting. The method yielded single locus transformants at a rate of over 50% (Aldemita and Hodges 1996, Chan et al. 1993, Hiei et al. 1994).

For the assessment of yield increase, e.g. tolerance to low temperature, biomass production, intrinsic yield and/or dry matter production and/or seed yield is compared to e.g. corresponding non-transgenic wild type plants. For example, plants with an increased yield, e.g. an increased yield-related trait, e.g. higher tolerance to stress, e.g. with an increased nutrient use efficiency or an increased intrinsic yield, and e.g. with higher tolerance to low temperature may show increased biomass production and/or dry matter production and/or seed yield under low temperature when compared plants lacking the transgene, e.g. to corresponding non-transgenic wild type plants.

E.g., for the cycling drought assay repetitive stress is applied to plants without leading to desiccation. The water supply throughout the experiment is limited and plants are subjected to cycles of drought and re-watering. For measuring biomass production, plant fresh weight is determined one day after the final watering by cutting shoots and weighing them. At an equivalent degree of drought stress, tolerant plants are able to resume normal growth whereas susceptible plants have died or suffer significant injury resulting in shorter leaves and less dry matter.

Example 22

Plant Screening for Growth Under Cycling Drought Conditions

In the cycling drought assay repetitive stress is applied to plants without leading to desiccation. In a standard experiment soil is prepared as 1:1 (v/v) mixture of nutrient rich soil (GS90, Tantau, Wansdorf, Germany) and quarz sand. Pots (6 cm diameter) were filled with this mixture and placed into trays. Water was added to the trays to let the soil mixture take up appropriate amount of water for the sowing procedure (day 1) and subsequently seeds of transgenic *A. thaliana* plants and their wild-type controls were sown in pots. Then the filled tray was covered with a transparent lid and transferred into a precooled (4° C.-5° C.) and darkened growth chamber. Stratification was established for a period of 3 days in the dark at 4° C.-5° C. or, alternatively, for 4 days in the dark at 4° C. Germination of seeds and growth was initiated at a growth condition of 20° C., 60% relative humidity, 16 h photoperiod and illumination with fluorescent light at approximately 200 µmol/m2 s. Covers were removed 7-8 days after sowing. BASTA selection was done at day 10 or day 11 (9 or 10 days after sowing) by spraying pots with plantlets from the top. In the standard experiment, a 0.07% (v/v) solution of BASTA concentrate (183 g/l glufosinate-ammonium) in tap water was sprayed once or, alternatively, a 0.02% (v/v) solution of BASTA was sprayed three times. The wild-type control plants were sprayed with tap water only (instead of spraying with BASTA dissolved in tap water) but were otherwise treated identically. Plants were individualized 13-14 days after sowing by removing the surplus of seedlings and leaving one seedling in soil. Transgenic events and wild-type control plants were evenly distributed over the chamber.

The water supply throughout the experiment was limited and plants were subjected to cycles of drought and re-watering. Watering was carried out at day 1 (before sowing), day 14 or day 15, day 21 or day 22, and, finally, day 27 or day 28. For measuring biomass production, plant fresh weight was determined one day after the final watering (day 28 or day 29) by cutting shoots and weighing them. Besides weighing, phenotypic information was added in case of plants that differ from the wild type control. Plants were in the stage prior to flowering and prior to growth of inflorescence when harvested. Significance values for the statistical significance of the biomass changes were calculated by applying the 'student's' t test (parameters: two-sided, unequal variance).

Up to five lines (events) per transgenic construct were tested in successive experimental levels (up to 4). Only constructs that displayed positive performance were subjected to the next experimental level. Usually in the first level five plants per construct were tested and in the subsequent levels 30-60 plants were tested. Biomass performance was evaluated as described above. Data are shown for constructs that displayed increased biomass performance in at least two successive experimental levels.

Biomass production of transgenic *A. thaliana* developed under cycling drought growth conditions is shown in Table VIIIc: Biomass production was measured by weighing plant rosettes. Biomass increase was calculated as ratio of average weight for transgenic plants compared to average weight of wild type control plants from the same experiment. The mean biomass increase of transgenic constructs is given (significance value <0.3 and biomass increase >5% (ratio >1.05)).

Example 23

Plant Screening for Yield Increase Under Standardised Growth Conditions (Intrinsic Yield In this experiment, a plant screening for yield increase (in this case: biomass yield increase) under standardised growth conditions in the absence of substantial abiotic stress has been performed. In a standard experiment soil is prepared as 3.5:1 (v/v) mixture of nutrient rich soil (GS90, Tantau, Wansdorf, Germany) and quarz sand. Alternatively, plants were sown on nutrient rich soil (GS90, Tantau, Germany). Pots were filled with soil mixture and placed into trays. Water was added to the trays to let the soil mixture take up appropriate amount of water for the sowing procedure. The seeds for transgenic *A. thaliana* plants and their non-trangenic wild-type controls were sown in pots (6 cm diameter). Then the filled tray was covered with a transparent lid and transferred into a precooled (4° C.-5° C.) and darkened growth chamber. Stratification was established for a period of 3-4 days in the dark at 4° C.-5° C. Germination of seeds and growth was initiated at a growth condition of 20° C., 60% relative humidity, 16 h photoperiod and illumination with fluorescent light at approximately 200 µmol/m2 s. Covers were removed 7-8 days after sowing. BASTA selection was done at day 10 or day 11 (9 or 10 days after sowing) by spraying pots with plantlets from the top. In the standard experiment, a 0.07% (v/v) solution of BASTA concentrate (183 g/l glufosinate-ammonium) in tap water was sprayed once or, alternatively, a 0.02% (v/v) solution of BASTA was sprayed three times. The wild-type control plants were sprayed with tap water only (instead of spraying with BASTA dissolved in tap water) but were otherwise treated identically. Plants were individualized 13-14 days after sowing by removing the surplus of seedlings and leaving one seedling in soil. Transgenic events and wild-type control plants were evenly distributed over the chamber.

Watering was carried out every two days after removing the covers in a standard experiment or, alternatively, every day. For measuring biomass performance, plant fresh weight was determined at harvest time (24-29 days after sowing) by cutting shoots and weighing them. Plants were in the stage prior to flowering and prior to growth of inflorescence when harvested. Transgenic plants were compared to the non-transgenic wild-type control plants. Significance values for the statistical significance of the biomass changes were calculated by applying the 'student's' t test (parameters: two-sided, unequal variance).

Two different types of experimental procedures were performed:

—Procedure 1). Per transgenic construct 3-4 independent transgenic lines (=events) were tested (22-30 plants per construct) and biomass performance was evaluated as described above.

—Procedure 2.) Up to five lines per transgenic construct were tested in successive experimental levels (up to 4). Only constructs that displayed positive performance were subjected to the next experimental level. Usually in the first level five plants per construct were tested and in the subsequent levels 30-60 plants were tested. Biomass performance was evaluated as described above. Data from this type of experiment (Procedure 2) are shown for constructs that displayed increased biomass performance in at least two successive experimental levels.

Biomass production of transgenic *A. thaliana* grown under standardised growth conditions is shown in Table VIIId: Biomass production was measured by weighing plant rosettes. Biomass increase was calculated as ratio of average weight of transgenic plants compared to average weight of wild-type control plants from the same experiment. The mean biomass increase of transgenic constructs is given (significance value <0.3 and biomass increase >5% (ratio >1.05)).

Example 24

Plant Screening (*Arabidopsis*) for Growth Under Limited Nitrogen Supply

Two different procedures were used for screening:

—Procedure 1). Per transgenic construct 4 independent transgenic lines (=events) were tested (22-28 plants per construct). *Arabidopsis thaliana* seeds are sown in pots containing a 1:1 (v:v) mixture of nutrient depleted soil ("Einheitserde Typ 0", 30% clay, Tantau, Wansdorf Germany) and sand. Germination is induced by a four day period at 4° C., in the dark. Subsequently the plants are grown under standard growth conditions (photoperiod of 16 h light and 8 h dark, 20° C., 60% relative humidity, and a photon flux density of 200 µE). The plants are grown and cultured, inter alia they are watered every second day with a N-depleted nutrient solution. The N-depleted nutrient solution e.g. contains beneath water

| mineral nutrient | final concentration |
|---|---|
| KCl | 3.00 mM |
| $MgSO_4 \times 7H_2O$ | 0.5 mM |
| $CaCl_2 \times 6H_2O$ | 1.5 mM |
| $K_2SO_4$ | 1.5 mM |
| $NaH_2PO_4$ | 1.5 mM |
| Fe-EDTA | 40 µM |
| $H_3BO_3$ | 25 µM |
| $MnSO_4 \times H_2O$ | 1 µM |
| $ZnSO_4 \times 7H_2O$ | 0.5 µM |
| $Cu_2SO_4 \times 5H_2O$ | 0.3 µM |
| $Na_2MoO_4 \times 2H_2O$ | 0.05 µM |

After 9 to 10 days the plants are individualized. After a total time of 28 to 31 days the plants are harvested and rated by the fresh weight of the aerial parts of the plants. The biomass increase has been measured as ratio of the fresh weight of the aerial parts of the respective transgenic plant and the non-transgenic wild type plant.

—Procedure 2). For screening of transgenic plants a specific culture facility was used. For high-throughput purposes plants were screened for biomass production on agar plates with limited supply of nitrogen (adapted from Estelle and Somerville, 1987). This screening pipeline consists of two level. Transgenic lines are subjected to subsequent level if biomass production was significantly improved in comparison to wild type plants. With each level number of replicates and statistical stringency was increased.

For the sowing, the seeds were removed from the Eppendorf tubes with the aid of a toothpick and transferred onto the above-mentioned agar plates, with limited supply of nitrogen (0.05 mM $KNO_3$). In total, approximately 15-30 seeds were distributed horizontally on each plate (12×12 cm).

After the seeds had been sown, plates are subjected to stratification for 2-4 days in the dark at 4° C. After the stratification, the test plants were grown for 22 to 25 days at a 16-h-light, 8-h-dark rhythm at 20° C., an atmospheric humidity of 60% and a $CO_2$ concentration of approximately 400 ppm. The light sources used generate a light resembling the solar color spectrum with a light intensity of approximately 100 µE/m²s. After 10 to 11 days the plants are individualized. Improved growth under nitrogen limited conditions was assessed by biomass production of shoots and roots of transgenic plants in comparison to wild type control plants after 20-25 days growth. Transgenic lines showing a significant improved biomass production in comparison to wild type plants are subjected to following experiment of the subsequent level on soil as described in procedure 1, however, 3-6 lines per construct were tested (up to 60 plants per construct).

Biomass production of transgenic *Arabidopsis thaliana* grown under limited nitrogen supply is shown in Table VIIIa:

Biomass production was measured by weighing plant rosettes. Biomass increase was calculated as ratio of average weight for transgenic plants compared to average weight of wild type control plants from the same experiment. The mean biomass increase of transgenic constructs is given (significance value <0.3 and biomass increase >5% (ratio >1.05)).

TABLE IA

| | | | | | 5. | |
|---|---|---|---|---|---|---|
| | 1. | 2. | 3. | 4. | Lead | 6. |
| Application | Hit | Project | Locus | Organism | SEQ ID | Target |
| 1 | 1 | LT_OEX_1 | B0414 | *E. coli* | 38 | Cytoplasmic |
| 1 | 2 | LT_OEX_1 | B2931 | *E. coli* | 147 | Cytoplasmic |
| 1 | 3 | LT_OEX_1 | B3945 | *E. coli* | 172 | Cytoplasmic |
| 1 | 4 | LT_OEX_1 | YEL004W | *S. cerevisiae* | 382 | Cytoplasmic |
| 1 | 5 | LT_OEX_1 | YER177W | *S. cerevisiae* | 406 | Cytoplasmic |
| 1 | 6 | LT_OEX_1 | YHR204W | *S. cerevisiae* | 917 | Cytoplasmic |
| 1 | 7 | LT_OEX_1 | YLL053C | *S. cerevisiae* | 952 | Cytoplasmic |
| 1 | 8 | LT_OEX_1 | YML123C | *S. cerevisiae* | 1320 | Cytoplasmic |
| 1 | 9 | LT_OEX_1 | YNL142W | *S. cerevisiae* | 1648 | Cytoplasmic |
| 1 | 10 | LT_OEX_1 | YNR040W | *S. cerevisiae* | 2065 | Cytoplasmic |
| 1 | 11 | LT_OEX_1 | YPR035W | *S. cerevisiae* | 2081 | Cytoplasmic |
| 1 | 12 a | LT_OEX_1 | B0903 | *E. coli* | 2406 | Plastidic |
| 1 | 12 b | LT_OEX_1 | B0903 | *E. coli* | 2406 | Cytoplasmic |
| 1 | 13 | LT_OEX_1 | B1393 | *E. coli* | 2564 | Cytoplasmic |
| 1 | 14 | LT_OEX_1 | B2704 | *E. coli* | 2841 | Plastidic |
| 1 | 15 | LT_OEX_1 | B2905 | *E. coli* | 2879 | Cytoplasmic |
| 1 | 16 | LT_OEX_1 | B3206 | *E. coli* | 3109 | Plastidic |
| 1 | 17 | LT_OEX_1 | B3659 | *E. coli* | 3403 | Cytoplasmic |
| 1 | 18 | LT_OEX_1 | B3871 | *E. coli* | 3441 | Cytoplasmic |
| 1 | 19 | LT_OEX_1 | YDR142C | *S. cerevisiae* | 3978 | Plastidic |
| 1 | 20 | LT_OEX_1 | YER175W-A | *S. cerevisiae* | 4047 | Cytoplasmic |
| 1 | 21 | LT_OEX_1 | YGR289C | *S. cerevisiae* | 4051 | Plastidic |
| 1 | 22 | LT_OEX_1 | YHR044C | *S. cerevisiae* | 4131 | Plastidic |
| 1 | 23 | LT_OEX_1 | YHR072W | *S. cerevisiae* | 4217 | Cytoplasmic |
| 1 | 24 | LT_OEX_1 | YHR213W-A | *S. cerevisiae* | 4491 | Cytoplasmic |
| 1 | 25 | LT_OEX_1 | YIL053W | *S. cerevisiae* | 4495 | Cytoplasmic |
| 1 | 26 | LT_OEX_1 | YJL103C | *S. cerevisiae* | 4558 | Plastidic |
| 1 | 27 | LT_OEX_1 | YJL137C | *S. cerevisiae* | 4589 | Plastidic |
| 1 | 28 | LT_OEX_1 | YLR027C | *S. cerevisiae* | 4622 | Cytoplasmic |
| 1 | 29 a | LT_OEX_1 | YML079W | *S. cerevisiae* | 5070 | Plastidic |
| 1 | 29 b | LT_OEX_1 | YML079W | *S. cerevisiae* | 5070 | Cytoplasmic |
| 1 | 30 | LT_OEX_1 | YMR157C | *S. cerevisiae* | 5102 | Plastidic |
| 1 | 31 | LT_OEX_1 | YNL024C | *S. cerevisiae* | 5115 | Plastidic |
| 1 | 32 a | LT_OEX_1 | YOL058W | *S. cerevisiae* | 5159 | Plastidic |
| 1 | 32 b | LT_OEX_1 | YOL058W | *S. cerevisiae* | 5159 | Cytoplasmic |
| 1 | 33 | LT_OEX_1 | YPL180W | *S. cerevisiae* | 5746 | Cytoplasmic |
| 1 | 34 | LT_OEX_1 | YPR167C | *S. cerevisiae* | 5756 | Plastidic |
| 1 | 35 | LT_OEX_1 | B0036 | *E. coli* | 6086 | Plastidic |
| 1 | 36 | LT_OEX_1 | B1906 | *E. coli* | 6581 | Cytoplasmic |
| 1 | 37 | LT_OEX_1 | B2371 | *E. coli* | 6609 | Cytoplasmic |
| 1 | 38 | LT_OEX_1 | B2881 | *E. coli* | 6949 | Cytoplasmic |
| 1 | 39 | LT_OEX_1 | B3106 | *E. coli* | 7078 | Cytoplasmic |
| 1 | 40 | LT_OEX_1 | B3400 | *E. coli* | 7270 | Plastidic |
| 1 | 41 | LT_OEX_1 | B3410 | *E. coli* | 7467 | Cytoplasmic |
| 1 | 42 | LT_OEX_1 | B4209 | *E. coli* | 7492 | Plastidic |
| 1 | 43 | LT_OEX_1 | SLL1545 | *Synechocystis* | 7591 | Cytoplasmic |
| 1 | 44 | LT_OEX_1 | SLR1348 | *Synechocystis* | 7670 | Mitochondric |
| 1 | 45 | LT_OEX_1 | YGR191W | *S. cerevisiae* | 8236 | Plastidic |
| 1 | 46 | LT_OEX_1 | AT1G22920 | *A. thaliana* | 8563 | Cytoplasmic |
| 1 | 47 | LT_OEX_1 | B1600 | *E. coli* | 8648 | Plastidic |
| 1 | 48 | LT_OEX_1 | B1900 | *E. coli* | 8760 | Plastidic |
| 1 | 49 | LT_OEX_1 | SLL0099 | *Synechocystis* | 8861 | Cytoplasmic |
| 1 | 50 | LT_OEX_1 | SLL0383 | *Synechocystis* | 9046 | Cytoplasmic |
| 1 | 51 | LT_OEX_1 | SLR1094 | *Synechocystis* | 9280 | Cytoplasmic |
| 1 | 52 | LT_OEX_1 | SLR1520 | *Synechocystis* | 9307 | Cytoplasmic |
| 1 | 53 | LT_OEX_1 | YDL142C | *S. cerevisiae* | 9430 | Cytoplasmic |
| 1 | 54 | LT_OEX_1 | YDR147W | *S. cerevisiae* | 9479 | Cytoplasmic |
| 1 | 55 | LT_OEX_1 | YLR284C | *S. cerevisiae* | 9500 | Plastidic |
| 1 | 56 | LT_OEX_1 | YPL148C | *S. cerevisiae* | 9553 | Plastidic |
| 1 | 57 | LT_OEX_1 | YPR074C | *S. cerevisiae* | 9574 | Plastidic |
| 1 | 58 | LT_OEX_1 | B1008 | *E. coli* | 10404 | Plastidic |
| 1 | 59 | LT_OEX_1 | B1529 | *E. coli* | 10503 | Plastidic |
| 1 | 60 | LT_OEX_1 | B3347 | *E. coli* | 10591 | Plastidic |
| 1 | 61 | LT_OEX_1 | YBR176W | *S. cerevisiae* | 10934 | Cytoplasmic |
| 1 | 62 | LT_OEX_1 | YGR177C | *S. cerevisiae* | 11461 | Cytoplasmic |
| 1 | 63 | LT_OEX_1 | YHR176W | *S. cerevisiae* | 11501 | Cytoplasmic |

TABLE IA-continued

Nucleic acid sequence ID numbers

| 1 | 64 | LT_OEX_1 | B2881_2 | *E. coli* | 11564 | Cytoplasmic |
| 1 | 65 | LT_OEX_1 | B3945_2 | *E. coli* | 11695 | Cytoplasmic |
| 1 | 66 | LT_OEX_1 | YHR204W_2 | *S. cerevisiae* | 11907 | Cytoplasmic |
| 1 | 67 | LT_OEX_1 | YNL142W_2 | *S. cerevisiae* | 11944 | Cytoplasmic |
| 1 | 68 a | LT_OEX_1 | YOL058W_2 | *S. cerevisiae* | 12357 | Plastidic |
| 1 | 68 b | LT_OEX_1 | YOL058W_2 | *S. cerevisiae* | 12357 | Cytoplasmic |
| 1 | 69 | LT_OEX_1 | YPR035W_2 | *S. cerevisiae* | 12936 | Cytoplasmic |

| Application | 1. Hit | 7. SEQ IDs of Nucleic Acid Homologs |
|---|---|---|
| 1 | 1 | 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 |
| 1 | 2 | 149, 151, 153, 155, 157, 159, 161, 163 |
| 1 | 3 | 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372 |
| 1 | 4 | 384, 386, 388, 390, 392, 394, 396 |
| 1 | 5 | 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746 |
| 1 | 6 | 919, 921, 923, 925, 927, 929, 931, 933, 935, 937, 939 |
| 1 | 7 | 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212 |
| 1 | 8 | 1322, 1324, 1326, 1328, 1330, 1332, 1334, 1336, 1338, 1340, 1342, 1344, 1346, 1348, 1350, 1352, 1354, 1356, 1358, 1360, 1362, 1364, 1366, 1368, 1370, 1372, 1374, 1376, 1378, 1380, 1382, 1384, 1386, 1388, 1390, 1392, 1394, 1396, 1398, 1400, 1402, 1404, 1406, 1408, 1410, 1412, 1414, 1416, 1418, 1420, 1422, 1424, 1426, 1428, 1430, 1432, 1434, 1436, 1438, 1440, 1442, 1444, 1446, 1448, 1450, 1452, 1454, 1456, 1458, 1460, 1462, 1464, 1466, 1468, 1470, 1472, 1474, 1476, 1478, 1480, 1482, 1484, 1486, 1488, 1490, 1492, 1494, 1496, 1498, 1500, 1502, 1504, 1506, 1508, 1510, 1512, 1514, 1516, 1518, 1520, 1522, 1524, 1526, 1528, 1530, 1532, 1534, 1536, 1538, 1540, 1542, 1544, 1546, 1548, 1550, 1552, 1554, 1556, 1558, 1560, 1562, 1564, 1566, 1568, 1570, 1572, 1574, 1576, 1578, 1580, 1582, 1584, 1586, 1588, 1590, 1592, 1594, 1596, 1598, 1600, 1602, 1604, 1606, 1608, 1610, 1612, 1614 |
| 1 | 9 | 1650, 1652, 1654, 1656, 1658, 1660, 1662, 1664, 1666, 1668, 1670, 1672, 1674, 1676, 1678, 1680, 1682, 1684, 1686, 1688, 1690, 1692, 1694, 1696, 1698, 1700, 1702, 1704, 1706, 1708, 1710, 1712, 1714, 1716, 1718, 1720, 1722, 1724, 1726, 1728, 1730, 1732, 1734, 1736, 1738, 1740, 1742, 1744, 1746, 1748, 1750, 1752, 1754, 1756, 1758, 1760, 1762, 1764, 1766, 1768, 1770, 1772, 1774, 1776, 1778, 1780, 1782, 1784, 1786, 1788, 1790, 1792, 1794, 1796, 1798, 1800, 1802, 1804, 1806, 1808, 1810, 1812, 1814, 1816, 1818, 1820, 1822, 1824, 1826, 1828, 1830, 1832, 1834, 1836, 1838, 1840, 1842, 1844, 1846, 1848, 1850, 1852, 1854, 1856, 1858, 1860, 1862, 1864, 1866, 1868, 1870, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, |

TABLE IA-continued

| | | Nucleic acid sequence ID numbers |
|---|---|---|
| | | 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2030, 2032, 2034, 2036, 2038, 2040, 2042, 2044, 2046, 2048, 2050, 2052, 2054 |
| 1 | 10 | 2067, 2069, 2071, 2073, 2075 |
| 1 | 11 | 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2183, 2185, 2187, 2189, 2191, 2193, 2195, 2197, 2199, 2201, 2203, 2205, 2207, 2209, 2211, 2213, 2215, 2217, 2219, 2221, 2223, 2225, 2227, 2229, 2231, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345 |
| 1 | 12 a | 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544 |
| 1 | 12 b | 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2498, 2500, 2502, 2504, 2506, 2508, 2510, 2512, 2514, 2516, 2518, 2520, 2522, 2524, 2526, 2528, 2530, 2532, 2534, 2536, 2538, 2540, 2542, 2544 |
| 1 | 13 | 2566, 2568, 2570, 2572, 2574, 2576, 2578, 2580, 2582, 2584, 2586, 2588, 2590, 2592, 2594, 2596, 2598, 2600, 2602, 2604, 2606, 2608, 2610, 2612, 2614, 2616, 2618, 2620, 2622, 2624, 2626, 2628, 2630, 2632, 2634, 2636, 2638, 2640, 2642, 2644, 2646, 2648, 2650, 2652, 2654, 2656, 2658, 2660, 2662, 2664, 2666, 2668, 2670, 2672, 2674, 2676, 2678, 2680, 2682, 2684, 2686, 2688, 2690, 2692, 2694, 2696, 2698, 2700, 2702, 2704, 2706, 2708, 2710, 2712, 2714, 2716, 2718, 2720, 2722, 2724, 2726, 2728, 2730, 2732, 2734, 2736, 2738, 2740, 2742, 2744, 2746, 2748, 2750, 2752, 2754, 2756, 2758, 2760, 2762, 2764, 2766, 2768, 2770, 2772, 2774, 2776, 2778, 2780, 2782, 2784, 2786, 2788, 2790, 2792, 2794, 2796, 2798, 2800, 2802 |
| 1 | 14 | 2843, 2845, 2847, 2849, 2851, 2853, 2855, 2857, 2859, 2861, 2863, 2865, 2867, 2869, 2871, 2873 |
| 1 | 15 | 2881, 2883, 2885, 2887, 2889, 2891, 2893, 2895, 2897, 2899, 2901, 2903, 2905, 2907, 2909, 2911, 2913, 2915, 2917, 2919, 2921, 2923, 2925, 2927, 2929, 2931, 2933, 2935, 2937, 2939, 2941, 2943, 2945, 2947, 2949, 2951, 2953, 2955, 2957, 2959, 2961, 2963, 2965, 2967, 2969, 2971, 2973, 2975, 2977, 2979, 2981, 2983, 2985, 2987, 2989, 2991, 2993, 2995, 2997, 2999, 3001, 3003, 3005, 3007, 3009, 3011, 3013, 3015, 3017, 3019, 3021, 3023, 3025, 3027, 3029, 3031, 3033, 3035, 3037, 3039, 3041, 3043, 3045, 3047, 3049, 3051, 3053, 3055, 3057, 3059, 3061, 3063, 3065, 3067, 3069, 3071, 3073, 3075, 3077, 3079, 3081, 3083, 3085 |
| 1 | 16 | 3111, 3113, 3115, 3117, 3119, 3121, 3123, 3125, 3127, 3129, 3131, 3133, 3135, 3137, 3139, 3141, 3143, 3145, 3147, 3149, 3151, 3153, 3155, 3157, 3159, 3161, 3163, 3165, 3167, 3169, 3171, 3173, 3175, 3177, 3179, 3181, 3183, 3185, 3187, 3189, 3191, 3193, 3195, 3197, 3199, 3201, 3203, 3205, 3207, 3209, 3211, 3213, 3215, 3217, 3219, 3221, 3223, 3225, 3227, 3229, 3231, 3233, 3235, 3237, 3239, 3241, 3243, 3245, 3247, 3249, 3251, 3253, 3255, 3257, 3259, 3261, 3263, 3265, 3267, 3269, 3271, 3273, 3275, 3277, 3279, 3281, 3283, 3285, 3287, 3289, 3291, 3293, 3295, 3297, 3299, 3301, 3303, 3305, 3307, 3309, 3311, 3313, 3315, 3317, 3319, 3321, 3323, 3325, 3327, 3329, 3331, 3333, 3335, 3337, 3339, 3341, 3343, 3345, 3347, 3349, 3351, 3353, 3355, 3357, 3359, 3361, 3363, 3365, 3367, 3369, 3371, 3373, 3375, 3377, 3379, 3381, 3383, 3385, 3387, 3389, 3391, 3393, 3395, 3397 |
| 1 | 17 | 3405, 3407, 3409, 3411, 3413, 3415, 3417, 3419, 3421, 3423, 3425, 3427, 3429 |
| 1 | 18 | 3443, 3445, 3447, 3449, 3451, 3453, 3455, 3457, 3459, 3461, 3463, 3465, 3467, 3469, 3471, 3473, 3475, 3477, 3479, 3481, 3483, 3485, 3487, 3489, 3491, 3493, 3495, 3497, 3499, 3501, 3503, 3505, 3507, 3509, 3511, 3513, 3515, 3517, 3519, 3521, 3523, 3525, 3527, 3529, 3531, 3533, 3535, 3537, 3539, 3541, 3543, 3545, 3547, 3549, 3551, 3553, 3555, 3557, 3559, 3561, 3563, 3565, 3567, 3569, 3571, 3573, 3575, 3577, 3579, 3581, 3583, 3585, 3587, 3589, 3591, 3593, 3595, |

TABLE IA-continued

| | | Nucleic acid sequence ID numbers |
|---|---|---|
| | | 3597, 3599, 3601, 3603, 3605, 3607, 3609, 3611, 3613, 3615, 3617, 3619, 3621, 3623, 3625, 3627, 3629, 3631, 3633, 3635, 3637, 3639, 3641, 3643, 3645, 3647, 3649, 3651, 3653, 3655, 3657, 3659, 3661, 3663, 3665, 3667, 3669, 3671, 3673, 3675, 3677, 3679, 3681, 3683, 3685, 3687, 3689, 3691, 3693, 3695, 3697, 3699, 3701, 3703, 3705, 3707, 3709, 3711, 3713, 3715, 3717, 3719, 3721, 3723, 3725, 3727, 3729, 3731, 3733, 3735, 3737, 3739, 3741, 3743, 3745, 3747, 3749, 3751, 3753, 3755, 3757, 3759, 3761, 3763, 3765, 3767, 3769, 3771, 3773, 3775, 3777, 3779, 3781, 3783, 3785, 3787, 3789, 3791, 3793, 3795, 3797, 3799, 3801, 3803, 3805, 3807, 3809, 3811, 3813, 3815, 3817, 3819, 3821, 3823, 3825, 3827, 3829, 3831, 3833, 3835, 3837, 3839, 3841, 3843, 3845, 3847, 3849, 3851, 3853, 3855, 3857, 3859, 3861, 3863, 3865, 3867, 3869, 3871, 3873, 3875, 3877, 3879, 3881, 3883, 3885, 3887, 3889, 3891, 3893, 3895, 3897, 3899, 3901, 3903, 3905, 3907, 3909, 3911, 3913, 3915, 3917, 3919, 3921, 3923, 3925, 3927, 3929, 3931, 3933, 3935, 3937, 3939, 3941, 3943, 3945, 3947, 3949, 3951, 3953 |
| 1 | 19 | 3980, 3982, 3984, 3986, 3988, 3990, 3992, 3994, 3996, 3998, 4000, 4002, 4004, 4006, 4008, 4010, 4012, 4014, 4016, 4018, 4020, 4022, 4024, 4026, 4028, 4030, 4032, 4034 |
| 1 | 20 | — |
| 1 | 21 | 4053, 4055, 4057, 4059, 4061, 4063, 4065, 4067, 4069, 4071, 4073, 4075, 4077, 4079, 4081, 4083, 4085, 4087, 4089, 4091, 4093, 4095, 4097, 4099, 4101, 4103, 4105, 4107, 4109, 4111, 4113, 4115, 4117, 4119 |
| 1 | 22 | 4133, 4135, 4137, 4139, 4141, 4143, 4145, 4147, 4149, 4151, 4153, 4155, 4157, 4159, 4161, 4163, 4165, 4167, 4169, 4171, 4173, 4175, 4177, 4179, 4181, 4183, 4185, 4187, 4189, 4191, 4193, 4195, 4197, 4199, 4201, 4203, 4205, 4207, 4209 |
| 1 | 23 | 4219, 4221, 4223, 4225, 4227, 4229, 4231, 4233, 4235, 4237, 4239, 4241, 4243, 4245, 4247, 4249, 4251, 4253, 4255, 4257, 4259, 4261, 4263, 4265, 4267, 4269, 4271, 4273, 4275, 4277, 4279, 4281, 4283, 4285, 4287, 4289, 4291, 4293, 4295, 4297, 4299, 4301, 4303, 4305, 4307, 4309, 4311, 4313, 4315, 4317, 4319, 4321, 4323, 4325, 4327, 4329, 4331, 4333, 4335, 4337, 4339, 4341, 4343, 4345, 4347, 4349, 4351, 4353, 4355, 4357, 4359, 4361, 4363, 4365, 4367, 4369, 4371, 4373, 4375, 4377, 4379, 4381, 4383, 4385, 4387, 4389, 4391, 4393, 4395, 4397, 4399, 4401, 4403, 4405, 4407, 4409, 4411, 4413, 4415, 4417, 4419, 4421, 4423, 4425, 4427, 4429, 4431, 4433, 4435, 4437, 4439, 4441, 4443, 4445, 4447, 4449, 4451, 4453, 4455, 4457, 4459 |
| 1 | 24 | — |
| 1 | 25 | 4497, 4499, 4501, 4503, 4505, 4507, 4509, 4511, 4513, 4515, 4517, 4519, 4521, 4523, 4525, 4527, 4529, 4531, 4533, 4535, 4537, 4539, 4541, 4543, 4545, 4547, 4549 |
| 1 | 26 | 4560, 4562, 4564, 4566, 4568, 4570, 4572, 4574, 4576, 4578 |
| 1 | 27 | 4591, 4593, 4595, 4597, 4599, 4601, 4603, 4605, 4607, 4609, 4611 |
| 1 | 28 | 4624, 4626, 4628, 4630, 4632, 4634, 4636, 4638, 4640, 4642, 4644, 4646, 4648, 4650, 4652, 4654, 4656, 4658, 4660, 4662, 4664, 4666, 4668, 4670, 4672, 4674, 4676, 4678, 4680, 4682, 4684, 4686, 4688, 4690, 4692, 4694, 4696, 4698, 4700, 4702, 4704, 4706, 4708, 4710, 4712, 4714, 4716, 4718, 4720, 4722, 4724, 4726, 4728, 4730, 4732, 4734, 4736, 4738, 4740, 4742, 4744, 4746, 4748, 4750, 4752, 4754, 4756, 4758, 4760, 4762, 4764, 4766, 4768, 4770, 4772, 4774, 4776, 4778, 4780, 4782, 4784, 4786, 4788, 4790, 4792, 4794, 4796, 4798, 4800, 4802, 4804, 4806, 4808, 4810, 4812, 4814, 4816, 4818, 4820, 4822, 4824, 4826, 4828, 4830, 4832, 4834, 4836, 4838, 4840, 4842, 4844, 4846, 4848, 4850, 4852, 4854, 4856, 4858, 4860, 4862, 4864, 4866, 4868, 4870, 4872, 4874, 4876, 4878, 4880, 4882, 4884, 4886, 4888, 4890, 4892, 4894, 4896, 4898, 4900, 4902, 4904, 4906, 4908, 4910, 4912, 4914, 4916, 4918, 4920, 4922, 4924, 4926, 4928, 4930, 4932, 4934, 4936, 4938, 4940, 4942, 4944, 4946, 4948, 4950, 4952, 4954, 4956, 4958, 4960, 4962, 4964, 4966, 4968, 4970, 4972, 4974, 4976, 4978, 4980, 4982, 4984, 4986, 4988, 4990, 4992, 4994, 4996, 4998, 5000, 5002, 5004, 5006, 5008, 5010, 5012, 5014, 5016, 5018 |
| 1 | 29 a | 5072, 5074, 5076, 5078, 5080, 5082, 5084, 5086, 5088, 5090, 5092, 5094, 5096 |
| 1 | 29 b | 5072, 5074, 5076, 5078, 5080, 5082, 5084, 5086, 5088, 5090, 5092, 5094, 5096 |
| 1 | 30 | 5104, 5106, 5108 |
| 1 | 31 | 5117, 5119, 5121, 5123, 5125, 5127, 5129, 5131, 5133, 5135, 5137, 5139, 5141, 5143, 5145, 5147, 5149, 5151 |
| 1 | 32 a | 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213, 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305, 5307, 5309, 5311, 5313, |

TABLE IA-continued

| | | Nucleic acid sequence ID numbers |
|---|---|---|
| | | 5315, 5317, 5319, 5321, 5323, 5325, 5327, 5329, 5331, 5333, 5335, 5337, 5339, 5341, 5343, 5345, 5347, 5349, 5351, 5353, 5355, 5357, 5359, 5361, 5363, 5365, 5367, 5369, 5371, 5373, 5375, 5377, 5379, 5381, 5383, 5385, 5387, 5389, 5391, 5393, 5395, 5397, 5399, 5401, 5403, 5405, 5407, 5409, 5411, 5413, 5415, 5417, 5419, 5421, 5423, 5425, 5427, 5429, 5431, 5433, 5435, 5437, 5439, 5441, 5443, 5445, 5447, 5449, 5451, 5453, 5455, 5457, 5459, 5461, 5463, 5465, 5467, 5469, 5471, 5473, 5475, 5477, 5479, 5481, 5483, 5485, 5487, 5489, 5491, 5493, 5495, 5497, 5499, 5501, 5503, 5505, 5507, 5509, 5511, 5513, 5515, 5517, 5519, 5521, 5523, 5525, 5527, 5529, 5531, 5533, 5535, 5537, 5539, 5541, 5543, 5545, 5547, 5549, 5551, 5553, 5555, 5557, 5559, 5561, 5563, 5565, 5567, 5569, 5571, 5573, 5575, 5577, 5579, 5581, 5583, 5585, 5587, 5589, 5591, 5593, 5595, 5597, 5599, 5601, 5603, 5605, 5607, 5609, 5611, 5613, 5615, 5617, 5619, 5621, 5623, 5625, 5627, 5629, 5631, 5633, 5635, 5637, 5639, 5641, 5643, 5645, 5647, 5649, 5651, 5653, 5655, 5657, 5659, 5661, 5663, 5665, 5667, 5669, 5671, 5673, 5675, 5677, 5679, 5681, 5683, 5685, 5687, 5689, 5691, 5693, 5695, 5697, 5699, 5701, 5703, 5705, 5707, 5709, 5711, 5713, 5715, 5717, 5719, 5721, 5723, 5725, 5727, 5729, 5731, 5733 |
| 1 | 32 b | 5161, 5163, 5165, 5167, 5169, 5171, 5173, 5175, 5177, 5179, 5181, 5183, 5185, 5187, 5189, 5191, 5193, 5195, 5197, 5199, 5201, 5203, 5205, 5207, 5209, 5211, 5213, 5215, 5217, 5219, 5221, 5223, 5225, 5227, 5229, 5231, 5233, 5235, 5237, 5239, 5241, 5243, 5245, 5247, 5249, 5251, 5253, 5255, 5257, 5259, 5261, 5263, 5265, 5267, 5269, 5271, 5273, 5275, 5277, 5279, 5281, 5283, 5285, 5287, 5289, 5291, 5293, 5295, 5297, 5299, 5301, 5303, 5305, 5307, 5309, 5311, 5313, 5315, 5317, 5319, 5321, 5323, 5325, 5327, 5329, 5331, 5333, 5335, 5337, 5339, 5341, 5343, 5345, 5347, 5349, 5351, 5353, 5355, 5357, 5359, 5361, 5363, 5365, 5367, 5369, 5371, 5373, 5375, 5377, 5379, 5381, 5383, 5385, 5387, 5389, 5391, 5393, 5395, 5397, 5399, 5401, 5403, 5405, 5407, 5409, 5411, 5413, 5415, 5417, 5419, 5421, 5423, 5425, 5427, 5429, 5431, 5433, 5435, 5437, 5439, 5441, 5443, 5445, 5447, 5449, 5451, 5453, 5455, 5457, 5459, 5461, 5463, 5465, 5467, 5469, 5471, 5473, 5475, 5477, 5479, 5481, 5483, 5485, 5487, 5489, 5491, 5493, 5495, 5497, 5499, 5501, 5503, 5505, 5507, 5509, 5511, 5513, 5515, 5517, 5519, 5521, 5523, 5525, 5527, 5529, 5531, 5533, 5535, 5537, 5539, 5541, 5543, 5545, 5547, 5549, 5551, 5553, 5555, 5557, 5559, 5561, 5563, 5565, 5567, 5569, 5571, 5573, 5575, 5577, 5579, 5581, 5583, 5585, 5587, 5589, 5591, 5593, 5595, 5597, 5599, 5601, 5603, 5605, 5607, 5609, 5611, 5613, 5615, 5617, 5619, 5621, 5623, 5625, 5627, 5629, 5631, 5633, 5635, 5637, 5639, 5641, 5643, 5645, 5647, 5649, 5651, 5653, 5655, 5657, 5659, 5661, 5663, 5665, 5667, 5669, 5671, 5673, 5675, 5677, 5679, 5681, 5683, 5685, 5687, 5689, 5691, 5693, 5695, 5697, 5699, 5701, 5703, 5705, 5707, 5709, 5711, 5713, 5715, 5717, 5719, 5721, 5723, 5725, 5727, 5729, 5731, 5733 |
| 1 | 33 | 5748 |
| 1 | 34 | 5758, 5760, 5762, 5764, 5766, 5768, 5770, 5772, 5774, 5776, 5778, 5780, 5782, 5784, 5786, 5788, 5790, 5792, 5794, 5796, 5798, 5800, 5802, 5804, 5806, 5808, 5810, 5812, 5814, 5816, 5818, 5820, 5822, 5824, 5826, 5828, 5830, 5832, 5834, 5836, 5838, 5840, 5842, 5844, 5846, 5848, 5850, 5852, 5854, 5856, 5858, 5860, 5862, 5864, 5866, 5868, 5870, 5872, 5874, 5876, 5878, 5880, 5882, 5884, 5886, 5888, 5890, 5892, 5894, 5896, 5898, 5900, 5902, 5904, 5906, 5908, 5910, 5912, 5914, 5916, 5918, 5920, 5922, 5924, 5926, 5928, 5930, 5932, 5934, 5936, 5938, 5940, 5942, 5944, 5946, 5948, 5950, 5952, 5954, 5956, 5958, 5960, 5962, 5964, 5966, 5968, 5970, 5972, 5974, 5976, 5978, 5980, 5982, 5984, 5986, 5988, 5990, 5992, 5994, 5996, 5998, 6000, 6002, 6004, 6006, 6008, 6010, 6012, 6014, 6016, 6018, 6020, 6022, 6024, 6026, 6028, 6030, 6032, 6034, 6036, 6038, 6040, 6042, 6044, 6046 |
| 1 | 35 | 6088, 6090, 6092, 6094, 6096, 6098, 6100, 6102, 6104, 6106, 6108, 6110, 6112, 6114, 6116, 6118, 6120, 6122, 6124, 6126, 6128, 6130, 6132, 6134, 6136, 6138, 6140, 6142, 6144, 6146, 6148, 6150, 6152, 6154, 6156, 6158, 6160, 6162, 6164, 6166, 6168, 6170, 6172, 6174, 6176, 6178, 6180, 6182, 6184, 6186, 6188, 6190, 6192, 6194, 6196, 6198, 6200, 6202, 6204, 6206, 6208, 6210, 6212, 6214, 6216, 6218, 6220, 6222, 6224, 6226, 6228, 6230, 6232, 6234, 6236, 6238, 6240, 6242, 6244, 6246, 6248, 6250, 6252, 6254, 6256, 6258, 6260, 6262, 6264, 6266, 6268, 6270, 6272, 6274, 6276, 6278, 6280, 6282, 6284, 6286, 6288, 6290, 6292, 6294, 6296, 6298, 6300, 6302, 6304, 6306, 6308, 6310, 6312, 6314, 6316, 6318, 6320, 6322, 6324, 6326, 6328, 6330, 6332, 6334, 6336, 6338, 6340, 6342, 6344, 6346, 6348, 6350, 6352, 6354, 6356, 6358, 6360, 6362, 6364, 6366, 6368, 6370, 6372, 6374, 6376, 6378, 6380, 6382, 6384, 6386, 6388, 6390, 6392, 6394, 6396, 6398, 6400, 6402, 6404, 6406, 6408, 6410, 6412, 6414, 6416, 6418, 6420, 6422, 6424, 6426, 6428, 6430, 6432, 6434, 6436, 6438, |

TABLE IA-continued

| | | Nucleic acid sequence ID numbers |
|---|---|---|
| | | 6440, 6442, 6444, 6446, 6448, 6450, 6452, 6454, 6456, 6458, 6460, 6462, 6464, 6466, 6468, 6470, 6472, 6474, 6476, 6478, 6480, 6482, 6484, 6486, 6488, 6490, 6492, 6494, 6496, 6498, 6500, 6502, 6504, 6506, 6508, 6510, 6512, 6514, 6516, 6518, 6520, 6522, 6524, 6526, 6528, 6530, 6532, 6534, 6536, 6538, 6540, 6542 |
| 1 | 36 | 6583, 6585, 6587, 6589, 6591, 6593, 6595, 6597, 6599, 6601, 6603 |
| 1 | 37 | 6611, 6613, 6615, 6617, 6619, 6621, 6623, 6625, 6627, 6629, 6631, 6633, 6635, 6637, 6639, 6641, 6643, 6645, 6647, 6649, 6651, 6653, 6655, 6657, 6659, 6661, 6663, 6665, 6667, 6669, 6671, 6673, 6675, 6677, 6679, 6681, 6683, 6685, 6687, 6689, 6691, 6693, 6695, 6697, 6699, 6701, 6703, 6705, 6707, 6709, 6711, 6713, 6715, 6717, 6719, 6721, 6723, 6725, 6727, 6729, 6731, 6733, 6735, 6737, 6739, 6741, 6743, 6745, 6747, 6749, 6751, 6753, 6755, 6757, 6759, 6761, 6763, 6765, 6767, 6769, 6771, 6773, 6775, 6777, 6779, 6781, 6783, 6785, 6787, 6789, 6791, 6793, 6795, 6797, 6799, 6801, 6803, 6805, 6807, 6809, 6811, 6813, 6815, 6817, 6819, 6821, 6823, 6825, 6827, 6829, 6831, 6833, 6835, 6837, 6839, 6841, 6843, 6845, 6847, 6849, 6851, 6853, 6855, 6857, 6859, 6861, 6863, 6865, 6867, 6869, 6871, 6873, 6875, 6877, 6879, 6881, 6883, 6885, 6887, 6889, 6891, 6893, 6895, 6897, 6899, 6901, 6903, 6905, 6907, 6909, 6911, 6913, 6915, 6917, 6919, 6921, 6923, 6925, 6927, 6929, 6931, 6933, 6935, 6937, 6939, 6941, 6943 |
| 1 | 38 | 6951, 6953, 6955, 6957, 6959, 6961, 6963, 6965, 6967, 6969, 6971, 6973, 6975, 6977, 6979, 6981, 6983, 6985, 6987, 6989, 6991, 6993, 6995, 6997, 6999, 7001, 7003, 7005, 7007, 7009, 7011, 7013, 7015, 7017, 7019, 7021, 7023, 7025, 7027, 7029, 7031, 7033, 7035, 7037, 7039, 7041, 7043, 7045, 7047, 7049, 7051, 7053, 7055, 7057, 7059, 7061, 7063, 7065, 7067 |
| 1 | 39 | 7080, 7082, 7084, 7086, 7088, 7090, 7092, 7094, 7096, 7098, 7100, 7102, 7104, 7106, 7108, 7110, 7112, 7114, 7116, 7118, 7120, 7122, 7124, 7126, 7128, 7130, 7132, 7134, 7136, 7138, 7140, 7142, 7144, 7146, 7148, 7150, 7152, 7154, 7156, 7158, 7160, 7162, 7164, 7166, 7168, 7170, 7172, 7174, 7176, 7178, 7180, 7182, 7184, 7186, 7188, 7190, 7192, 7194, 7196, 7198, 7200, 7202, 7204, 7206, 7208, 7210, 7212, 7214, 7216, 7218, 7220, 7222, 7224, 7226, 7228, 7230, 7232, 7234, 7236, 7238, 7240, 7242, 7244, 7246, 7248, 7250, 7252, 7254, 7256, 7258, 7260, 7262, 7264 |
| 1 | 40 | 7272, 7274, 7276, 7278, 7280, 7282, 7284, 7286, 7288, 7290, 7292, 7294, 7296, 7298, 7300, 7302, 7304, 7306, 7308, 7310, 7312, 7314, 7316, 7318, 7320, 7322, 7324, 7326, 7328, 7330, 7332, 7334, 7336, 7338, 7340, 7342, 7344, 7346, 7348, 7350, 7352, 7354, 7356, 7358, 7360, 7362, 7364, 7366, 7368, 7370, 7372, 7374, 7376, 7378, 7380, 7382, 7384, 7386, 7388, 7390, 7392, 7394, 7396, 7398, 7400, 7402, 7404, 7406, 7408, 7410, 7412, 7414, 7416, 7418, 7420, 7422, 7424, 7426, 7428, 7430, 7432, 7434, 7436, 7438, 7440, 7442, 7444, 7446, 7448, 7450, 7452, 7454, 7456, 7458, 7460 |
| 1 | 41 | 7469, 7471, 7473, 7475, 7477, 7479, 7481, 7483, 7485 |
| 1 | 42 | 7494, 7496, 7498, 7500, 7502, 7504, 7506, 7508, 7510, 7512, 7514, 7516, 7518, 7520, 7522, 7524, 7526, 7528, 7530, 7532, 7534, 7536, 7538, 7540, 7542, 7544, 7546, 7548, 7550, 7552, 7554, 7556, 7558, 7560, 7562, 7564, 7566, 7568, 7570, 7572, 7574, 7576, 7578, 7580, 7582 |
| 1 | 43 | 7593, 7595, 7597, 7599, 7601, 7603, 7605, 7607, 7609, 7611, 7613, 7615, 7617, 7619, 7621, 7623, 7625, 7627, 7629, 7631, 7633, 7635, 7637, 7639, 7641, 7643, 7645, 7647, 7649, 7651, 7653, 7655, 7657, 7659, 7661, 7663, 7665 |
| 1 | 44 | 7672, 7674, 7676, 7678, 7680, 7682, 7684, 7686, 7688, 7690, 7692, 7694, 7696, 7698, 7700, 7702, 7704, 77 06, 7708, 7710, 7712, 7714, 7716, 7718, 7720, 7722, 7724, 7726, 7728, 7730, 7732, 7734, 7736, 7738, 7740, 7742, 7744, 7746, 7748, 7750, 7752, 7754, 7756, 7758, 7760, 7762, 7764, 7766, 7768, 7770, 7772, 7774, 7776, 7778, 7780, 7782, 7784, 7786, 7788, 7790, 7792, 7794, 7796, 7798, 7800, 7802, 7804, 7806, 7808, 7810, 7812, 7814, 7816, 7818, 7820, 7822, 7824, 7826, 7828, 7830, 7832, 7834, 7836, 7838, 7840, 7842, 7844, 7846, 7848, 7850, 7852, 7854, 7856, 7858, 7860, 7862, 7864, 7866, 7868, 7870, 7872, 7874, 7876, 7878, 7880, 7882, 7884, 7886, 7888, 7890, 7892, 7894, 7896, 7898, 7900, 7902, 7904, 7906, 7908, 7910, 7912, 7914, 7916, 7918, 7920, 7922, 7924, 7926, 7928, 7930, 7932, 7934, 7936, 7938, 7940, 7942, 7944, 7946, 7948, 7950, 7952, 7954, 7956, 7958, 7960, 7962, 7964, 7966, 7968, 7970, 7972, 7974, 7976, 7978, 7980, 7982, 7984, 7986, 7988, 7990, 7992, 7994, 7996, 7998, 8000, 8002, 8004, 8006, 8008, 8010, 8012, 8014, 8016, 8018, 8020, 8022, 8024, 8026, 8028, 8030, 8032, 8034, 8036, 8038, 8040, 8042, 8044, 8046, 8048, 8050, 8052, 8054, 8056, 8058, 8060, 8062, 8064, 8066, 8068, 8070, 8072, 8074, 8076, 8078, 8080, 8082, 8084, 8086, 8088, 8090, 8092, 8094, 8096, 8098, 8100, 8102, 8104, 8106, 8108, 8110, 8112, 8114, 8116, 8118, 8120, 8122, 8124, 8126, 8128, 8130, 8132, 8134, 8136, 8138, 8140, 8142, 8144, 8146, 8148, 8150, 8152, 8154, |

TABLE IA-continued

| | | Nucleic acid sequence ID numbers |
|---|---|---|
| | | 8156, 8158, 8160, 8162, 8164, 8166, 8168, 8170, 8172, 8174, 8176, 8178, 8180, 8182, 8184, 8186, 8188, 8190, 8192, 8194, 8196, 8198, 8200, 8202, 8204, 8206, 8208, 8210, 8212, 8214, 8216, 8218, 8220, 8222 |
| 1 | 45 | 8238, 8240, 8242, 8244, 8246, 8248, 8250, 8252, 8254, 8256, 8258, 8260, 8262, 8264, 8266, 8268, 8270, 8272, 8274, 8276, 8278, 8280, 8282, 8284, 8286, 8288, 8290, 8292, 8294, 8296, 8298, 8300, 8302, 8304, 8306, 8308, 8310, 8312, 8314, 8316, 8318, 8320, 8322, 8324, 8326, 8328, 8330, 8332, 8334, 8336, 8338, 8340, 8342, 8344, 8346, 8348, 8350, 8352, 8354, 8356, 8358, 8360, 8362, 8364, 8366, 8368, 8370, 8372, 8374, 8376, 8378, 8380, 8382, 8384, 8386, 8388, 8390, 8392, 8394, 8396, 8398, 8400, 8402, 8404, 8406, 8408, 8410, 8412, 8414, 8416, 8418, 8420, 8422, 8424, 8426, 8428, 8430, 8432, 8434, 8436, 8438, 8440, 8442, 8444, 8446, 8448, 8450, 8452, 8454, 8456, 8458, 8460, 8462, 8464, 8466, 8468, 8470, 8472, 8474, 8476, 8478, 8480, 8482, 8484, 8486, 8488, 8490, 8492, 8494, 8496, 8498, 8500, 8502, 8504, 8506, 8508, 8510, 8512, 8514, 8516, 8518, 8520, 8522, 8524, 8526, 8528, 8530, 8532, 8534, 8536, 8538, 8540, 8542, 8544, 8546, 8548, 8550, 8552, 8554, 8556 |
| 1 | 46 | 8565, 8567, 8569, 8571, 8573, 8575, 8577, 8579, 8581, 8583, 8585, 8587, 8589, 8591, 8593, 8595, 8597, 8599, 8601, 8603, 8605, 8607, 8609, 8611, 8613, 8615, 8617, 8619, 8621, 8623, 8625, 8627, 8629, 8631, 8633, 8635 |
| 1 | 47 | 8650, 8652, 8654, 8656, 8658, 8660, 8662, 8664, 8666, 8668, 8670, 8672, 8674, 8676, 8678, 8680, 8682, 8684, 8686, 8688, 8690, 8692, 8694, 8696, 8698, 8700, 8702, 8704, 8706, 8708, 8710, 8712, 8714, 8716, 8718, 8720, 8722, 8724, 8726, 8728, 8730, 8732, 8734, 8736, 8738, 8740, 8742, 8744, 8746, 8748, 8750, 8752, 8754 |
| 1 | 48 | 8762, 8764, 8766, 8768, 8770, 8772, 8774, 8776, 8778, 8780, 8782, 8784, 8786, 8788, 8790, 8792, 8794, 8796, 8798, 8800, 8802, 8804, 8806, 8808, 8810, 8812, 8814, 8816, 8818, 8820, 8822, 8824, 8826, 8828, 8830, 8832, 8834, 8836, 8838, 8840, 8842, 8844, 8846, 8848 |
| 1 | 49 | 8863, 8865, 8867, 8869, 8871, 8873, 8875, 8877, 8879, 8881, 8883, 8885, 8887, 8889, 8891, 8893, 8895, 8897, 8899, 8901, 8903, 8905, 8907, 8909, 8911, 8913, 8915, 8917, 8919, 8921, 8923, 8925, 8927, 8929, 8931, 8933, 8935, 8937, 8939, 8941, 8943, 8945, 8947, 8949, 8951, 8953, 8955, 8957, 8959, 8961, 8963, 8965, 8967, 8969, 8971, 8973, 8975, 8977, 8979, 8981, 8983, 8985, 8987, 8989, 8991, 8993, 8995, 8997, 8999, 9001, 9003, 9005, 9007, 9009, 9011, 9013, 9015, 9017, 9019, 9021, 9023, 9025, 9027, 9029, 9031, 9033, 9035, 9037, 9039 |
| 1 | 50 | 9048, 9050, 9052, 9054, 9056, 9058, 9060, 9062, 9064, 9066, 9068, 9070, 9072, 9074, 9076, 9078, 9080, 9082, 9084, 9086, 9088, 9090, 9092, 9094, 9096, 9098, 9100, 9102, 9104, 9106, 9108, 9110, 9112, 9114, 9116, 9118, 9120, 9122, 9124, 9126, 9128, 9130, 9132, 9134, 9136, 9138, 9140, 9142, 9144, 9146, 9148, 9150, 9152, 9154, 9156, 9158, 9160, 9162, 9164, 9166, 9168, 9170, 9172, 9174, 9176, 9178, 9180, 9182, 9184, 9186, 9188, 9190, 9192, 9194, 9196, 9198, 9200, 9202, 9204, 9206, 9208, 9210, 9212, 9214, 9216, 9218, 9220, 9222, 9224, 9226, 9228, 9230, 9232, 9234, 9236, 9238, 9240, 9242, 9244, 9246, 9248, 9250, 9252, 9254, 9256, 9258, 9260, 9262, 9264, 9266, 9268, 9270, 9272, 9274 |
| 1 | 51 | 9282, 9284, 9286, 9288, 9290, 9292, 9294, 9296, 9298 |
| 1 | 52 | 9309, 9311, 9313, 9315, 9317, 9319, 9321, 9323, 9325, 9327, 9329, 9331, 9333, 9335, 9337, 9339, 9341, 9343, 9345, 9347, 9349, 9351, 9353, 9355, 9357, 9359, 9361, 9363, 9365, 9367, 9369, 9371, 9373, 9375, 9377, 9379, 9381, 9383, 9385, 9387, 9389, 9391, 9393, 9395, 9397, 9399, 9401, 9403, 9405, 9407, 9409, 9411, 9413, 9415, 9417, 9419, 9421, 9423 |
| 1 | 53 | 9432, 9434, 9436, 9438, 9440, 9442, 9444, 9446, 9448, 9450, 9452, 9454, 9456, 9458, 9460, 9462, 9464, 9466, 9468, 9470, 9472 |
| 1 | 54 | 9481, 9483, 9485 |
| 1 | 55 | 9502, 9504, 9506, 9508, 9510, 9512, 9514, 9516, 9518, 9520, 9522, 9524, 9526, 9528, 9530, 9532, 9534, 9536, 9538, 9540, 9542, 9544, 9546 |
| 1 | 56 | 9555, 9557, 9559, 9561, 9563, 9565 |
| 1 | 57 | 9576, 9578, 9580, 9582, 9584, 9586, 9588, 9590, 9592, 9594, 9596, 9598, 9600, 9602, 9604, 9606, 9608, 9610, 9612, 9614, 9616, 9618, 9620, 9622, 9624, 9626, 9628, 9630, 9632, 9634, 9636, 9638, 9640, 9642, 9644, 9646, 9648, 9650, 9652, 9654, 9656, 9658, 9660, 9662, 9664, 9666, 9668, 9670, 9672, 9674, 9676, 9678, 9680, 9682, 9684, 9686, 9688, 9690, 9692, 9694, 9696, 9698, 9700, 9702, 9704, 9706, 9708, 9710, 9712, 9714, 9716, 9718, 9720, 9722, 9724, 9726, 9728, 9730, 9732, 9734, 9736, 9738, 9740, 9742, 9744, 9746, 9748, 9750, 9752, 9754, 9756, 9758, 9760, 9762, 9764, 9766, 9768, 9770, 9772, 9774, 9776, 9778, 9780, 9782, 9784, 9786, 9788, 9790, 9792, 9794, 9796, 9798, 9800, 9802, 9804, 9806, 9808, 9810, 9812, 9814, 9816, 9818, 9820, 9822, 9824, 9826, 9828, 9830, 9832, 9834, 9836, 9838, |

TABLE IA-continued

Nucleic acid sequence ID numbers

|   |   |   |
|---|---|---|
|   |   | 9840, 9842, 9844, 9846, 9848, 9850, 9852, 9854, 9856, 9858, 9860, 9862, 9864, 9866, 9868, 9870, 9872, 9874, 9876, 9878, 9880, 9882, 9884, 9886, 9888, 9890, 9892, 9894, 9896, 9898, 9900, 9902, 9904, 9906, 9908, 9910, 9912, 9914, 9916, 9918, 9920, 9922, 9924, 9926, 9928, 9930, 9932, 9934, 9936, 9938, 9940, 9942, 9944, 9946, 9948, 9950, 9952, 9954, 9956, 9958, 9960, 9962, 9964, 9966, 9968, 9970, 9972, 9974, 9976, 9978, 9980, 9982, 9984, 9986, 9988, 9990, 9992, 9994, 9996, 9998, 10000, 10002, 10004, 10006, 10008, 10010, 10012, 10014, 10016, 10018, 10020, 10022, 10024, 10026, 10028, 10030, 10032, 10034, 10036, 10038, 10040, 10042, 10044, 10046, 10048, 10050, 10052, 10054, 10056, 10058, 10060, 10062, 10064, 10066, 10068, 10070, 10072, 10074, 10076, 10078, 10080, 10082, 10084, 10086, 10088, 10090, 10092, 10094, 10096, 10098, 10100, 10102, 10104, 10106, 10108, 10110, 10112, 10114, 10116, 10118, 10120, 10122, 10124, 10126, 10128, 10130, 10132, 10134, 10136, 10138, 10140, 10142, 10144, 10146, 10148, 10150, 10152, 10154, 10156, 10158, 10160, 10162, 10164, 10166, 10168, 10170, 10172, 10174, 10176, 10178, 10180, 10182, 10184, 10186, 10188, 10190, 10192, 10194, 10196, 10198, 10200, 10202, 10204, 10206, 10208, 10210, 10212, 10214, 10216, 10218, 10220, 10222, 10224, 10226, 10228, 10230, 10232, 10234, 10236, 10238, 10240, 10242, 10244, 10246, 10248, 10250, 10252, 10254, 10256, 10258, 10260, 10262, 10264, 10266, 10268, 10270, 10272, 10274, 10276, 10278, 10280, 10282, 10284, 10286, 10288, 10290, 10292, 10294, 10296, 10298, 10300, 10302, 10304, 10306, 10308, 10310, 10312, 10314, 10316, 10318, 10320, 10322, 10324, 10326, 10328, 10330, 10332, 10334, 10336, 10338, 10340, 10342, 10344, 10346, 10348, 10350, 10352, 10354, 10356, 10358, 10360, 10362, 10364, 10366, 10368, 10370, 10372, 10374, 10376, 10378, 10380, 10382, 10384, 10386, 10388 |
| 1 | 58 | 10406, 10408, 10410, 10412, 10414, 10416, 10418, 10420, 10422, 10424, 10426, 10428, 10430, 10432, 10434, 10436, 10438, 10440, 10442, 10444, 10446, 10448, 10450, 10452, 10454, 10456, 10458, 10460, 10462, 10464, 10466, 10468, 10470, 10472, 10474, 10476, 10478, 10480, 10482, 10484, 10486, 10488, 10490, 10492, 10494 |
| 1 | 59 | 10505, 10507, 10509, 10511, 10513, 10515, 10517, 10519, 10521, 10523, 10525, 10527, 10529, 10531, 10533, 10535, 10537, 10539, 10541, 10543, 10545, 10547, 10549, 10551, 10553, 10555, 10557, 10559, 10561, 10563, 10565, 10567, 10569, 10571, 10573, 10575, 10577, 10579, 10581, 10583 |
| 1 | 60 | 10593, 10595, 10597, 10599, 10601, 10603, 10605, 10607, 10609, 10611, 10613, 10615, 10617, 10619, 10621, 10623, 10625, 10627, 10629, 10631, 10633, 10635, 10637, 10639, 10641, 10643, 10645, 10647, 10649, 10651, 10653, 10655, 10657, 10659, 10661, 10663, 10665, 10667, 10669, 10671, 10673, 10675, 10677, 10679, 10681, 10683, 10685, 10687, 10689, 10691, 10693, 10695, 10697, 10699, 10701, 10703, 10705, 10707, 10709, 10711, 10713, 10715, 10717, 10719, 10721, 10723, 10725, 10727, 10729, 10731, 10733, 10735, 10737, 10739, 10741, 10743, 10745, 10747, 10749, 10751, 10753, 10755, 10757, 10759, 10761, 10763, 10765, 10767, 10769, 10771, 10773, 10775, 10777, 10779, 10781, 10783, 10785, 10787, 10789, 10791, 10793, 10795, 10797, 10799, 10801, 10803, 10805, 10807, 10809, 10811, 10813, 10815, 10817, 10819, 10821, 10823, 10825, 10827, 10829, 10831, 10833, 10835, 10837, 10839, 10841, 10843, 10845, 10847, 10849, 10851, 10853, 10855, 10857, 10859, 10861, 10863, 10865, 10867, 10869, 10871, 10873, 10875, 10877, 10879, 10881, 10883, 10885, 10887, 10889, 10891, 10893, 10895, 10897, 10899, 10901, 10903, 10905, 10907, 10909, 10911, 10913, 10915, 10917, 10919, 10921, 10923, 10925, 10927 |
| 1 | 61 | 10936, 10938, 10940, 10942, 10944, 10946, 10948, 10950, 10952, 10954, 10956, 10958, 10960, 10962, 10964, 10966, 10968, 10970, 10972, 10974, 10976, 10978, 10980, 10982, 10984, 10986, 10988, 10990, 10992, 10994, 10996, 10998, 11000, 11002, 11004, 11006, 11008, 11010, 11012, 11014, 11016, 11018, 11020, 11022, 11024, 11026, 11028, 11030, 11032, 11034, 11036, 11038, 11040, 11042, 11044, 11046, 11048, 11050, 11052, 11054, 11056, 11058, 11060, 11062, 11064, 11066, 11068, 11070, 11072, 11074, 11076, 11078, 11080, 11082, 11084, 11086, 11088, 11090, 11092, 11094, 11096, 11098, 11100, 11102, 11104, 11106, 11108, 11110, 11112, 11114, 11116, 11118, 11120, 11122, 11124, 11126, 11128, 11130, 11132, 11134, 11136, 11138, 11140, 11142, 11144, 11146, 11148, 11150, 11152, 11154, 11156, 11158, 11160, 11162, 11164, 11166, 11168, 11170, 11172, 11174, 11176, 11178, 11180, 11182, 11184, 11186, 11188, 11190, 11192, 11194, 11196, 11198, 11200, 11202, 11204, 11206, 11208, 11210, 11212, 11214, 11216, 11218, 11220, 11222, 11224, 11226, 11228, 11230, 11232, 11234, 11236, 11238, 11240, 11242, 11244, 11246, 11248, 11250, 11252, 11254, 11256, 11258, 11260, 11262, 11264, 11266, 11268, 11270, 11272, 11274, 11276, 11278, 11280, 11282, 11284, 11286, 11288, 11290, 11292, 11294, |

TABLE IA-continued

| | | Nucleic acid sequence ID numbers |
|---|---|---|
| | | 11296, 11298, 11300, 11302, 11304, 11306, 11308, 11310, 11312, 11314, 11316, 11318, 11320, 11322, 11324, 11326, 11328, 11330, 11332, 11334, 11336, 11338, 11340, 11342, 11344, 11346, 11348, 11350, 11352, 11354, 11356, 11358, 11360, 11362, 11364, 11366, 11368, 11370, 11372, 11374, 11376, 11378, 11380, 11382, 11384, 11386, 11388, 11390, 11392, 11394, 11396, 11398, 11400, 11402, 11404, 11406, 11408, 11410, 11412, 11414, 11416, 11418, 11420, 11422, 11424, 11426, 11428, 11430, 11432, 11434, 11436, 11438, 11440, 11442, 11444, 11446, 11448, 11450, 11452 |
| 1 | 62 | 11463, 11465, 11467, 11469, 11471, 11473, 11475, 11477, 11479, 11481, 11483, 11485 |
| 1 | 63 | 11503, 11505, 11507, 11509, 11511, 11513, 11515, 11517, 11519, 11521, 11523, 11525, 11527, 11529, 11531, 11533, 11535, 11537, 11539, 11541, 11543, 11545, 11547 |
| 1 | 64 | 11566, 11568, 11570, 11572, 11574, 11576, 11578, 11580, 11582, 11584, 11586, 11588, 11590, 11592, 11594, 11596, 11598, 11600, 11602, 11604, 11606, 11608, 11610, 11612, 11614, 11616, 11618, 11620, 11622, 11624, 11626, 11628, 11630, 11632, 11634, 11636, 11638, 11640, 11642, 11644, 11646, 11648, 11650, 11652, 11654, 11656, 11658, 11660, 11662, 11664, 11666, 11668, 11670, 11672, 11674, 11676, 11678, 11680, 11682, 11684 |
| 1 | 65 | 11697, 11699, 11701, 11703, 11705, 11707, 11709, 11711, 11713, 11715, 11717, 11719, 11721, 11723, 11725, 11727, 11729, 11731, 11733, 11735, 11737, 11739, 11741, 11743, 11745, 11747, 11749, 11751, 11753, 11755, 11757, 11759, 11761, 11763, 11765, 11767, 11769, 11771, 11773, 11775, 11777, 11779, 11781, 11783, 11785, 11787, 11789, 11791, 11793, 11795, 11797, 11799, 11801, 11803, 11805, 11807, 11809, 11811, 11813, 11815, 11817, 11819, 11821, 11823, 11825, 11827, 11829, 11831, 11833, 11835, 11837, 11839, 11841, 11843, 11845, 11847, 11849, 11851, 11853, 11855, 11857, 11859, 11861, 11863, 11865, 11867, 11869, 11871, 11873, 11875, 11877, 11879, 11881, 11883, 11885, 11887, 11889, 11891, 11893, 11895, 11897 |
| 1 | 66 | 11909, 11911, 11913, 11915, 11917, 11919, 11921, 11923, 11925, 11927, 11929, 11931 |
| 1 | 67 | 11946, 11948, 11950, 11952, 11954, 11956, 11958, 11960, 11962, 11964, 11966, 11968, 11970, 11972, 11974, 11976, 11978, 11980, 11982, 11984, 11986, 11988, 11990, 11992, 11994, 11996, 11998, 12000, 12002, 12004, 12006, 12008, 12010, 12012, 12014, 12016, 12018, 12020, 12022, 12024, 12026, 12028, 12030, 12032, 12034, 12036, 12038, 12040, 12042, 12044, 12046, 12048, 12050, 12052, 12054, 12056, 12058, 12060, 12062, 12064, 12066, 12068, 12070, 12072, 12074, 12076, 12078, 12080, 12082, 12084, 12086, 12088, 12090, 12092, 12094, 12096, 12098, 12100, 12102, 12104, 12106, 12108, 12110, 12112, 12114, 12116, 12118, 12120, 12122, 12124, 12126, 12128, 12130, 12132, 12134, 12136, 12138, 12140, 12142, 12144, 12146, 12148, 12150, 12152, 12154, 12156, 12158, 12160, 12162, 12164, 12166, 12168, 12170, 12172, 12174, 12176, 12178, 12180, 12182, 12184, 12186, 12188, 12190, 12192, 12194, 12196, 12198, 12200, 12202, 12204, 12206, 12208, 12210, 12212, 12214, 12216, 12218, 12220, 12222, 12224, 12226, 12228, 12230, 12232, 12234, 12236, 12238, 12240, 12242, 12244, 12246, 12248, 12250, 12252, 12254, 12256, 12258, 12260, 12262, 12264, 12266, 12268, 12270, 12272, 12274, 12276, 12278, 12280, 12282, 12284, 12286, 12288, 12290, 12292, 12294, 12296, 12298, 12300, 12302, 12304, 12306, 12308, 12310, 12312, 12314, 12316, 12318, 12320, 12322, 12324, 12326, 12328, 12330, 12332, 12334, 12336, 12338, 12340, 12342, 12344, 12346 |
| 1 | 68 a | 12359, 12361, 12363, 12365, 12367, 12369, 12371, 12373, 12375, 12377, 12379, 12381, 12383, 12385, 12387, 12389, 12391, 12393, 12395, 12397, 12399, 12401, 12403, 12405, 12407, 12409, 12411, 12413, 12415, 12417, 12419, 12421, 12423, 12425, 12427, 12429, 12431, 12433, 12435, 12437, 12439, 12441, 12443, 12445, 12447, 12449, 12451, 12453, 12455, 12457, 12459, 12461, 12463, 12465, 12467, 12469, 12471, 12473, 12475, 12477, 12479, 12481, 12483, 12485, 12487, 12489, 12491, 12493, 12495, 12497, 12499, 12501, 12503, 12505, 12507, 12509, 12511, 12513, 12515, 12517, 12519, 12521, 12523, 12525, 12527, 12529, 12531, 12533, 12535, 12537, 12539, 12541, 12543, 12545, 12547, 12549, 12551, 12553, 12555, 12557, 12559, 12561, 12563, 12565, 12567, 12569, 12571, 12573, 12575, 12577, 12579, 12581, 12583, 12585, 12587, 12589, 12591, 12593, 12595, 12597, 12599, 12601, 12603, 12605, 12607, 12609, 12611, 12613, 12615, 12617, 12619, 12621, 12623, 12625, 12627, 12629, 12631, 12633, 12635, 12637, 12639, 12641, 12643, 12645, 12647, 12649, 12651, 12653, 12655, 12657, 12659, 12661, 12663, 12665, 12667, 12669, 12671, 12673, 12675, 12677, 12679, 12681, 12683, 12685, 12687, 12689, 12691, 12693, 12695, 12697, 12699, 12701, 12703, 12705, 12707, 12709, 12711, 12713, 12715, 12717, |

TABLE IA-continued

Nucleic acid sequence ID numbers

| | | |
|---|---|---|
| | | 12719, 12721, 12723, 12725, 12727, 12729, 12731, 12733, 12735, 12737, 12739, 12741, 12743, 12745, 12747, 12749, 12751, 12753, 12755, 12757, 12759, 12761, 12763, 12765, 12767, 12769, 12771, 12773, 12775, 12777, 12779, 12781, 12783, 12785, 12787, 12789, 12791, 12793, 12795, 12797, 12799, 12801, 12803, 12805, 12807, 12809, 12811, 12813, 12815, 12817, 12819, 12821, 12823, 12825, 12827, 12829, 12831, 12833, 12835, 12837, 12839, 12841, 12843, 12845, 12847, 12849, 12851, 12853, 12855, 12857, 12859, 12861, 12863, 12865, 12867, 12869, 12871, 12873, 12875, 12877, 12879, 12881, 12883, 12885, 12887, 12889, 12891, 12893, 12895, 12897, 12899, 12901, 12903, 12905, 12907, 12909, 12911, 12913, 12915, 12917, 12919, 12921, 12923 |
| 1 | 68 b | 12359, 12361, 12363, 12365, 12367, 12369, 12371, 12373, 12375, 12377, 12379, 12381, 12383, 12385, 12387, 12389, 12391, 12393, 12395, 12397, 12399, 12401, 12403, 12405, 12407, 12409, 12411, 12413, 12415, 12417, 12419, 12421, 12423, 12425, 12427, 12429, 12431, 12433, 12435, 12437, 12439, 12441, 12443, 12445, 12447, 12449, 12451, 12453, 12455, 12457, 12459, 12461, 12463, 12465, 12467, 12469, 12471, 12473, 12475, 12477, 12479, 12481, 12483, 12485, 12487, 12489, 12491, 12493, 12495, 12497, 12499, 12501, 12503, 12505, 12507, 12509, 12511, 12513, 12515, 12517, 12519, 12521, 12523, 12525, 12527, 12529, 12531, 12533, 12535, 12537, 12539, 12541, 12543, 12545, 12547, 12549, 12551, 12553, 12555, 12557, 12559, 12561, 12563, 12565, 12567, 12569, 12571, 12573, 12575, 12577, 12579, 12581, 12583, 12585, 12587, 12589, 12591, 12593, 12595, 12597, 12599, 12601, 12603, 12605, 12607, 12609, 12611, 12613, 12615, 12617, 12619, 12621, 12623, 12625, 12627, 12629, 12631, 12633, 12635, 12637, 12639, 12641, 12643, 12645, 12647, 12649, 12651, 12653, 12655, 12657, 12659, 12661, 12663, 12665, 12667, 12669, 12671, 12673, 12675, 12677, 12679, 12681, 12683, 12685, 12687, 12689, 12691, 12693, 12695, 12697, 12699, 12701, 12703, 12705, 12707, 12709, 12711, 12713, 12715, 12717, 12719, 12721, 12723, 12725, 12727, 12729, 12731, 12733, 12735, 12737, 12739, 12741, 12743, 12745, 12747, 12749, 12751, 12753, 12755, 12757, 12759, 12761, 12763, 12765, 12767, 12769, 12771, 12773, 12775, 12777, 12779, 12781, 12783, 12785, 12787, 12789, 12791, 12793, 12795, 12797, 12799, 12801, 12803, 12805, 12807, 12809, 12811, 12813, 12815, 12817, 12819, 12821, 12823, 12825, 12827, 12829, 12831, 12833, 12835, 12837, 12839, 12841, 12843, 12845, 12847, 12849, 12851, 12853, 12855, 12857, 12859, 12861, 12863, 12865, 12867, 12869, 12871, 12873, 12875, 12877, 12879, 12881, 12883, 12885, 12887, 12889, 12891, 12893, 12895, 12897, 12899, 12901, 12903, 12905, 12907, 12909, 12911, 12913, 12915, 12917, 12919, 12921, 12923 |
| 1 | 69 | 12938, 12940, 12942, 12944, 12946, 12948, 12950, 12952, 12954, 12956, 12958, 12960, 12962, 12964, 12966, 12968, 12970, 12972, 12974, 12976, 12978, 12980, 12982, 12984, 12986, 12988, 12990, 12992, 12994, 12996, 12998, 13000, 13002, 13004, 13006, 13008, 13010, 13012, 13014, 13016, 13018, 13020, 13022, 13024, 13026, 13028, 13030, 13032, 13034, 13036, 13038, 13040, 13042, 13044, 13046, 13048, 13050, 13052, 13054, 13056, 13058, 13060, 13062, 13064, 13066, 13068, 13070, 13072, 13074, 13076, 13078, 13080, 13082, 13084, 13086, 13088, 13090, 13092, 13094, 13096, 13098, 13100, 13102, 13104, 13106, 13108, 13110, 13112, 13114, 13116, 13118, 13120, 13122, 13124, 13126, 13128, 13130, 13132, 13134, 13136, 13138, 13140, 13142, 13144, 13146, 13148, 13150, 13152, 13154, 13156, 13158, 13160, 13162, 13164, 13166, 13168, 13170, 13172, 13174, 13176, 13178, 13180, 13182, 13184, 13186, 13188, 13190, 13192, 13194, 13196, 13198, 13200, 13202 |

TABLE IB

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 1 | LT_OEX_1 | B0414 | E. coli | 38 | Cytoplasmic | — |
| 1 | 2 | LT_OEX_1 | B2931 | E. coli | 147 | Cytoplasmic | — |
| 1 | 3 | LT_OEX_1 | B3945 | E. coli | 172 | Cytoplasmic | — |
| 1 | 4 | LT_OEX_1 | YEL004W | S. cerevisiae | 382 | Cytoplasmic | — |
| 1 | 5 | LT_OEX_1 | YER177W | S. cerevisiae | 406 | Cytoplasmic | 748, 750, 752, 754, 756, 758, 760, 762, 764, 766, 768, 770, 772, 774, 776, 778, 780, 782, 784, 786, 788, 790, 792, 794, 796, 798, 800, 802, |

TABLE IB-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| | | | | | | | 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906 |
| 1 | 6 | LT_OEX_1 | YHR204W | S. cerevisiae | 917 | Cytoplasmic | — |
| 1 | 7 | LT_OEX_1 | YLL053C | S. cerevisiae | 952 | Cytoplasmic | 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, 1286, 1288, 1290, 1292, 1294, 1296, 1298, 1300, 1302, 1304, 1306, 1308, 1310, 1312, 1314, 13269, 13271, 13273 |
| 1 | 8 | LT_OEX_1 | YML123C | S. cerevisiae | 1320 | Cytoplasmic | 1616, 1618, 1620, 1622, 1624, 1626, 1628, 1630, 1632, 1634 |
| 1 | 9 | LT_OEX_1 | YNL142W | S. cerevisiae | 1648 | Cytoplasmic | 2056 |
| 1 | 10 | LT_OEX_1 | YNR040W | S. cerevisiae | 2065 | Cytoplasmic | — |
| 1 | 11 | LT_OEX_1 | YPR035W | S. cerevisiae | 2081 | Cytoplasmic | 2347, 2349, 2351, 2353, 2355, 2357, 2359, 2361, 2363, 2365, 2367, 2369, 2371, 2373, 2375, 2377, 2379, 2381, 2383, 2385, 2387, 2389, 2391, 2393 |
| 1 | 12 a | LT_OEX_1 | B0903 | E. coli | 2406 | Plastidic | — |
| 1 | 12 b | LT_OEX_1 | B0903 | E. coli | 2406 | Cytoplasmic | — |
| 1 | 13 | LT_OEX_1 | B1393 | E. coli | 2564 | Cytoplasmic | 2804, 2806, 2808, 2810, 2812, 2814, 2816, 2818, 2820, 2822, 2824, 2826, 2828, 2830, 2832, 2834 |
| 1 | 14 | LT_OEX_1 | B2704 | E. coli | 2841 | Plastidic | — |
| 1 | 15 | LT_OEX_1 | B2905 | E. coli | 2879 | Cytoplasmic | 3087, 3089, 3091, 3093, 3095, 3097, 3099 |
| 1 | 16 | LT_OEX_1 | B3206 | E. coli | 3109 | Plastidic | — |
| 1 | 17 | LT_OEX_1 | B3659 | E. coli | 3403 | Cytoplasmic | — |
| 1 | 18 | LT_OEX_1 | B3871 | E. coli | 3441 | Cytoplasmic | 3955, 3957, 3959, 3961, 3963 |
| 1 | 19 | LT_OEX_1 | YDR142C | S. cerevisiae | 3978 | Plastidic | 4036, 13265 |
| 1 | 20 | LT_OEX_1 | YER175W-A | S. cerevisiae | 4047 | Cytoplasmic | — |
| 1 | 21 | LT_OEX_1 | YGR289C | S. cerevisiae | 4051 | Plastidic | — |
| 1 | 22 | LT_OEX_1 | YHR044C | S. cerevisiae | 4131 | Plastidic | — |
| 1 | 23 | LT_OEX_1 | YHR072W | S. cerevisiae | 4217 | Cytoplasmic | 4461, 4463, 4465, 4467, 4469, 4471, 4473, 4475, 4477, 4479 |
| 1 | 24 | LT_OEX_1 | YHR213W-A | S. cerevisiae | 4491 | Cytoplasmic | — |
| 1 | 25 | LT_OEX_1 | YIL053W | S. cerevisiae | 4495 | Cytoplasmic | — |
| 1 | 26 | LT_OEX_1 | YJL103C | S. cerevisiae | 4558 | Plastidic | — |
| 1 | 27 | LT_OEX_1 | YJL137C | S. cerevisiae | 4589 | Plastidic | — |
| 1 | 28 | LT_OEX_1 | YLR027C | S. cerevisiae | 4622 | Cytoplasmic | 5020, 5022, 5024, 5026, 5028, 5030, 5032, 5034, 5036, 5038, 5040, 5042, 5044, 5046, 5048, 5050, 5052, 5054, 5056, 5058, 5060 |
| 1 | 29 a | LT_OEX_1 | YML079W | S. cerevisiae | 5070 | Plastidic | — |
| 1 | 29 b | LT_OEX_1 | YML079W | S. cerevisiae | 5070 | Cytoplasmic | — |
| 1 | 30 | LT_OEX_1 | YMR157C | S. cerevisiae | 5102 | Plastidic | — |
| 1 | 31 | LT_OEX_1 | YNL024C | S. cerevisiae | 5115 | Plastidic | — |
| 1 | 32 a | LT_OEX_1 | YOL058W | S. cerevisiae | 5159 | Plastidic | 5735, 5737, 5739 |
| 1 | 32 b | LT_OEX_1 | YOL058W | S. cerevisiae | 5159 | Cytoplasmic | 5735, 5737, 5739 |
| 1 | 33 | LT_OEX_1 | YPL180W | S. cerevisiae | 5746 | Cytoplasmic | — |
| 1 | 34 | LT_OEX_1 | YPR167C | S. cerevisiae | 5756 | Plastidic | 6048 |
| 1 | 35 | LT_OEX_1 | B0036 | E. coli | 6086 | Plastidic | 6544, 6546, 6548, 6550, 6552, 6554, 6556, 6558, 6560, 6562, 6564, 6566, 6568, 6570, 6572, 6574 |
| 1 | 36 | LT_OEX_1 | B1906 | E. coli | 6581 | Cytoplasmic | — |
| 1 | 37 | LT_OEX_1 | B2371 | E. coli | 6609 | Cytoplasmic | — |
| 1 | 38 | LT_OEX_1 | B2881 | E. coli | 6949 | Cytoplasmic | 7069, 7071 |
| 1 | 39 | LT_OEX_1 | B3106 | E. coli | 7078 | Cytoplasmic | — |
| 1 | 40 | LT_OEX_1 | B3400 | E. coli | 7270 | Plastidic | — |
| 1 | 41 | LT_OEX_1 | B3410 | E. coli | 7467 | Cytoplasmic | — |
| 1 | 42 | LT_OEX_1 | B4209 | E. coli | 7492 | Plastidic | — |
| 1 | 43 | LT_OEX_1 | SLL1545 | Synechocystis | 7591 | Cytoplasmic | — |
| 1 | 44 | LT_OEX_1 | SLR1348 | Synechocystis | 7670 | Mitochondric | 8224, 8226, 8228 |
| 1 | 45 | LT_OEX_1 | YGR191W | S. cerevisiae | 8236 | Plastidic | — |
| 1 | 46 | LT_OEX_1 | AT1G22920 | A. thaliana | 8563 | Cytoplasmic | 8637 |
| 1 | 47 | LT_OEX_1 | B1600 | E. coli | 8648 | Plastidic | — |
| 1 | 48 | LT_OEX_1 | B1900 | E. coli | 8760 | Plastidic | — |
| 1 | 49 | LT_OEX_1 | SLL0099 | Synechocystis | 8861 | Cytoplasmic | — |
| 1 | 50 | LT_OEX_1 | SLL0383 | Synechocystis | 9046 | Cytoplasmic | — |
| 1 | 51 | LT_OEX_1 | SLR1094 | Synechocystis | 9280 | Cytoplasmic | — |
| 1 | 52 | LT_OEX_1 | SLR1520 | Synechocystis | 9307 | Cytoplasmic | — |
| 1 | 53 | LT_OEX_1 | YDL142C | S. cerevisiae | 9430 | Cytoplasmic | — |
| 1 | 54 | LT_OEX_1 | YDR147W | S. cerevisiae | 9479 | Cytoplasmic | — |
| 1 | 55 | LT_OEX_1 | YLR284C | S. cerevisiae | 9500 | Plastidic | — |
| 1 | 56 | LT_OEX_1 | YPL148C | S. cerevisiae | 9553 | Plastidic | — |

TABLE IB-continued

Nucleic acid sequence ID numbers

| Application | 1. Hit | 2. Project | 3. Locus | 4. Organism | 5. Lead SEQ ID | 6. Target | 7. SEQ IDs of Nucleic Acid Homologs |
|---|---|---|---|---|---|---|---|
| 1 | 57 | LT_OEX_1 | YPR074C | S. cerevisiae | 9574 | Plastidic | 10390, 10392 |
| 1 | 58 | LT_OEX_1 | B1008 | E. coli | 10404 | Plastidic | — |
| 1 | 59 | LT_OEX_1 | B1529 | E. coli | 10503 | Plastidic | — |
| 1 | 60 | LT_OEX_1 | B3347 | E. coli | 10591 | Plastidic | — |
| 1 | 61 | LT_OEX_1 | YBR176W | S. cerevisiae | 10934 | Cytoplasmic | 11454 |
| 1 | 62 | LT_OEX_1 | YGR177C | S. cerevisiae | 11461 | Cytoplasmic | — |
| 1 | 63 | LT_OEX_1 | YHR176W | S. cerevisiae | 11501 | Cytoplasmic | 11549, 11551, 11553, 11555, 11557 |
| 1 | 64 | LT_OEX_1 | B2881_2 | E. coli | 11564 | Cytoplasmic | 11686, 11688 |
| 1 | 65 | LT_OEX_1 | B3945_2 | E. coli | 11695 | Cytoplasmic | — |
| 1 | 66 | LT_OEX_1 | YHR204W_2 | S. cerevisiae | 11907 | Cytoplasmic | — |
| 1 | 67 | LT_OEX_1 | YNL142W_2 | S. cerevisiae | 11944 | Cytoplasmic | 12348 |
| 1 | 68 a | LT_OEX_1 | YOL058W_2 | S. cerevisiae | 12357 | Plastidic | 12925, 12927, 12929 |
| 1 | 68 b | LT_OEX_1 | YOL058W_2 | S. cerevisiae | 12357 | Cytoplasmic | 12925, 12927, 12929 |
| 1 | 69 | LT_OEX_1 | YPR035W_2 | S. cerevisiae | 12936 | Cytoplasmic | 13204, 13206, 13208, 13210, 13212, 13214, 13216, 13218, 13220, 13222, 13224, 13226, 13228, 13230, 13232, 13234, 13236, 13238, 13240, 13242, 13244, 13246, 13248, 13250 |

TABLE IIA

Amino acid sequence ID numbers

| Application | 1. Hit | 2. Project | 3. Locus | 4. Organism | 5. Lead SEQ ID | 6. Target |
|---|---|---|---|---|---|---|
| 1 | 1 | LT_OEX_1 | B0414 | E. coli | 39 | Cytoplasmic |
| 1 | 2 | LT_OEX_1 | B2931 | E. coli | 148 | Cytoplasmic |
| 1 | 3 | LT_OEX_1 | B3945 | E. coli | 173 | Cytoplasmic |
| 1 | 4 | LT_OEX_1 | YEL004W | S. cerevisiae | 383 | Cytoplasmic |
| 1 | 5 | LT_OEX_1 | YER177W | S. cerevisiae | 407 | Cytoplasmic |
| 1 | 6 | LT_OEX_1 | YHR204W | S. cerevisiae | 918 | Cytoplasmic |
| 1 | 7 | LT_OEX_1 | YLL053C | S. cerevisiae | 953 | Cytoplasmic |
| 1 | 8 | LT_OEX_1 | YML123C | S. cerevisiae | 1321 | Cytoplasmic |
| 1 | 9 | LT_OEX_1 | YNL142W | S. cerevisiae | 1649 | Cytoplasmic |
| 1 | 10 | LT_OEX_1 | YNR040W | S. cerevisiae | 2066 | Cytoplasmic |
| 1 | 11 | LT_OEX_1 | YPR035W | S. cerevisiae | 2082 | Cytoplasmic |
| 1 | 12 a | LT_OEX_1 | B0903 | E. coli | 2407 | Plastidic |
| 1 | 12 b | LT_OEX_1 | B0903 | E. coli | 2407 | Cytoplasmic |
| 1 | 13 | LT_OEX_1 | B1393 | E. coli | 2565 | Cytoplasmic |
| 1 | 14 | LT_OEX_1 | B2704 | E. coli | 2842 | Plastidic |
| 1 | 15 | LT_OEX_1 | B2905 | E. coli | 2880 | Cytoplasmic |
| 1 | 16 | LT_OEX_1 | B3206 | E. coli | 3110 | Plastidic |
| 1 | 17 | LT_OEX_1 | B3659 | E. coli | 3404 | Cytoplasmic |
| 1 | 18 | LT_OEX_1 | B3871 | E. coli | 3442 | Cytoplasmic |
| 1 | 19 | LT_OEX_1 | YDR142C | S. cerevisiae | 3979 | Plastidic |
| 1 | 20 | LT_OEX_1 | YER175W-A | S. cerevisiae | 4048 | Cytoplasmic |
| 1 | 21 | LT_OEX_1 | YGR289C | S. cerevisiae | 4052 | Plastidic |
| 1 | 22 | LT_OEX_1 | YHR044C | S. cerevisiae | 4132 | Plastidic |
| 1 | 23 | LT_OEX_1 | YHR072W | S. cerevisiae | 4218 | Cytoplasmic |
| 1 | 24 | LT_OEX_1 | YHR213W-A | S. cerevisiae | 4492 | Cytoplasmic |
| 1 | 25 | LT_OEX_1 | YIL053W | S. cerevisiae | 4496 | Cytoplasmic |
| 1 | 26 | LT_OEX_1 | YJL103C | S. cerevisiae | 4559 | Plastidic |
| 1 | 27 | LT_OEX_1 | YJL137C | S. cerevisiae | 4590 | Plastidic |
| 1 | 28 | LT_OEX_1 | YLR027C | S. cerevisiae | 4623 | Cytoplasmic |
| 1 | 29 a | LT_OEX_1 | YML079W | S. cerevisiae | 5071 | Plastidic |
| 1 | 29 b | LT_OEX_1 | YML079W | S. cerevisiae | 5071 | Cytoplasmic |
| 1 | 30 | LT_OEX_1 | YMR157C | S. cerevisiae | 5103 | Cytoplasmic |
| 1 | 31 | LT_OEX_1 | YNL024C | S. cerevisiae | 5116 | Plastidic |
| 1 | 32 a | LT_OEX_1 | YOL058W | S. cerevisiae | 5160 | Plastidic |
| 1 | 32 b | LT_OEX_1 | YOL058W | S. cerevisiae | 5160 | Cytoplasmic |
| 1 | 33 | LT_OEX_1 | YPL180W | S. cerevisiae | 5747 | Cytoplasmic |
| 1 | 34 | LT_OEX_1 | YPR167C | S. cerevisiae | 5757 | Plastidic |
| 1 | 35 | LT_OEX_1 | B0036 | E. coli | 6087 | Plastidic |
| 1 | 36 | LT_OEX_1 | B1906 | E. coli | 6582 | Cytoplasmic |
| 1 | 37 | LT_OEX_1 | B2371 | E. coli | 6610 | Cytoplasmic |
| 1 | 38 | LT_OEX_1 | B2881 | E. coli | 6950 | Cytoplasmic |
| 1 | 39 | LT_OEX_1 | B3106 | E. coli | 7079 | Cytoplasmic |
| 1 | 40 | LT_OEX_1 | B3400 | E. coli | 7271 | Plastidic |
| 1 | 41 | LT_OEX_1 | B3410 | E. coli | 7468 | Cytoplasmic |
| 1 | 42 | LT_OEX_1 | B4209 | E. coli | 7493 | Plastidic |

TABLE IIA-continued

Amino acid sequence ID numbers

| | | | | | | |
|---|---|---|---|---|---|---|
| 1 | 43 | LT_OEX_1 | SLL1545 | *Synechocystis* | 7592 | Cytoplasmic |
| 1 | 44 | LT_OEX_1 | SLR1348 | *Synechocystis* | 7671 | Mitochondric |
| 1 | 45 | LT_OEX_1 | YGR191W | *S. cerevisiae* | 8237 | Plastidic |
| 1 | 46 | LT_OEX_1 | AT1G22920 | *A. thaliana* | 8564 | Cytoplasmic |
| 1 | 47 | LT_OEX_1 | B1600 | *E. coli* | 8649 | Plastidic |
| 1 | 48 | LT_OEX_1 | B1900 | *E. coli* | 8761 | Plastidic |
| 1 | 49 | LT_OEX_1 | SLL0099 | *Synechocystis* | 8862 | Cytoplasmic |
| 1 | 50 | LT_OEX_1 | SLL0383 | *Synechocystis* | 9047 | Cytoplasmic |
| 1 | 51 | LT_OEX_1 | SLR1094 | *Synechocystis* | 9281 | Cytoplasmic |
| 1 | 52 | LT_OEX_1 | SLR1520 | *Synechocystis* | 9308 | Cytoplasmic |
| 1 | 53 | LT_OEX_1 | YDL142C | *S. cerevisiae* | 9431 | Cytoplasmic |
| 1 | 54 | LT_OEX_1 | YDR147W | *S. cerevisiae* | 9480 | Cytoplasmic |
| 1 | 55 | LT_OEX_1 | YLR284C | *S. cerevisiae* | 9501 | Plastidic |
| 1 | 56 | LT_OEX_1 | YPL148C | *S. cerevisiae* | 9554 | Plastidic |
| 1 | 57 | LT_OEX_1 | YPR074C | *S. cerevisiae* | 9575 | Plastidic |
| 1 | 58 | LT_OEX_1 | B1008 | *E. coli* | 10405 | Plastidic |
| 1 | 59 | LT_OEX_1 | B1529 | *E. coli* | 10504 | Plastidic |
| 1 | 60 | LT_OEX_1 | B3347 | *E. coli* | 10592 | Plastidic |
| 1 | 61 | LT_OEX_1 | YBR176W | *S. cerevisiae* | 10935 | Cytoplasmic |
| 1 | 62 | LT_OEX_1 | YGR177C | *S. cerevisiae* | 11462 | Cytoplasmic |
| 1 | 63 | LT_OEX_1 | YHR176W | *S. cerevisiae* | 11502 | Cytoplasmic |
| 1 | 64 | LT_OEX_1 | B2881_2 | *E. coli* | 11565 | Cytoplasmic |
| 1 | 65 | LT_OEX_1 | B3945_2 | *E. coli* | 11696 | Cytoplasmic |
| 1 | 66 | LT_OEX_1 | YHR204W_2 | *S. cerevisiae* | 11908 | Cytoplasmic |
| 1 | 67 | LT_OEX_1 | YNL142W_2 | *S. cerevisiae* | 11945 | Cytoplasmic |
| 1 | 68 a | LT_OEX_1 | YOL058W_2 | *S. cerevisiae* | 12358 | Plastidic |
| 1 | 68 b | LT_OEX_1 | YOL058W_2 | *S. cerevisiae* | 12358 | Cytoplasmic |
| 1 | 69 | LT_OEX_1 | YPR035W_2 | *S. cerevisiae* | 12937 | Cytoplasmic |

| Application | 1. Hit | 7. SEQ IDs of Polypeptide Homologs |
|---|---|---|
| 1 | 1 | 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135 |
| 1 | 2 | 150, 152, 154, 156, 158, 160, 162, 164 |
| 1 | 3 | 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373 |
| 1 | 4 | 385, 387, 389, 391, 393, 395, 397 |
| 1 | 5 | 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747 |
| 1 | 6 | 920, 922, 924, 926, 928, 930, 932, 934, 936, 938, 940 |
| 1 | 7 | 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213 |
| 1 | 8 | 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, |

TABLE IIA-continued

| | | Amino acid sequence ID numbers |
|---|---|---|
| | | 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615 |
| 1 | 9 | 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765, 1767, 1769, 1771, 1773, 1775, 1777, 1779, 1781, 1783, 1785, 1787, 1789, 1791, 1793, 1795, 1797, 1799, 1801, 1803, 1805, 1807, 1809, 1811, 1813, 1815, 1817, 1819, 1821, 1823, 1825, 1827, 1829, 1831, 1833, 1835, 1837, 1839, 1841, 1843, 1845, 1847, 1849, 1851, 1853, 1855, 1857, 1859, 1861, 1863, 1865, 1867, 1869, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2031, 2033, 2035, 2037, 2039, 2041, 2043, 2045, 2047, 2049, 2051, 2053, 2055 |
| 1 | 10 | 2068, 2070, 2072, 2074, 2076 |
| 1 | 11 | 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, 2136, 2138, 2140, 2142, 2144, 2146, 2148, 2150, 2152, 2154, 2156, 2158, 2160, 2162, 2164, 2166, 2168, 2170, 2172, 2174, 2176, 2178, 2180, 2182, 2184, 2186, 2188, 2190, 2192, 2194, 2196, 2198, 2200, 2202, 2204, 2206, 2208, 2210, 2212, 2214, 2216, 2218, 2220, 2222, 2224, 2226, 2228, 2230, 2232, 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346 |
| 1 | 12 a | 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545 |
| 1 | 12 b | 2409, 2411, 2413, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2499, 2501, 2503, 2505, 2507, 2509, 2511, 2513, 2515, 2517, 2519, 2521, 2523, 2525, 2527, 2529, 2531, 2533, 2535, 2537, 2539, 2541, 2543, 2545 |
| 1 | 13 | 2567, 2569, 2571, 2573, 2575, 2577, 2579, 2581, 2583, 2585, 2587, 2589, 2591, 2593, 2595, 2597, 2599, 2601, 2603, 2605, 2607, 2609, 2611, 2613, 2615, 2617, 2619, 2621, 2623, 2625, 2627, 2629, 2631, 2633, 2635, 2637, 2639, 2641, 2643, 2645, 2647, 2649, 2651, 2653, 2655, 2657, 2659, 2661, 2663, 2665, 2667, 2669, 2671, 2673, 2675, 2677, 2679, 2681, 2683, 2685, 2687, 2689, 2691, 2693, 2695, 2697, 2699, 2701, 2703, 2705, 2707, 2709, 2711, 2713, 2715, 2717, 2719, 2721, 2723, 2725, 2727, 2729, 2731, 2733, 2735, 2737, 2739, 2741, 2743, 2745, 2747, 2749, 2751, 2753, 2755, 2757, 2759, 2761, 2763, 2765, 2767, 2769, 2771, 2773, 2775, 2777, 2779, 2781, 2783, 2785, 2787, 2789, 2791, 2793, 2795, 2797, 2799, 2801, 2803 |
| 1 | 14 | 2844, 2846, 2848, 2850, 2852, 2854, 2856, 2858, 2860, 2862, 2864, 2866, 2868, 2870, 2872, 2874 |
| 1 | 15 | 2882, 2884, 2886, 2888, 2890, 2892, 2894, 2896, 2898, 2900, 2902, 2904, 2906, 2908, 2910, 2912, 2914, 2916, 2918, 2920, 2922, 2924, 2926, 2928, 2930, 2932, 2934, 2936, 2938, 2940, |

TABLE IIA-continued

| | | Amino acid sequence ID numbers |
|---|---|---|
| | | 2942, 2944, 2946, 2948, 2950, 2952, 2954, 2956, 2958, 2960, 2962, 2964, 2966, 2968, 2970, 2972, 2974, 2976, 2978, 2980, 2982, 2984, 2986, 2988, 2990, 2992, 2994, 2996, 2998, 3000, 3002, 3004, 3006, 3008, 3010, 3012, 3014, 3016, 3018, 3020, 3022, 3024, 3026, 3028, 3030, 3032, 3034, 3036, 3038, 3040, 3042, 3044, 3046, 3048, 3050, 3052, 3054, 3056, 3058, 3060, 3062, 3064, 3066, 3068, 3070, 3072, 3074, 3076, 3078, 3080, 3082, 3084, 3086 |
| 1 | 16 | 3112, 3114, 3116, 3118, 3120, 3122, 3124, 3126, 3128, 3130, 3132, 3134, 3136, 3138, 3140, 3142, 3144, 3146, 3148, 3150, 3152, 3154, 3156, 3158, 3160, 3162, 3164, 3166, 3168, 3170, 3172, 3174, 3176, 3178, 3180, 3182, 3184, 3186, 3188, 3190, 3192, 3194, 3196, 3198, 3200, 3202, 3204, 3206, 3208, 3210, 3212, 3214, 3216, 3218, 3220, 3222, 3224, 3226, 3228, 3230, 3232, 3234, 3236, 3238, 3240, 3242, 3244, 3246, 3248, 3250, 3252, 3254, 3256, 3258, 3260, 3262, 3264, 3266, 3268, 3270, 3272, 3274, 3276, 3278, 3280, 3282, 3284, 3286, 3288, 3290, 3292, 3294, 3296, 3298, 3300, 3302, 3304, 3306, 3308, 3310, 3312, 3314, 3316, 3318, 3320, 3322, 3324, 3326, 3328, 3330, 3332, 3334, 3336, 3338, 3340, 3342, 3344, 3346, 3348, 3350, 3352, 3354, 3356, 3358, 3360, 3362, 3364, 3366, 3368, 3370, 3372, 3374, 3376, 3378, 3380, 3382, 3384, 3386, 3388, 3390, 3392, 3394, 3396, 3398 |
| 1 | 17 | 3406, 3408, 3410, 3412, 3414, 3416, 3418, 3420, 3422, 3424, 3426, 3428, 3430 |
| 1 | 18 | 3444, 3446, 3448, 3450, 3452, 3454, 3456, 3458, 3460, 3462, 3464, 3466, 3468, 3470, 3472, 3474, 3476, 3478, 3480, 3482, 3484, 3486, 3488, 3490, 3492, 3494, 3496, 3498, 3500, 3502, 3504, 3506, 3508, 3510, 3512, 3514, 3516, 3518, 3520, 3522, 3524, 3526, 3528, 3530, 3532, 3534, 3536, 3538, 3540, 3542, 3544, 3546, 3548, 3550, 3552, 3554, 3556, 3558, 3560, 3562, 3564, 3566, 3568, 3570, 3572, 3574, 3576, 3578, 3580, 3582, 3584, 3586, 3588, 3590, 3592, 3594, 3596, 3598, 3600, 3602, 3604, 3606, 3608, 3610, 3612, 3614, 3616, 3618, 3620, 3622, 3624, 3626, 3628, 3630, 3632, 3634, 3636, 3638, 3640, 3642, 3644, 3646, 3648, 3650, 3652, 3654, 3656, 3658, 3660, 3662, 3664, 3666, 3668, 3670, 3672, 3674, 3676, 3678, 3680, 3682, 3684, 3686, 3688, 3690, 3692, 3694, 3696, 3698, 3700, 3702, 3704, 3706, 3708, 3710, 3712, 3714, 3716, 3718, 3720, 3722, 3724, 3726, 3728, 3730, 3732, 3734, 3736, 3738, 3740, 3742, 3744, 3746, 3748, 3750, 3752, 3754, 3756, 3758, 3760, 3762, 3764, 3766, 3768, 3770, 3772, 3774, 3776, 3778, 3780, 3782, 3784, 3786, 3788, 3790, 3792, 3794, 3796, 3798, 3800, 3802, 3804, 3806, 3808, 3810, 3812, 3814, 3816, 3818, 3820, 3822, 3824, 3826, 3828, 3830, 3832, 3834, 3836, 3838, 3840, 3842, 3844, 3846, 3848, 3850, 3852, 3854, 3856, 3858, 3860, 3862, 3864, 3866, 3868, 3870, 3872, 3874, 3876, 3878, 3880, 3882, 3884, 3886, 3888, 3890, 3892, 3894, 3896, 3898, 3900, 3902, 3904, 3906, 3908, 3910, 3912, 3914, 3916, 3918, 3920, 3922, 3924, 3926, 3928, 3930, 3932, 3934, 3936, 3938, 3940, 3942, 3944, 3946, 3948, 3950, 3952, 3954 |
| 1 | 19 | 3981, 3983, 3985, 3987, 3989, 3991, 3993, 3995, 3997, 3999, 4001, 4003, 4005, 4007, 4009, 4011, 4013, 4015, 4017, 4019, 4021, 4023, 4025, 4027, 4029, 4031, 4033, 4035 |
| 1 | 20 | — |
| 1 | 21 | 4054, 4056, 4058, 4060, 4062, 4064, 4066, 4068, 4070, 4072, 4074, 4076, 4078, 4080, 4082, 4084, 4086, 4088, 4090, 4092, 4094, 4096, 4098, 4100, 4102, 4104, 4106, 4108, 4110, 4112, 4114, 4116, 4118, 4120 |
| 1 | 22 | 4134, 4136, 4138, 4140, 4142, 4144, 4146, 4148, 4150, 4152, 4154, 4156, 4158, 4160, 4162, 4164, 4166, 4168, 4170, 4172, 4174, 4176, 4178, 4180, 4182, 4184, 4186, 4188, 4190, 4192, 4194, 4196, 4198, 4200, 4202, 4204, 4206, 4208, 4210 |
| 1 | 23 | 4220, 4222, 4224, 4226, 4228, 4230, 4232, 4234, 4236, 4238, 4240, 4242, 4244, 4246, 4248, 4250, 4252, 4254, 4256, 4258, 4260, 4262, 4264, 4266, 4268, 4270, 4272, 4274, 4276, 4278, 4280, 4282, 4284, 4286, 4288, 4290, 4292, 4294, 4296, 4298, 4300, 4302, 4304, 4306, 4308, 4310, 4312, 4314, 4316, 4318, 4320, 4322, 4324, 4326, 4328, 4330, 4332, 4334, 4336, 4338, 4340, 4342, 4344, 4346, 4348, 4350, 4352, 4354, 4356, 4358, 4360, 4362, 4364, 4366, 4368, 4370, 4372, 4374, 4376, 4378, 4380, 4382, 4384, 4386, 4388, 4390, 4392, 4394, 4396, 4398, 4400, 4402, 4404, 4406, 4408, 4410, 4412, 4414, 4416, 4418, 4420, 4422, 4424, 4426, 4428, 4430, 4432, 4434, 4436, 4438, 4440, 4442, 4444, 4446, 4448, 4450, 4452, 4454, 4456, 4458, 4460 |

TABLE IIA-continued

| | | Amino acid sequence ID numbers |
|---|---|---|
| 1 | 24 | — |
| 1 | 25 | 4498, 4500, 4502, 4504, 4506, 4508, 4510, 4512, 4514, 4516, 4518, 4520, 4522, 4524, 4526, 4528, 4530, 4532, 4534, 4536, 4538, 4540, 4542, 4544, 4546, 4548, 4550 |
| 1 | 26 | 4561, 4563, 4565, 4567, 4569, 4571, 4573, 4575, 4577, 4579 |
| 1 | 27 | 4592, 4594, 4596, 4598, 4600, 4602, 4604, 4606, 4608, 4610, 4612 |
| 1 | 28 | 4625, 4627, 4629, 4631, 4633, 4635, 4637, 4639, 4641, 4643, 4645, 4647, 4649, 4651, 4653, 4655, 4657, 4659, 4661, 4663, 4665, 4667, 4669, 4671, 4673, 4675, 4677, 4679, 4681, 4683, 4685, 4687, 4689, 4691, 4693, 4695, 4697, 4699, 4701, 4703, 4705, 4707, 4709, 4711, 4713, 4715, 4717, 4719, 4721, 4723, 4725, 4727, 4729, 4731, 4733, 4735, 4737, 4739, 4741, 4743, 4745, 4747, 4749, 4751, 4753, 4755, 4757, 4759, 4761, 4763, 4765, 4767, 4769, 4771, 4773, 4775, 4777, 4779, 4781, 4783, 4785, 4787, 4789, 4791, 4793, 4795, 4797, 4799, 4801, 4803, 4805, 4807, 4809, 4811, 4813, 4815, 4817, 4819, 4821, 4823, 4825, 4827, 4829, 4831, 4833, 4835, 4837, 4839, 4841, 4843, 4845, 4847, 4849, 4851, 4853, 4855, 4857, 4859, 4861, 4863, 4865, 4867, 4869, 4871, 4873, 4875, 4877, 4879, 4881, 4883, 4885, 4887, 4889, 4891, 4893, 4895, 4897, 4899, 4901, 4903, 4905, 4907, 4909, 4911, 4913, 4915, 4917, 4919, 4921, 4923, 4925, 4927, 4929, 4931, 4933, 4935, 4937, 4939, 4941, 4943, 4945, 4947, 4949, 4951, 4953, 4955, 4957, 4959, 4961, 4963, 4965, 4967, 4969, 4971, 4973, 4975, 4977, 4979, 4981, 4983, 4985, 4987, 4989, 4991, 4993, 4995, 4997, 4999, 5001, 5003, 5005, 5007, 5009, 5011, 5013, 5015, 5017, 5019 |
| 1 | 29 a | 5073, 5075, 5077, 5079, 5081, 5083, 5085, 5087, 5089, 5091, 5093, 5095, 5097 |
| 1 | 29 b | 5073, 5075, 5077, 5079, 5081, 5083, 5085, 5087, 5089, 5091, 5093, 5095, 5097 |
| 1 | 30 | 5105, 5107, 5109 |
| 1 | 31 | 5118, 5120, 5122, 5124, 5126, 5128, 5130, 5132, 5134, 5136, 5138, 5140, 5142, 5144, 5146, 5148, 5150, 5152 |
| 1 | 32 a | 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, 5342, 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, 5542, 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, 5690, 5692, 5694, 5696, 5698, 5700, 5702, 5704, 5706, 5708, 5710, 5712, 5714, 5716, 5718, 5720, 5722, 5724, 5726, 5728, 5730, 5732, 5734 |
| 1 | 32 b | 5162, 5164, 5166, 5168, 5170, 5172, 5174, 5176, 5178, 5180, 5182, 5184, 5186, 5188, 5190, 5192, 5194, 5196, 5198, 5200, 5202, 5204, 5206, 5208, 5210, 5212, 5214, 5216, 5218, 5220, 5222, 5224, 5226, 5228, 5230, 5232, 5234, 5236, 5238, 5240, 5242, 5244, 5246, 5248, 5250, 5252, 5254, 5256, 5258, 5260, 5262, 5264, 5266, 5268, 5270, 5272, 5274, 5276, 5278, 5280, 5282, 5284, 5286, 5288, 5290, 5292, 5294, 5296, 5298, 5300, 5302, 5304, 5306, 5308, 5310, 5312, 5314, 5316, 5318, 5320, 5322, 5324, 5326, 5328, 5330, 5332, 5334, 5336, 5338, 5340, 5342, 5344, 5346, 5348, 5350, 5352, 5354, 5356, 5358, 5360, 5362, 5364, 5366, 5368, 5370, 5372, 5374, 5376, 5378, 5380, 5382, 5384, 5386, 5388, 5390, 5392, 5394, 5396, 5398, 5400, 5402, 5404, 5406, 5408, 5410, 5412, 5414, 5416, 5418, 5420, 5422, 5424, 5426, 5428, 5430, 5432, 5434, 5436, 5438, 5440, 5442, 5444, 5446, 5448, 5450, 5452, 5454, 5456, 5458, 5460, |

TABLE IIA-continued

| | | Amino acid sequence ID numbers |
|---|---|---|
| | | 5462, 5464, 5466, 5468, 5470, 5472, 5474, 5476, 5478, 5480, 5482, 5484, 5486, 5488, 5490, 5492, 5494, 5496, 5498, 5500, 5502, 5504, 5506, 5508, 5510, 5512, 5514, 5516, 5518, 5520, 5522, 5524, 5526, 5528, 5530, 5532, 5534, 5536, 5538, 5540, 5542, 5544, 5546, 5548, 5550, 5552, 5554, 5556, 5558, 5560, 5562, 5564, 5566, 5568, 5570, 5572, 5574, 5576, 5578, 5580, 5582, 5584, 5586, 5588, 5590, 5592, 5594, 5596, 5598, 5600, 5602, 5604, 5606, 5608, 5610, 5612, 5614, 5616, 5618, 5620, 5622, 5624, 5626, 5628, 5630, 5632, 5634, 5636, 5638, 5640, 5642, 5644, 5646, 5648, 5650, 5652, 5654, 5656, 5658, 5660, 5662, 5664, 5666, 5668, 5670, 5672, 5674, 5676, 5678, 5680, 5682, 5684, 5686, 5688, 5690, 5692, 5694, 5696, 5698, 5700, 5702, 5704, 5706, 5708, 5710, 5712, 5714, 5716, 5718, 5720, 5722, 5724, 5726, 5728, 5730, 5732, 5734 |
| 1 | 33 | 5749 |
| 1 | 34 | 5759, 5761, 5763, 5765, 5767, 5769, 5771, 5773, 5775, 5777, 5779, 5781, 5783, 5785, 5787, 5789, 5791, 5793, 5795, 5797, 5799, 5801, 5803, 5805, 5807, 5809, 5811, 5813, 5815, 5817, 5819, 5821, 5823, 5825, 5827, 5829, 5831, 5833, 5835, 5837, 5839, 5841, 5843, 5845, 5847, 5849, 5851, 5853, 5855, 5857, 5859, 5861, 5863, 5865, 5867, 5869, 5871, 5873, 5875, 5877, 5879, 5881, 5883, 5885, 5887, 5889, 5891, 5893, 5895, 5897, 5899, 5901, 5903, 5905, 5907, 5909, 5911, 5913, 5915, 5917, 5919, 5921, 5923, 5925, 5927, 5929, 5931, 5933, 5935, 5937, 5939, 5941, 5943, 5945, 5947, 5949, 5951, 5953, 5955, 5957, 5959, 5961, 5963, 5965, 5967, 5969, 5971, 5973, 5975, 5977, 5979, 5981, 5983, 5985, 5987, 5989, 5991, 5993, 5995, 5997, 5999, 6001, 6003, 6005, 6007, 6009, 6011, 6013, 6015, 6017, 6019, 6021, 6023, 6025, 6027, 6029, 6031, 6033, 6035, 6037, 6039, 6041, 6043, 6045, 6047 |
| 1 | 35 | 6089, 6091, 6093, 6095, 6097, 6099, 6101, 6103, 6105, 6107, 6109, 6111, 6113, 6115, 6117, 6119, 6121, 6123, 6125, 6127, 6129, 6131, 6133, 6135, 6137, 6139, 6141, 6143, 6145, 6147, 6149, 6151, 6153, 6155, 6157, 6159, 6161, 6163, 6165, 6167, 6169, 6171, 6173, 6175, 6177, 6179, 6181, 6183, 6185, 6187, 6189, 6191, 6193, 6195, 6197, 6199, 6201, 6203, 6205, 6207, 6209, 6211, 6213, 6215, 6217, 6219, 6221, 6223, 6225, 6227, 6229, 6231, 6233, 6235, 6237, 6239, 6241, 6243, 6245, 6247, 6249, 6251, 6253, 6255, 6257, 6259, 6261, 6263, 6265, 6267, 6269, 6271, 6273, 6275, 6277, 6279, 6281, 6283, 6285, 6287, 6289, 6291, 6293, 6295, 6297, 6299, 6301, 6303, 6305, 6307, 6309, 6311, 6313, 6315, 6317, 6319, 6321, 6323, 6325, 6327, 6329, 6331, 6333, 6335, 6337, 6339, 6341, 6343, 6345, 6347, 6349, 6351, 6353, 6355, 6357, 6359, 6361, 6363, 6365, 6367, 6369, 6371, 6373, 6375, 6377, 6379, 6381, 6383, 6385, 6387, 6389, 6391, 6393, 6395, 6397, 6399, 6401, 6403, 6405, 6407, 6409, 6411, 6413, 6415, 6417, 6419, 6421, 6423, 6425, 6427, 6429, 6431, 6433, 6435, 6437, 6439, 6441, 6443, 6445, 6447, 6449, 6451, 6453, 6455, 6457, 6459, 6461, 6463, 6465, 6467, 6469, 6471, 6473, 6475, 6477, 6479, 6481, 6483, 6485, 6487, 6489, 6491, 6493, 6495, 6497, 6499, 6501, 6503, 6505, 6507, 6509, 6511, 6513, 6515, 6517, 6519, 6521, 6523, 6525, 6527, 6529, 6531, 6533, 6535, 6537, 6539, 6541, 6543 |
| 1 | 36 | 6584, 6586, 6588, 6590, 6592, 6594, 6596, 6598, 6600, 6602, 6604 |
| 1 | 37 | 6612, 6614, 6616, 6618, 6620, 6622, 6624, 6626, 6628, 6630, 6632, 6634, 6636, 6638, 6640, 6642, 6644, 6646, 6648, 6650, 6652, 6654, 6656, 6658, 6660, 6662, 6664, 6666, 6668, 6670, 6672, 6674, 6676, 6678, 6680, 6682, 6684, 6686, 6688, 6690, 6692, 6694, 6696, 6698, 6700, 6702, 6704, 6706, 6708, 6710, 6712, 6714, 6716, 6718, 6720, 6722, 6724, 6726, 6728, 6730, 6732, 6734, 6736, 6738, 6740, 6742, 6744, 6746, 6748, 6750, 6752, 6754, 6756, 6758, 6760, 6762, 6764, 6766, 6768, 6770, 6772, 6774, 6776, 6778, 6780, 6782, 6784, 6786, 6788, 6790, 6792, 6794, 6796, 6798, 6800, 6802, 6804, 6806, 6808, 6810, 6812, 6814, 6816, 6818, 6820, 6822, 6824, 6826, 6828, 6830, 6832, 6834, 6836, 6838, 6840, 6842, 6844, 6846, 6848, 6850, 6852, 6854, 6856, 6858, 6860, 6862, 6864, 6866, 6868, 6870, 6872, 6874, 6876, 6878, 6880, 6882, 6884, 6886, 6888, 6890, 6892, 6894, 6896, 6898, 6900, 6902, 6904, 6906, 6908, 6910, 6912, 6914, 6916, 6918, 6920, 6922, 6924, 6926, 6928, 6930, 6932, 6934, 6936, 6938, 6940, 6942, 6944 |
| 1 | 38 | 6952, 6954, 6956, 6958, 6960, 6962, 6964, 6966, 6968, 6970, 6972, 6974, 6976, 6978, 6980, 6982, 6984, 6986, 6988, 6990, 6992, 6994, 6996, 6998, 7000, 7002, 7004, 7006, 7008, 7010, 7012, 7014, 7016, 7018, 7020, 7022, 7024, 7026, 7028, 7030, 7032, 7034, 7036, 7038, 7040, 7042, 7044, 7046, 7048, 7050, 7052, 7054, 7056, 7058, 7060, 7062, 7064, 7066, 7068 |

TABLE IIA-continued

| | | Amino acid sequence ID numbers |
|---|---|---|
| 1 | 39 | 7081, 7083, 7085, 7087, 7089, 7091, 7093, 7095, 7097, 7099, 7101, 7103, 7105, 7107, 7109, 7111, 7113, 7115, 7117, 7119, 7121, 7123, 7125, 7127, 7129, 7131, 7133, 7135, 7137, 7139, 7141, 7143, 7145, 7147, 7149, 7151, 7153, 7155, 7157, 7159, 7161, 7163, 7165, 7167, 7169, 7171, 7173, 7175, 7177, 7179, 7181, 7183, 7185, 7187, 7189, 7191, 7193, 7195, 7197, 7199, 7201, 7203, 7205, 7207, 7209, 7211, 7213, 7215, 7217, 7219, 7221, 7223, 7225, 7227, 7229, 7231, 7233, 7235, 7237, 7239, 7241, 7243, 7245, 7247, 7249, 7251, 7253, 7255, 7257, 7259, 7261, 7263, 7265 |
| 1 | 40 | 7273, 7275, 7277, 7279, 7281, 7283, 7285, 7287, 7289, 7291, 7293, 7295, 7297, 7299, 7301, 7303, 7305, 7307, 7309, 7311, 7313, 7315, 7317, 7319, 7321, 7323, 7325, 7327, 7329, 7331, 7333, 7335, 7337, 7339, 7341, 7343, 7345, 7347, 7349, 7351, 7353, 7355, 7357, 7359, 7361, 7363, 7365, 7367, 7369, 7371, 7373, 7375, 7377, 7379, 7381, 7383, 7385, 7387, 7389, 7391, 7393, 7395, 7397, 7399, 7401, 7403, 7405, 7407, 7409, 7411, 7413, 7415, 7417, 7419, 7421, 7423, 7425, 7427, 7429, 7431, 7433, 7435, 7437, 7439, 7441, 7443, 7445, 7447, 7449, 7451, 7453, 7455, 7457, 7459, 7461 |
| 1 | 41 | 7470, 7472, 7474, 7476, 7478, 7480, 7482, 7484, 7486 |
| 1 | 42 | 7495, 7497, 7499, 7501, 7503, 7505, 7507, 7509, 7511, 7513, 7515, 7517, 7519, 7521, 7523, 7525, 7527, 7529, 7531, 7533, 7535, 7537, 7539, 7541, 7543, 7545, 7547, 7549, 7551, 7553, 7555, 7557, 7559, 7561, 7563, 7565, 7567, 7569, 7571, 7573, 7575, 7577, 7579, 7581, 7583 |
| 1 | 43 | 7594, 7596, 7598, 7600, 7602, 7604, 7606, 7608, 7610, 7612, 7614, 7616, 7618, 7620, 7622, 7624, 7626, 7628, 7630, 7632, 7634, 7636, 7638, 7640, 7642, 7644, 7646, 7648, 7650, 7652, 7654, 7656, 7658, 7660, 7662, 7664, 7666 |
| 1 | 44 | 7673, 7675, 7677, 7679, 7681, 7683, 7685, 7687, 7689, 7691, 7693, 7695, 7697, 7699, 7701, 7703, 7705, 7707, 7709, 7711, 7713, 7715, 7717, 7719, 7721, 7723, 7725, 7727, 7729, 7731, 7733, 7735, 7737, 7739, 7741, 7743, 7745, 7747, 7749, 7751, 7753, 7755, 7757, 7759, 7761, 7763, 7765, 7767, 7769, 7771, 7773, 7775, 7777, 7779, 7781, 7783, 7785, 7787, 7789, 7791, 7793, 7795, 7797, 7799, 7801, 7803, 7805, 7807, 7809, 7811, 7813, 7815, 7817, 7819, 7821, 7823, 7825, 7827, 7829, 7831, 7833, 7835, 7837, 7839, 7841, 7843, 7845, 7847, 7849, 7851, 7853, 7855, 7857, 7859, 7861, 7863, 7865, 7867, 7869, 7871, 7873, 7875, 7877, 7879, 7881, 7883, 7885, 7887, 7889, 7891, 7893, 7895, 7897, 7899, 7901, 7903, 7905, 7907, 7909, 7911, 7913, 7915, 7917, 7919, 7921, 7923, 7925, 7927, 7929, 7931, 7933, 7935, 7937, 7939, 7941, 7943, 7945, 7947, 7949, 7951, 7953, 7955, 7957, 7959, 7961, 7963, 7965, 7967, 7969, 7971, 7973, 7975, 7977, 7979, 7981, 7983, 7985, 7987, 7989, 7991, 7993, 7995, 7997, 7999, 8001, 8003, 8005, 8007, 8009, 8011, 8013, 8015, 8017, 8019, 8021, 8023, 8025, 8027, 8029, 8031, 8033, 8035, 8037, 8039, 8041, 8043, 8045, 8047, 8049, 8051, 8053, 8055, 8057, 8059, 8061, 8063, 8065, 8067, 8069, 8071, 8073, 8075, 8077, 8079, 8081, 8083, 8085, 8087, 8089, 8091, 8093, 8095, 8097, 8099, 8101, 8103, 8105, 8107, 8109, 8111, 8113, 8115, 8117, 8119, 8121, 8123, 8125, 8127, 8129, 8131, 8133, 8135, 8137, 8139, 8141, 8143, 8145, 8147, 8149, 8151, 8153, 8155, 8157, 8159, 8161, 8163, 8165, 8167, 8169, 8171, 8173, 8175, 8177, 8179, 8181, 8183, 8185, 8187, 8189, 8191, 8193, 8195, 8197, 8199, 8201, 8203, 8205, 8207, 8209, 8211, 8213, 8215, 8217, 8219, 8221, 8223 |
| 1 | 45 | 8239, 8241, 8243, 8245, 8247, 8249, 8251, 8253, 8255, 8257, 8259, 8261, 8263, 8265, 8267, 8269, 8271, 8273, 8275, 8277, 8279, 8281, 8283, 8285, 8287, 8289, 8291, 8293, 8295, 8297, 8299, 8301, 8303, 8305, 8307, 8309, 8311, 8313, 8315, 8317, 8319, 8321, 8323, 8325, 8327, 8329, 8331, 8333, 8335, 8337, 8339, 8341, 8343, 8345, 8347, 8349, 8351, 8353, 8355, 8357, 8359, 8361, 8363, 8365, 8367, 8369, 8371, 8373, 8375, 8377, 8379, 8381, 8383, 8385, 8387, 8389, 8391, 8393, 8395, 8397, 8399, 8401, 8403, 8405, 8407, 8409, 8411, 8413, 8415, 8417, 8419, 8421, 8423, 8425, 8427, 8429, 8431, 8433, 8435, 8437, 8439, 8441, 8443, 8445, 8447, 8449, 8451, 8453, 8455, 8457, 8459, 8461, 8463, 8465, 8467, 8469, 8471, 8473, 8475, 8477, 8479, 8481, 8483, 8485, 8487, 8489, 8491, 8493, 8495, 8497, 8499, 8501, 8503, 8505, 8507, 8509, 8511, 8513, 8515, 8517, 8519, 8521, 8523, 8525, 8527, 8529, 8531, 8533, 8535, 8537, 8539, 8541, 8543, 8545, 8547, 8549, 8551, 8553, 8555, 8557 |
| 1 | 46 | 8566, 8568, 8570, 8572, 8574, 8576, 8578, 8580, 8582, 8584, 8586, 8588, 8590, 8592, 8594, 8596, 8598, 8600, 8602, 8604, 8606, 8608, 8610, 8612, 8614, 8616, 8618, 8620, 8622, 8624, 8626, 8628, 8630, 8632, 8634, 8636 |

TABLE IIA-continued

| | | Amino acid sequence ID numbers |
|---|---|---|
| 1 | 47 | 8651, 8653, 8655, 8657, 8659, 8661, 8663, 8665, 8667, 8669, 8671, 8673, 8675, 8677, 8679, 8681, 8683, 8685, 8687, 8689, 8691, 8693, 8695, 8697, 8699, 8701, 8703, 8705, 8707, 8709, 8711, 8713, 8715, 8717, 8719, 8721, 8723, 8725, 8727, 8729, 8731, 8733, 8735, 8737, 8739, 8741, 8743, 8745, 8747, 8749, 8751, 8753, 8755 |
| 1 | 48 | 8763, 8765, 8767, 8769, 8771, 8773, 8775, 8777, 8779, 8781, 8783, 8785, 8787, 8789, 8791, 8793, 8795, 8797, 8799, 8801, 8803, 8805, 8807, 8809, 8811, 8813, 8815, 8817, 8819, 8821, 8823, 8825, 8827, 8829, 8831, 8833, 8835, 8837, 8839, 8841, 8843, 8845, 8847, 8849 |
| 1 | 49 | 8864, 8866, 8868, 8870, 8872, 8874, 8876, 8878, 8880, 8882, 8884, 8886, 8888, 8890, 8892, 8894, 8896, 8898, 8900, 8902, 8904, 8906, 8908, 8910, 8912, 8914, 8916, 8918, 8920, 8922, 8924, 8926, 8928, 8930, 8932, 8934, 8936, 8938, 8940, 8942, 8944, 8946, 8948, 8950, 8952, 8954, 8956, 8958, 8960, 8962, 8964, 8966, 8968, 8970, 8972, 8974, 8976, 8978, 8980, 8982, 8984, 8986, 8988, 8990, 8992, 8994, 8996, 8998, 9000, 9002, 9004, 9006, 9008, 9010, 9012, 9014, 9016, 9018, 9020, 9022, 9024, 9026, 9028, 9030, 9032, 9034, 9036, 9038, 9040 |
| 1 | 50 | 9049, 9051, 9053, 9055, 9057, 9059, 9061, 9063, 9065, 9067, 9069, 9071, 9073, 9075, 9077, 9079, 9081, 9083, 9085, 9087, 9089, 9091, 9093, 9095, 9097, 9099, 9101, 9103, 9105, 9107, 9109, 9111, 9113, 9115, 9117, 9119, 9121, 9123, 9125, 9127, 9129, 9131, 9133, 9135, 9137, 9139, 9141, 9143, 9145, 9147, 9149, 9151, 9153, 9155, 9157, 9159, 9161, 9163, 9165, 9167, 9169, 9171, 9173, 9175, 9177, 9179, 9181, 9183, 9185, 9187, 9189, 9191, 9193, 9195, 9197, 9199, 9201, 9203, 9205, 9207, 9209, 9211, 9213, 9215, 9217, 9219, 9221, 9223, 9225, 9227, 9229, 9231, 9233, 9235, 9237, 9239, 9241, 9243, 9245, 9247, 9249, 9251, 9253, 9255, 9257, 9259, 9261, 9263, 9265, 9267, 9269, 9271, 9273, 9275 |
| 1 | 51 | 9283, 9285, 9287, 9289, 9291, 9293, 9295, 9297, 9299 |
| 1 | 52 | 9310, 9312, 9314, 9316, 9318, 9320, 9322, 9324, 9326, 9328, 9330, 9332, 9334, 9336, 9338, 9340, 9342, 9344, 9346, 9348, 9350, 9352, 9354, 9356, 9358, 9360, 9362, 9364, 9366, 9368, 9370, 9372, 9374, 9376, 9378, 9380, 9382, 9384, 9386, 9388, 9390, 9392, 9394, 9396, 9398, 9400, 9402, 9404, 9406, 9408, 9410, 9412, 9414, 9416, 9418, 9420, 9422, 9424 |
| 1 | 53 | 9433, 9435, 9437, 9439, 9441, 9443, 9445, 9447, 9449, 9451, 9453, 9455, 9457, 9459, 9461, 9463, 9465, 9467, 9469, 9471, 9473 |
| 1 | 54 | 9482, 9484, 9486 |
| 1 | 55 | 9503, 9505, 9507, 9509, 9511, 9513, 9515, 9517, 9519, 9521, 9523, 9525, 9527, 9529, 9531, 9533, 9535, 9537, 9539, 9541, 9543, 9545, 9547 |
| 1 | 56 | 9556, 9558, 9560, 9562, 9564, 9566 |
| 1 | 57 | 9577, 9579, 9581, 9583, 9585, 9587, 9589, 9591, 9593, 9595, 9597, 9599, 9601, 9603, 9605, 9607, 9609, 9611, 9613, 9615, 9617, 9619, 9621, 9623, 9625, 9627, 9629, 9631, 9633, 9635, 9637, 9639, 9641, 9643, 9645, 9647, 9649, 9651, 9653, 9655, 9657, 9659, 9661, 9663, 9665, 9667, 9669, 9671, 9673, 9675, 9677, 9679, 9681, 9683, 9685, 9687, 9689, 9691, 9693, 9695, 9697, 9699, 9701, 9703, 9705, 9707, 9709, 9711, 9713, 9715, 9717, 9719, 9721, 9723, 9725, 9727, 9729, 9731, 9733, 9735, 9737, 9739, 9741, 9743, 9745, 9747, 9749, 9751, 9753, 9755, 9757, 9759, 9761, 9763, 9765, 9767, 9769, 9771, 9773, 9775, 9777, 9779, 9781, 9783, 9785, 9787, 9789, 9791, 9793, 9795, 9797, 9799, 9801, 9803, 9805, 9807, 9809, 9811, 9813, 9815, 9817, 9819, 9821, 9823, 9825, 9827, 9829, 9831, 9833, 9835, 9837, 9839, 9841, 9843, 9845, 9847, 9849, 9851, 9853, 9855, 9857, 9859, 9861, 9863, 9865, 9867, 9869, 9871, 9873, 9875, 9877, 9879, 9881, 9883, 9885, 9887, 9889, 9891, 9893, 9895, 9897, 9899, 9901, 9903, 9905, 9907, 9909, 9911, 9913, 9915, 9917, 9919, 9921, 9923, 9925, 9927, 9929, 9931, 9933, 9935, 9937, 9939, 9941, 9943, 9945, 9947, 9949, 9951, 9953, 9955, 9957, 9959, 9961, 9963, 9965, 9967, 9969, 9971, 9973, 9975, 9977, 9979, 9981, 9983, 9985, 9987, 9989, 9991, 9993, 9995, 9997, 9999, 10001, 10003, 10005, 10007, 10009, 10011, 10013, 10015, 10017, 10019, 10021, 10023, 10025, 10027, 10029, 10031, 10033, 10035, 10037, 10039, 10041, 10043, 10045, 10047, 10049, 10051, 10053, 10055, 10057, 10059, 10061, 10063, 10065, 10067, 10069, 10071, 10073, 10075, 10077, 10079, 10081, 10083, 10085, 10087, 10089, 10091, 10093, 10095, 10097, 10099, 10101, 10103, 10105, 10107, 10109, 10111, 10113, 10115, 10117, 10119, 10121, 10123, 10125, 10127, 10129, 10131, 10133, 10135, 10137, 10139, 10141, 10143, 10145, 10147, 10149, 10151, 10153, 10155, 10157, |

TABLE IIA-continued

| | | Amino acid sequence ID numbers |
|---|---|---|
| | | 10159, 10161, 10163, 10165, 10167, 10169, 10171, 10173, 10175, 10177, 10179, 10181, 10183, 10185, 10187, 10189, 10191, 10193, 10195, 10197, 10199, 10201, 10203, 10205, 10207, 10209, 10211, 10213, 10215, 10217, 10219, 10221, 10223, 10225, 10227, 10229, 10231, 10233, 10235, 10237, 10239, 10241, 10243, 10245, 10247, 10249, 10251, 10253, 10255, 10257, 10259, 10261, 10263, 10265, 10267, 10269, 10271, 10273, 10275, 10277, 10279, 10281, 10283, 10285, 10287, 10289, 10291, 10293, 10295, 10297, 10299, 10301, 10303, 10305, 10307, 10309, 10311, 10313, 10315, 10317, 10319, 10321, 10323, 10325, 10327, 10329, 10331, 10333, 10335, 10337, 10339, 10341, 10343, 10345, 10347, 10349, 10351, 10353, 10355, 10357, 10359, 10361, 10363, 10365, 10367, 10369, 10371, 10373, 10375, 10377, 10379, 10381, 10383, 10385, 10387, 10389 |
| 1 | 58 | 10407, 10409, 10411, 10413, 10415, 10417, 10419, 10421, 10423, 10425, 10427, 10429, 10431, 10433, 10435, 10437, 10439, 10441, 10443, 10445, 10447, 10449, 10451, 10453, 10455, 10457, 10459, 10461, 10463, 10465, 10467, 10469, 10471, 10473, 10475, 10477, 10479, 10481, 10483, 10485, 10487, 10489, 10491, 10493, 10495 |
| 1 | 59 | 10506, 10508, 10510, 10512, 10514, 10516, 10518, 10520, 10522, 10524, 10526, 10528, 10530, 10532, 10534, 10536, 10538, 10540, 10542, 10544, 10546, 10548, 10550, 10552, 10554, 10556, 10558, 10560, 10562, 10564, 10566, 10568, 10570, 10572, 10574, 10576, 10578, 10580, 10582, 10584 |
| 1 | 60 | 10594, 10596, 10598, 10600, 10602, 10604, 10606, 10608, 10610, 10612, 10614, 10616, 10618, 10620, 10622, 10624, 10626, 10628, 10630, 10632, 10634, 10636, 10638, 10640, 10642, 10644, 10646, 10648, 10650, 10652, 10654, 10656, 10658, 10660, 10662, 10664, 10666, 10668, 10670, 10672, 10674, 10676, 10678, 10680, 10682, 10684, 10686, 10688, 10690, 10692, 10694, 10696, 10698, 10700, 10702, 10704, 10706, 10708, 10710, 10712, 10714, 10716, 10718, 10720, 10722, 10724, 10726, 10728, 10730, 10732, 10734, 10736, 10738, 10740, 10742, 10744, 10746, 10748, 10750, 10752, 10754, 10756, 10758, 10760, 10762, 10764, 10766, 10768, 10770, 10772, 10774, 10776, 10778, 10780, 10782, 10784, 10786, 10788, 10790, 10792, 10794, 10796, 10798, 10800, 10802, 10804, 10806, 10808, 10810, 10812, 10814, 10816, 10818, 10820, 10822, 10824, 10826, 10828, 10830, 10832, 10834, 10836, 10838, 10840, 10842, 10844, 10846, 10848, 10850, 10852, 10854, 10856, 10858, 10860, 10862, 10864, 10866, 10868, 10870, 10872, 10874, 10876, 10878, 10880, 10882, 10884, 10886, 10888, 10890, 10892, 10894, 10896, 10898, 10900, 10902, 10904, 10906, 10908, 10910, 10912, 10914, 10916, 10918, 10920, 10922, 10924, 10926, 10928 |
| 1 | 61 | 10937, 10939, 10941, 10943, 10945, 10947, 10949, 10951, 10953, 10955, 10957, 10959, 10961, 10963, 10965, 10967, 10969, 10971, 10973, 10975, 10977, 10979, 10981, 10983, 10985, 10987, 10989, 10991, 10993, 10995, 10997, 10999, 11001, 11003, 11005, 11007, 11009, 11011, 11013, 11015, 11017, 11019, 11021, 11023, 11025, 11027, 11029, 11031, 11033, 11035, 11037, 11039, 11041, 11043, 11045, 11047, 11049, 11051, 11053, 11055, 11057, 11059, 11061, 11063, 11065, 11067, 11069, 11071, 11073, 11075, 11077, 11079, 11081, 11083, 11085, 11087, 11089, 11091, 11093, 11095, 11097, 11099, 11101, 11103, 11105, 11107, 11109, 11111, 11113, 11115, 11117, 11119, 11121, 11123, 11125, 11127, 11129, 11131, 11133, 11135, 11137, 11139, 11141, 11143, 11145, 11147, 11149, 11151, 11153, 11155, 11157, 11159, 11161, 11163, 11165, 11167, 11169, 11171, 11173, 11175, 11177, 11179, 11181, 11183, 11185, 11187, 11189, 11191, 11193, 11195, 11197, 11199, 11201, 11203, 11205, 11207, 11209, 11211, 11213, 11215, 11217, 11219, 11221, 11223, 11225, 11227, 11229, 11231, 11233, 11235, 11237, 11239, 11241, 11243, 11245, 11247, 11249, 11251, 11253, 11255, 11257, 11259, 11261, 11263, 11265, 11267, 11269, 11271, 11273, 11275, 11277, 11279, 11281, 11283, 11285, 11287, 11289, 11291, 11293, 11295, 11297, 11299, 11301, 11303, 11305, 11307, 11309, 11311, 11313, 11315, 11317, 11319, 11321, 11323, 11325, 11327, 11329, 11331, 11333, 11335, 11337, 11339, 11341, 11343, 11345, 11347, 11349, 11351, 11353, 11355, 11357, 11359, 11361, 11363, 11365, 11367, 11369, 11371, 11373, 11375, 11377, 11379, 11381, 11383, 11385, 11387, 11389, 11391, 11393, 11395, 11397, 11399, 11401, 11403, 11405, 11407, 11409, 11411, 11413, 11415, 11417, 11419, 11421, 11423, 11425, 11427, 11429, 11431, |

TABLE IIA-continued

| | | Amino acid sequence ID numbers |
|---|---|---|
| | | 11433, 11435, 11437, 11439, 11441, 11443, 11445, 11447, 11449, 11451, 11453 |
| 1 | 62 | 11464, 11466, 11468, 11470, 11472, 11474, 11476, 11478, 11480, 11482, 11484, 11486 |
| 1 | 63 | 11504, 11506, 11508, 11510, 11512, 11514, 11516, 11518, 11520, 11522, 11524, 11526, 11528, 11530, 11532, 11534, 11536, 11538, 11540, 11542, 11544, 11546, 11548 |
| 1 | 64 | 11567, 11569, 11571, 11573, 11575, 11577, 11579, 11581, 11583, 11585, 11587, 11589, 11591, 11593, 11595, 11597, 11599, 11601, 11603, 11605, 11607, 11609, 11611, 11613, 11615, 11617, 11619, 11621, 11623, 11625, 11627, 11629, 11631, 11633, 11635, 11637, 11639, 11641, 11643, 11645, 11647, 11649, 11651, 11653, 11655, 11657, 11659, 11661, 11663, 11665, 11667, 11669, 11671, 11673, 11675, 11677, 11679, 11681, 11683, 11685 |
| 1 | 65 | 11698, 11700, 11702, 11704, 11706, 11708, 11710, 11712, 11714, 11716, 11718, 11720, 11722, 11724, 11726, 11728, 11730, 11732, 11734, 11736, 11738, 11740, 11742, 11744, 11746, 11748, 11750, 11752, 11754, 11756, 11758, 11760, 11762, 11764, 11766, 11768, 11770, 11772, 11774, 11776, 11778, 11780, 11782, 11784, 11786, 11788, 11790, 11792, 11794, 11796, 11798, 11800, 11802, 11804, 11806, 11808, 11810, 11812, 11814, 11816, 11818, 11820, 11822, 11824, 11826, 11828, 11830, 11832, 11834, 11836, 11838, 11840, 11842, 11844, 11846, 11848, 11850, 11852, 11854, 11856, 11858, 11860, 11862, 11864, 11866, 11868, 11870, 11872, 11874, 11876, 11878, 11880, 11882, 11884, 11886, 11888, 11890, 11892, 11894, 11896, 11898 |
| 1 | 66 | 11910, 11912, 11914, 11916, 11918, 11920, 11922, 11924, 11926, 11928, 11930, 11932 |
| 1 | 67 | 11947, 11949, 11951, 11953, 11955, 11957, 11959, 11961, 11963, 11965, 11967, 11969, 11971, 11973, 11975, 11977, 11979, 11981, 11983, 11985, 11987, 11989, 11991, 11993, 11995, 11997, 11999, 12001, 12003, 12005, 12007, 12009, 12011, 12013, 12015, 12017, 12019, 12021, 12023, 12025, 12027, 12029, 12031, 12033, 12035, 12037, 12039, 12041, 12043, 12045, 12047, 12049, 12051, 12053, 12055, 12057, 12059, 12061, 12063, 12065, 12067, 12069, 12071, 12073, 12075, 12077, 12079, 12081, 12083, 12085, 12087, 12089, 12091, 12093, 12095, 12097, 12099, 12101, 12103, 12105, 12107, 12109, 12111, 12113, 12115, 12117, 12119, 12121, 12123, 12125, 12127, 12129, 12131, 12133, 12135, 12137, 12139, 12141, 12143, 12145, 12147, 12149, 12151, 12153, 12155, 12157, 12159, 12161, 12163, 12165, 12167, 12169, 12171, 12173, 12175, 12177, 12179, 12181, 12183, 12185, 12187, 12189, 12191, 12193, 12195, 12197, 12199, 12201, 12203, 12205, 12207, 12209, 12211, 12213, 12215, 12217, 12219, 12221, 12223, 12225, 12227, 12229, 12231, 12233, 12235, 12237, 12239, 12241, 12243, 12245, 12247, 12249, 12251, 12253, 12255, 12257, 12259, 12261, 12263, 12265, 12267, 12269, 12271, 12273, 12275, 12277, 12279, 12281, 12283, 12285, 12287, 12289, 12291, 12293, 12295, 12297, 12299, 12301, 12303, 12305, 12307, 12309, 12311, 12313, 12315, 12317, 12319, 12321, 12323, 12325, 12327, 12329, 12331, 12333, 12335, 12337, 12339, 12341, 12343, 12345, 12347 |
| 1 | 68 a | 12360, 12362, 12364, 12366, 12368, 12370, 12372, 12374, 12376, 12378, 12380, 12382, 12384, 12386, 12388, 12390, 12392, 12394, 12396, 12398, 12400, 12402, 12404, 12406, 12408, 12410, 12412, 12414, 12416, 12418, 12420, 12422, 12424, 12426, 12428, 12430, 12432, 12434, 12436, 12438, 12440, 12442, 12444, 12446, 12448, 12450, 12452, 12454, 12456, 12458, 12460, 12462, 12464, 12466, 12468, 12470, 12472, 12474, 12476, 12478, 12480, 12482, 12484, 12486, 12488, 12490, 12492, 12494, 12496, 12498, 12500, 12502, 12504, 12506, 12508, 12510, 12512, 12514, 12516, 12518, 12520, 12522, 12524, 12526, 12528, 12530, 12532, 12534, 12536, 12538, 12540, 12542, 12544, 12546, 12548, 12550, 12552, 12554, 12556, 12558, 12560, 12562, 12564, 12566, 12568, 12570, 12572, 12574, 12576, 12578, 12580, 12582, 12584, 12586, 12588, 12590, 12592, 12594, 12596, 12598, 12600, 12602, 12604, 12606, 12608, 12610, 12612, 12614, 12616, 12618, 12620, 12622, 12624, 12626, 12628, 12630, 12632, 12634, 12636, 12638, 12640, 12642, 12644, 12646, 12648, 12650, 12652, 12654, 12656, 12658, 12660, 12662, 12664, 12666, 12668, 12670, 12672, 12674, 12676, 12678, 12680, 12682, 12684, 12686, 12688, 12690, 12692, 12694, 12696, 12698, 12700, 12702, 12704, 12706, 12708, 12710, |

TABLE IIA-continued

| | | Amino acid sequence ID numbers |
|---|---|---|
| | | 12712, 12714, 12716, 12718, 12720, 12722, 12724, 12726, 12728, 12730, 12732, 12734, 12736, 12738, 12740, 12742, 12744, 12746, 12748, 12750, 12752, 12754, 12756, 12758, 12760, 12762, 12764, 12766, 12768, 12770, 12772, 12774, 12776, 12778, 12780, 12782, 12784, 12786, 12788, 12790, 12792, 12794, 12796, 12798, 12800, 12802, 12804, 12806, 12808, 12810, 12812, 12814, 12816, 12818, 12820, 12822, 12824, 12826, 12828, 12830, 12832, 12834, 12836, 12838, 12840, 12842, 12844, 12846, 12848, 12850, 12852, 12854, 12856, 12858, 12860, 12862, 12864, 12866, 12868, 12870, 12872, 12874, 12876, 12878, 12880, 12882, 12884, 12886, 12888, 12890, 12892, 12894, 12896, 12898, 12900, 12902, 12904, 12906, 12908, 12910, 12912, 12914, 12916, 12918, 12920, 12922, 12924 |
| 1 | 68 b | 12360, 12362, 12364, 12366, 12368, 12370, 12372, 12374, 12376, 12378, 12380, 12382, 12384, 12386, 12388, 12390, 12392, 12394, 12396, 12398, 12400, 12402, 12404, 12406, 12408, 12410, 12412, 12414, 12416, 12418, 12420, 12422, 12424, 12426, 12428, 12430, 12432, 12434, 12436, 12438, 12440, 12442, 12444, 12446, 12448, 12450, 12452, 12454, 12456, 12458, 12460, 12462, 12464, 12466, 12468, 12470, 12472, 12474, 12476, 12478, 12480, 12482, 12484, 12486, 12488, 12490, 12492, 12494, 12496, 12498, 12500, 12502, 12504, 12506, 12508, 12510, 12512, 12514, 12516, 12518, 12520, 12522, 12524, 12526, 12528, 12530, 12532, 12534, 12536, 12538, 12540, 12542, 12544, 12546, 12548, 12550, 12552, 12554, 12556, 12558, 12560, 12562, 12564, 12566, 12568, 12570, 12572, 12574, 12576, 12578, 12580, 12582, 12584, 12586, 12588, 12590, 12592, 12594, 12596, 12598, 12600, 12602, 12604, 12606, 12608, 12610, 12612, 12614, 12616, 12618, 12620, 12622, 12624, 12626, 12628, 12630, 12632, 12634, 12636, 12638, 12640, 12642, 12644, 12646, 12648, 12650, 12652, 12654, 12656, 12658, 12660, 12662, 12664, 12666, 12668, 12670, 12672, 12674, 12676, 12678, 12680, 12682, 12684, 12686, 12688, 12690, 12692, 12694, 12696, 12698, 12700, 12702, 12704, 12706, 12708, 12710, 12712, 12714, 12716, 12718, 12720, 12722, 12724, 12726, 12728, 12730, 12732, 12734, 12736, 12738, 12740, 12742, 12744, 12746, 12748, 12750, 12752, 12754, 12756, 12758, 12760, 12762, 12764, 12766, 12768, 12770, 12772, 12774, 12776, 12778, 12780, 12782, 12784, 12786, 12788, 12790, 12792, 12794, 12796, 12798, 12800, 12802, 12804, 12806, 12808, 12810, 12812, 12814, 12816, 12818, 12820, 12822, 12824, 12826, 12828, 12830, 12832, 12834, 12836, 12838, 12840, 12842, 12844, 12846, 12848, 12850, 12852, 12854, 12856, 12858, 12860, 12862, 12864, 12866, 12868, 12870, 12872, 12874, 12876, 12878, 12880, 12882, 12884, 12886, 12888, 12890, 12892, 12894, 12896, 12898, 12900, 12902, 12904, 12906, 12908, 12910, 12912, 12914, 12916, 12918, 12920, 12922, 12924 |
| 1 | 69 | 12939, 12941, 12943, 12945, 12947, 12949, 12951, 12953, 12955, 12957, 12959, 12961, 12963, 12965, 12967, 12969, 12971, 12973, 12975, 12977, 12979, 12981, 12983, 12985, 12987, 12989, 12991, 12993, 12995, 12997, 12999, 13001, 13003, 13005, 13007, 13009, 13011, 13013, 13015, 13017, 13019, 13021, 13023, 13025, 13027, 13029, 13031, 13033, 13035, 13037, 13039, 13041, 13043, 13045, 13047, 13049, 13051, 13053, 13055, 13057, 13059, 13061, 13063, 13065, 13067, 13069, 13071, 13073, 13075, 13077, 13079, 13081, 13083, 13085, 13087, 13089, 13091, 13093, 13095, 13097, 13099, 13101, 13103, 13105, 13107, 13109, 13111, 13113, 13115, 13117, 13119, 13121, 13123, 13125, 13127, 13129, 13131, 13133, 13135, 13137, 13139, 13141, 13143, 13145, 13147, 13149, 13151, 13153, 13155, 13157, 13159, 13161, 13163, 13165, 13167, 13169, 13171, 13173, 13175, 13177, 13179, 13181, 13183, 13185, 13187, 13189, 13191, 13193, 13195, 13197, 13199, 13201, 13203 |

TABLE IIB

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 1 | LT_OEX_1 | B0414 | *E. coli* | 39 | Cytoplasmic | — |
| 1 | 2 | LT_OEX_1 | B2931 | *E. coli* | 148 | Cytoplasmic | — |
| 1 | 3 | LT_OEX_1 | B3945 | *E. coli* | 173 | Cytoplasmic | — |
| 1 | 4 | LT_OEX_1 | YEL004W | *S. cerevisiae* | 383 | Cytoplasmic | — |
| 1 | 5 | LT_OEX_1 | YER177W | *S. cerevisiae* | 407 | Cytoplasmic | 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907 |
| 1 | 6 | LT_OEX_1 | YHR204W | *S. cerevisiae* | 918 | Cytoplasmic | — |
| 1 | 7 | LT_OEX_1 | YLL053C | *S. cerevisiae* | 953 | Cytoplasmic | 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 13270, 13272, 13274 |
| 1 | 8 | LT_OEX_1 | YML123C | *S. cerevisiae* | 1321 | Cytoplasmic | 1617, 1619, 1621, 1623, 1625, 1627, 1629, 1631, 1633, 1635 |
| 1 | 9 | LT_OEX_1 | YNL142W | *S. cerevisiae* | 1649 | Cytoplasmic | 2057 |
| 1 | 10 | LT_OEX_1 | YNR040W | *S. cerevisiae* | 2066 | Cytoplasmic | — |
| 1 | 11 | LT_OEX_1 | YPR035W | *S. cerevisiae* | 2082 | Cytoplasmic | 2348, 2350, 2352, 2354, 2356, 2358, 2360, 2362, 2364, 2366, 2368, 2370, 2372, 2374, 2376, 2378, 2380, 2382, 2384, 2386, 2388, 2390, 2392, 2394 |
| 1 | 12 a | LT_OEX_1 | B0903 | *E. coli* | 2407 | Plastidic | — |
| 1 | 12 b | LT_OEX_1 | B0903 | *E. coli* | 2407 | Cytoplasmic | — |
| 1 | 13 | LT_OEX_1 | B1393 | *E. coli* | 2565 | Cytoplasmic | 2805, 2807, 2809, 2811, 2813, 2815, 2817, 2819, 2821, 2823, 2825, 2827, 2829, 2831, 2833, 2835 |
| 1 | 14 | LT_OEX_1 | B2704 | *E. coli* | 2842 | Plastidic | — |
| 1 | 15 | LT_OEX_1 | B2905 | *E. coli* | 2880 | Cytoplasmic | 3088, 3090, 3092, 3094, 3096, 3098, 3100 |
| 1 | 16 | LT_OEX_1 | B3206 | *E. coli* | 3110 | Plastidic | — |
| 1 | 17 | LT_OEX_1 | B3659 | *E. coli* | 3404 | Cytoplasmic | — |
| 1 | 18 | LT_OEX_1 | B3871 | *E. coli* | 3442 | Cytoplasmic | 3956, 3958, 3960, 3962, 3964 |
| 1 | 19 | LT_OEX_1 | YDR142C | *S. cerevisiae* | 3979 | Plastidic | 4037, 13266 |
| 1 | 20 | LT_OEX_1 | YER175W-A | *S. cerevisiae* | 4048 | Cytoplasmic | — |
| 1 | 21 | LT_OEX_1 | YGR289C | *S. cerevisiae* | 4052 | Plastidic | — |
| 1 | 22 | LT_OEX_1 | YHR044C | *S. cerevisiae* | 4132 | Plastidic | — |
| 1 | 23 | LT_OEX_1 | YHR072W | *S. cerevisiae* | 4218 | Cytoplasmic | 4462, 4464, 4466, 4468, 4470, 4472, 4474, 4476, 4478, 4480 |
| 1 | 24 | LT_OEX_1 | YHR213W-A | *S. cerevisiae* | 4492 | Cytoplasmic | — |
| 1 | 25 | LT_OEX_1 | YIL053W | *S. cerevisiae* | 4496 | Cytoplasmic | — |
| 1 | 26 | LT_OEX_1 | YJL103C | *S. cerevisiae* | 4559 | Plastidic | — |
| 1 | 27 | LT_OEX_1 | YJL137C | *S. cerevisiae* | 4590 | Plastidic | — |
| 1 | 28 | LT_OEX_1 | YLR027C | *S. cerevisiae* | 4623 | Cytoplasmic | 5021, 5023, 5025, 5027, 5029, 5031, 5033, 5035, 5037, 5039, 5041, 5043, 5045, 5047, 5049, 5051, 5053, 5055, 5057, 5059, 5061 |
| 1 | 29 a | LT_OEX_1 | YML079W | *S. cerevisiae* | 5071 | Plastidic | — |
| 1 | 29 b | LT_OEX_1 | YML079W | *S. cerevisiae* | 5071 | Cytoplasmic | — |
| 1 | 30 | LT_OEX_1 | YMR157C | *S. cerevisiae* | 5103 | Plastidic | — |
| 1 | 31 | LT_OEX_1 | YNL024C | *S. cerevisiae* | 5116 | Plastidic | — |
| 1 | 32 a | LT_OEX_1 | YOL058W | *S. cerevisiae* | 5160 | Plastidic | 5736, 5738, 5740 |
| 1 | 32 b | LT_OEX_1 | YOL058W | *S. cerevisiae* | 5160 | Cytoplasmic | 5736, 5738, 5740 |
| 1 | 33 | LT_OEX_1 | YPL180W | *S. cerevisiae* | 5747 | Cytoplasmic | — |
| 1 | 34 | LT_OEX_1 | YPR167C | *S. cerevisiae* | 5757 | Plastidic | 6049 |
| 1 | 35 | LT_OEX_1 | B0036 | *E. coli* | 6087 | Plastidic | 6545, 6547, 6549, 6551, 6553, 6555, 6557, 6559, 6561, 6563, 6565, 6567, 6569, 6571, 6573, 6575 |
| 1 | 36 | LT_OEX_1 | B1906 | *E. coli* | 6582 | Cytoplasmic | — |
| 1 | 37 | LT_OEX_1 | B2371 | *E. coli* | 6610 | Cytoplasmic | — |
| 1 | 38 | LT_OEX_1 | B2881 | *E. coli* | 6950 | Cytoplasmic | 7070, 7072 |
| 1 | 39 | LT_OEX_1 | B3106 | *E. coli* | 7079 | Cytoplasmic | — |
| 1 | 40 | LT_OEX_1 | B3400 | *E. coli* | 7271 | Plastidic | — |
| 1 | 41 | LT_OEX_1 | B3410 | *E. coli* | 7468 | Cytoplasmic | — |
| 1 | 42 | LT_OEX_1 | B4209 | *E. coli* | 7493 | Plastidic | — |
| 1 | 43 | LT_OEX_1 | SLL1545 | *Synechocystis* | 7592 | Cytoplasmic | — |
| 1 | 44 | LT_OEX_1 | SLR1348 | *Synechocystis* | 7671 | Mitochondric | 8225, 8227, 8229 |
| 1 | 45 | LT_OEX_1 | YGR191W | *S. cerevisiae* | 8237 | Plastidic | — |
| 1 | 46 | LT_OEX_1 | AT1G22920 | *A. thaliana* | 8564 | Cytoplasmic | 8638 |
| 1 | 47 | LT_OEX_1 | B1600 | *E. coli* | 8649 | Plastidic | — |
| 1 | 48 | LT_OEX_1 | B1900 | *E. coli* | 8761 | Plastidic | — |
| 1 | 49 | LT_OEX_1 | SLL0099 | *Synechocystis* | 8862 | Cytoplasmic | — |
| 1 | 50 | LT_OEX_1 | SLL0383 | *Synechocystis* | 9047 | Cytoplasmic | — |
| 1 | 51 | LT_OEX_1 | SLR1094 | *Synechocystis* | 9281 | Cytoplasmic | — |
| 1 | 52 | LT_OEX_1 | SLR1520 | *Synechocystis* | 9308 | Cytoplasmic | — |
| 1 | 53 | LT_OEX_1 | YDL142C | *S. cerevisiae* | 9431 | Cytoplasmic | — |

TABLE IIB-continued

Amino acid sequence ID numbers

| Application | 1. Hit | 2. Project | 3. Locus | 4. Organism | 5. Lead SEQ ID | 6. Target | 7. SEQ IDs of Polypeptide Homologs |
|---|---|---|---|---|---|---|---|
| 1 | 54 | LT_OEX_1 | YDR147W | S. cerevisiae | 9480 | Cytoplasmic | — |
| 1 | 55 | LT_OEX_1 | YLR284C | S. cerevisiae | 9501 | Plastidic | — |
| 1 | 56 | LT_OEX_1 | YPL148C | S. cerevisiae | 9554 | Plastidic | — |
| 1 | 57 | LT_OEX_1 | YPR074C | S. cerevisiae | 9575 | Plastidic | 10391, 10393 |
| 1 | 58 | LT_OEX_1 | B1008 | E. coli | 10405 | Plastidic | — |
| 1 | 59 | LT_OEX_1 | B1529 | E. coli | 10504 | Plastidic | — |
| 1 | 60 | LT_OEX_1 | B3347 | E. coli | 10592 | Plastidic | — |
| 1 | 61 | LT_OEX_1 | YBR176W | S. cerevisiae | 10935 | Cytoplasmic | 11455 |
| 1 | 62 | LT_OEX_1 | YGR177C | S. cerevisiae | 11462 | Cytoplasmic | — |
| 1 | 63 | LT_OEX_1 | YHR176W | S. cerevisiae | 11502 | Cytoplasmic | 11550, 11552, 11554, 11556, 11558 |
| 1 | 64 | LT_OEX_1 | B2881_2 | E. coli | 11565 | Cytoplasmic | 11687, 11689 |
| 1 | 65 | LT_OEX_1 | B3945_2 | E. coli | 11696 | Cytoplasmic | — |
| 1 | 66 | LT_OEX_1 | YHR204W_2 | S. cerevisiae | 11908 | Cytoplasmic | — |
| 1 | 67 | LT_OEX_1 | YNL142W_2 | S. cerevisiae | 11945 | Cytoplasmic | 12349 |
| 1 | 68 a | LT_OEX_1 | YOL058W_2 | S. cerevisiae | 12358 | Plastidic | 12926, 12928, 12930 |
| 1 | 68 b | LT_OEX_1 | YOL058W_2 | S. cerevisiae | 12358 | Cytoplasmic | 12926, 12928, 12930 |
| 1 | 69 | LT_OEX_1 | YPR035W_2 | S. cerevisiae | 12937 | Cytoplasmic | 13205, 13207, 13209, 13211, 13213, 13215, 13217, 13219, 13221, 13223, 13225, 13227, 13229, 13231, 13233, 13235, 13237, 13239, 13241, 13243, 13245, 13247, 13249, 13251 |

TABLE III

Primer nucleic acid sequence ID numbers

| Application | 1. Hit | 2. Project | 3. Locus | 4. Organism | 5. Lead SEQ ID | 6. Target | 7. SEQ IDs of Primers |
|---|---|---|---|---|---|---|---|
| 1 | 1 | LT_OEX_1 | B0414 | E. coli | 38 | Cytoplasmic | 136, 137 |
| 1 | 2 | LT_OEX_1 | B2931 | E. coli | 147 | Cytoplasmic | 165, 166 |
| 1 | 3 | LT_OEX_1 | B3945 | E. coli | 172 | Cytoplasmic | 374, 375 |
| 1 | 4 | LT_OEX_1 | YEL004W | S. cerevisiae | 382 | Cytoplasmic | 398, 399 |
| 1 | 5 | LT_OEX_1 | YER177W | S. cerevisiae | 406 | Cytoplasmic | 908, 909 |
| 1 | 6 | LT_OEX_1 | YHR204W | S. cerevisiae | 917 | Cytoplasmic | 941, 942 |
| 1 | 7 | LT_OEX_1 | YLL053C | S. cerevisiae | 952 | Cytoplasmic | 1316, 1317 |
| 1 | 8 | LT_OEX_1 | YML123C | S. cerevisiae | 1320 | Cytoplasmic | 1636, 1637 |
| 1 | 9 | LT_OEX_1 | YNL142W | S. cerevisiae | 1648 | Cytoplasmic | 2058, 2059 |
| 1 | 10 | LT_OEX_1 | YNR040W | S. cerevisiae | 2065 | Cytoplasmic | 2077, 2078 |
| 1 | 11 | LT_OEX_1 | YPR035W | S. cerevisiae | 2081 | Cytoplasmic | 2395, 2396 |
| 1 | 12 a | LT_OEX_1 | B0903 | E. coli | 2406 | Plastidic | 2546, 2547 |
| 1 | 12 b | LT_OEX_1 | B0903 | E. coli | 2406 | Cytoplasmic | 2546, 2547 |
| 1 | 13 | LT_OEX_1 | B1393 | E. coli | 2564 | Cytoplasmic | 2836, 2837 |
| 1 | 14 | LT_OEX_1 | B2704 | E. coli | 2841 | Plastidic | 2875, 2876 |
| 1 | 15 | LT_OEX_1 | B2905 | E. coli | 2879 | Cytoplasmic | 3101, 3102 |
| 1 | 16 | LT_OEX_1 | B3206 | E. coli | 3109 | Plastidic | 3399, 3400 |
| 1 | 17 | LT_OEX_1 | B3659 | E. coli | 3403 | Cytoplasmic | 3431, 3432 |
| 1 | 18 | LT_OEX_1 | B3871 | E. coli | 3441 | Cytoplasmic | 3965, 3966 |
| 1 | 19 | LT_OEX_1 | YDR142C | S. cerevisiae | 3978 | Plastidic | 4038, 4039 |
| 1 | 20 | LT_OEX_1 | YER175W-A | S. cerevisiae | 4047 | Cytoplasmic | 4049, 4050 |
| 1 | 21 | LT_OEX_1 | YGR289C | S. cerevisiae | 4051 | Plastidic | 4121, 4122 |
| 1 | 22 | LT_OEX_1 | YHR044C | S. cerevisiae | 4131 | Plastidic | 4211, 4212 |
| 1 | 23 | LT_OEX_1 | YHR072W | S. cerevisiae | 4217 | Cytoplasmic | 4481, 4482 |
| 1 | 24 | LT_OEX_1 | YHR213W-A | S. cerevisiae | 4491 | Cytoplasmic | 4493, 4494 |
| 1 | 25 | LT_OEX_1 | YIL053W | S. cerevisiae | 4495 | Cytoplasmic | 4551, 4552 |
| 1 | 26 | LT_OEX_1 | YJL103C | S. cerevisiae | 4558 | Plastidic | 4580, 4581 |
| 1 | 27 | LT_OEX_1 | YJL137C | S. cerevisiae | 4589 | Plastidic | 4613, 4614 |
| 1 | 28 | LT_OEX_1 | YLR027C | S. cerevisiae | 4622 | Cytoplasmic | 5062, 5063 |
| 1 | 29 a | LT_OEX_1 | YML079W | S. cerevisiae | 5070 | Plastidic | 5098, 5099 |
| 1 | 29 b | LT_OEX_1 | YML079W | S. cerevisiae | 5070 | Cytoplasmic | 5098, 5099 |
| 1 | 30 | LT_OEX_1 | YMR157C | S. cerevisiae | 5102 | Plastidic | 5110, 5111 |
| 1 | 31 | LT_OEX_1 | YNL024C | S. cerevisiae | 5115 | Cytoplasmic | 5153, 5154 |
| 1 | 32 a | LT_OEX_1 | YOL058W | S. cerevisiae | 5159 | Plastidic | 5741, 5742 |
| 1 | 32 b | LT_OEX_1 | YOL058W | S. cerevisiae | 5159 | Cytoplasmic | 5741, 5742 |
| 1 | 33 | LT_OEX_1 | YPL180W | S. cerevisiae | 5746 | Cytoplasmic | 5750, 5751 |
| 1 | 34 | LT_OEX_1 | YPR167C | S. cerevisiae | 5756 | Plastidic | 6050, 6051 |
| 1 | 35 | LT_OEX_1 | B0036 | E. coli | 6086 | Plastidic | 6576, 6577 |
| 1 | 36 | LT_OEX_1 | B1906 | E. coli | 6581 | Cytoplasmic | 6605, 6606 |
| 1 | 37 | LT_OEX_1 | B2371 | E. coli | 6609 | Cytoplasmic | 6945, 6946 |
| 1 | 38 | LT_OEX_1 | B2881 | E. coli | 6949 | Cytoplasmic | 7073, 7074 |
| 1 | 39 | LT_OEX_1 | B3106 | E. coli | 7078 | Cytoplasmic | 7266, 7267 |

TABLE III-continued

Primer nucleic acid sequence ID numbers

| Application | 1. Hit | 2. Project | 3. Locus | 4. Organism | 5. Lead SEQ ID | 6. Target | 7. SEQ IDs of Primers |
|---|---|---|---|---|---|---|---|
| 1 | 40 | LT_OEX_1 | B3400 | E. coli | 7270 | Plastidic | 7462, 7463 |
| 1 | 41 | LT_OEX_1 | B3410 | E. coli | 7467 | Cytoplasmic | 7487, 7488 |
| 1 | 42 | LT_OEX_1 | B4209 | E. coli | 7492 | Plastidic | 7584, 7585 |
| 1 | 43 | LT_OEX_1 | SLL1545 | Synechocystis | 7591 | Cytoplasmic | 7667, 7668 |
| 1 | 44 | LT_OEX_1 | SLR1348 | Synechocystis | 7670 | Mitochondric | 8230, 8231 |
| 1 | 45 | LT_OEX_1 | YGR191W | S. cerevisiae | 8236 | Plastidic | 8558, 8559 |
| 1 | 46 | LT_OEX_1 | AT1G22920 | A. thaliana | 8563 | Cytoplasmic | 8639, 8640 |
| 1 | 47 | LT_OEX_1 | B1600 | E. coli | 8648 | Plastidic | 8756, 8757 |
| 1 | 48 | LT_OEX_1 | B1900 | E. coli | 8760 | Plastidic | 8850, 8851 |
| 1 | 49 | LT_OEX_1 | SLL0099 | Synechocystis | 8861 | Cytoplasmic | 9041, 9042 |
| 1 | 50 | LT_OEX_1 | SLL0383 | Synechocystis | 9046 | Cytoplasmic | 9276, 9277 |
| 1 | 51 | LT_OEX_1 | SLR1094 | Synechocystis | 9280 | Cytoplasmic | 9300, 9301 |
| 1 | 52 | LT_OEX_1 | SLR1520 | Synechocystis | 9307 | Cytoplasmic | 9425, 9426 |
| 1 | 53 | LT_OEX_1 | YDL142C | S. cerevisiae | 9430 | Cytoplasmic | 9474, 9475 |
| 1 | 54 | LT_OEX_1 | YDR147W | S. cerevisiae | 9479 | Cytoplasmic | 9487, 9488 |
| 1 | 55 | LT_OEX_1 | YLR284C | S. cerevisiae | 9500 | Plastidic | 9548, 9549 |
| 1 | 56 | LT_OEX_1 | YPL148C | S. cerevisiae | 9553 | Plastidic | 9567, 9568 |
| 1 | 57 | LT_OEX_1 | YPR074C | S. cerevisiae | 9574 | Plastidic | 10394, 10395 |
| 1 | 58 | LT_OEX_1 | B1008 | E. coli | 10404 | Plastidic | 10496, 10497 |
| 1 | 59 | LT_OEX_1 | B1529 | E. coli | 10503 | Plastidic | 10585, 10586 |
| 1 | 60 | LT_OEX_1 | B3347 | E. coli | 10591 | Plastidic | 10929, 10930 |
| 1 | 61 | LT_OEX_1 | YBR176W | S. cerevisiae | 10934 | Cytoplasmic | 11456, 11457 |
| 1 | 62 | LT_OEX_1 | YGR177C | S. cerevisiae | 11461 | Cytoplasmic | 11487, 11488 |
| 1 | 63 | LT_OEX_1 | YHR176W | S. cerevisiae | 11501 | Cytoplasmic | 11559, 11560 |
| 1 | 64 | LT_OEX_1 | B2881_2 | E. coli | 11564 | Cytoplasmic | 11690, 11691 |
| 1 | 65 | LT_OEX_1 | B3945_2 | E. coli | 11695 | Cytoplasmic | 11899, 11900 |
| 1 | 66 | LT_OEX_1 | YHR204W_2 | S. cerevisiae | 11907 | Cytoplasmic | 11933, 11934 |
| 1 | 67 | LT_OEX_1 | YNL142W_2 | S. cerevisiae | 11944 | Cytoplasmic | 12350, 12351 |
| 1 | 68 a | LT_OEX_1 | YOL058W_2 | S. cerevisiae | 12357 | Plastidic | 12931, 12932 |
| 1 | 68 b | LT_OEX_1 | YOL058W_2 | S. cerevisiae | 12357 | Cytoplasmic | 12931, 12932 |
| 1 | 69 | LT_OEX_1 | YPR035W_2 | S. cerevisiae | 12936 | Cytoplasmic | 13252, 13253 |

TABLE IV

Consensus amino acid sequence ID numbers

| Application | 1. Hit | 2. Project | 3. Locus | 4. Organism | 5. Lead SEQ ID | 6. Target | 7. SEQ IDs of Consensus/Pattern Sequences |
|---|---|---|---|---|---|---|---|
| 1 | 1 | LT_OEX_1 | B0414 | E. coli | 39 | Cytoplasmic | 138, 139, 140, 141, 142, 143, 144, 145, 146 |
| 1 | 2 | LT_OEX_1 | B2931 | E. coli | 148 | Cytoplasmic | 167, 168, 169, 170, 171 |
| 1 | 3 | LT_OEX_1 | B3945 | E. coli | 173 | Cytoplasmic | 376, 377, 378, 379, 380, 381 |
| 1 | 4 | LT_OEX_1 | YEL004W | S. cerevisiae | 383 | Cytoplasmic | 400, 401, 402, 403, 404, 405 |
| 1 | 5 | LT_OEX_1 | YER177W | S. cerevisiae | 407 | Cytoplasmic | 910, 911, 912, 913, 914, 915, 916 |
| 1 | 6 | LT_OEX_1 | YHR204W | S. cerevisiae | 918 | Cytoplasmic | 943, 944, 945, 946, 947, 948, 949, 950, 951 |
| 1 | 7 | LT_OEX_1 | YLL053C | S. cerevisiae | 953 | Cytoplasmic | 1318, 1319 |
| 1 | 8 | LT_OEX_1 | YML123C | S. cerevisiae | 1321 | Cytoplasmic | 1638, 1639, 1640, 1641, 1642, 1643, 1644, 1645, 1646, 1647 |
| 1 | 9 | LT_OEX_1 | YNL142W | S. cerevisiae | 1649 | Cytoplasmic | 2060, 2061, 2062, 2063, 2064 |
| 1 | 10 | LT_OEX_1 | YNR040W | S. cerevisiae | 2066 | Cytoplasmic | 2079, 2080 |
| 1 | 11 | LT_OEX_1 | YPR035W | S. cerevisiae | 2082 | Cytoplasmic | 2397, 2398, 2399, 2400, 2401, 2402, 2403, 2404, 2405 |
| 1 | 12 a | LT_OEX_1 | B0903 | E. coli | 2407 | Plastidic | 2548, 2549, 2550, 2551, 2552, 2553, 2554, 2555, 2556, 2557, 2558, 2559, 2560, 2561, 2562, 2563 |
| 1 | 12 b | LT_OEX_1 | B0903 | E. coli | 2407 | Cytoplasmic | 2548, 2549, 2550, 2551, 2552, 2553, 2554, 2555, 2556, 2557, 2558, 2559, 2560, 2561, 2562, 2563 |
| 1 | 13 | LT_OEX_1 | B1393 | E. coli | 2565 | Cytoplasmic | 2838, 2839, 2840 |
| 1 | 14 | LT_OEX_1 | B2704 | E. coli | 2842 | Plastidic | 2877, 2878 |
| 1 | 15 | LT_OEX_1 | B2905 | E. coli | 2880 | Cytoplasmic | 3103, 3104, 3105, 3106, 3107, 3108 |
| 1 | 16 | LT_OEX_1 | B3206 | E. coli | 3110 | Plastidic | 3401, 3402 |
| 1 | 17 | LT_OEX_1 | B3659 | E. coli | 3404 | Cytoplasmic | 3433, 3434, 3435, 3436, 3437, 3438, 3439, 3440 |
| 1 | 18 | LT_OEX_1 | B3871 | E. coli | 3442 | Cytoplasmic | 3967, 3968, 3969, 3970, 3971, 3972, 3973, 3974, 3975, 3976, 3977 |
| 1 | 19 | LT_OEX_1 | YDR142C | S. cerevisiae | 3979 | Plastidic | 4040, 4041, 4042, 4043, 4044, 4045, 4046 |
| 1 | 20 | LT_OEX_1 | YER175W-A | S. cerevisiae | 4048 | Cytoplasmic | — |
| 1 | 21 | LT_OEX_1 | YGR289C | S. cerevisiae | 4052 | Plastidic | 4123, 4124, 4125, 4126, 4127, 4128, 4129, 4130 |
| 1 | 22 | LT_OEX_1 | YHR044C | S. cerevisiae | 4132 | Plastidic | 4213, 4214, 4215, 4216 |
| 1 | 23 | LT_OEX_1 | YHR072W | S. cerevisiae | 4218 | Cytoplasmic | 4483, 4484, 4485, 4486, 4487, 4488, 4489, 4490 |
| 1 | 24 | LT_OEX_1 | YHR213W-A | S. cerevisiae | 4492 | Cytoplasmic | — |
| 1 | 25 | LT_OEX_1 | YIL053W | S. cerevisiae | 4496 | Cytoplasmic | 4553, 4554, 4555, 4556, 4557 |
| 1 | 26 | LT_OEX_1 | YJL103C | S. cerevisiae | 4559 | Plastidic | 4582, 4583, 4584, 4585, 4586, 4587, 4588 |

TABLE IV-continued

Consensus amino acid sequence ID numbers

| Application | 1. Hit | 2. Project | 3. Locus | 4. Organism | 5. Lead SEQ ID | 6. Target | 7. SEQ IDs of Consensus/Pattern Sequences |
|---|---|---|---|---|---|---|---|
| 1 | 27 | LT_OEX_1 | YJL137C | S. cerevisiae | 4590 | Plastidic | 4615, 4616, 4617, 4618, 4619, 4620, 4621 |
| 1 | 28 | LT_OEX_1 | YLR027C | S. cerevisiae | 4623 | Cytoplasmic | 5064, 5065, 5066, 5067, 5068, 5069 |
| 1 | 29 a | LT_OEX_1 | YML079W | S. cerevisiae | 5071 | Plastidic | 5100, 5101 |
| 1 | 29 b | LT_OEX_1 | YML079W | S. cerevisiae | 5071 | Cytoplasmic | 5100, 5101 |
| 1 | 30 | LT_OEX_1 | YMR157C | S. cerevisiae | 5103 | Plastidic | 5112, 5113, 5114 |
| 1 | 31 | LT_OEX_1 | YNL024C | S. cerevisiae | 5116 | Plastidic | 5155, 5156, 5157, 5158 |
| 1 | 32 a | LT_OEX_1 | YOL058W | S. cerevisiae | 5160 | Plastidic | 5743, 5744, 5745 |
| 1 | 32 b | LT_OEX_1 | YOL058W | S. cerevisiae | 5160 | Cytoplasmic | 5743, 5744, 5745 |
| 1 | 33 | LT_OEX_1 | YPL180W | S. cerevisiae | 5747 | Cytoplasmic | 5752, 5753, 5754, 5755 |
| 1 | 34 | LT_OEX_1 | YPR167C | S. cerevisiae | 5757 | Plastidic | 6052, 6053 |
| 1 | 35 | LT_OEX_1 | B0036 | E. coli | 6087 | Plastidic | 6578, 6579, 6580 |
| 1 | 36 | LT_OEX_1 | B1906 | E. coli | 6582 | Cytoplasmic | 6607, 6608 |
| 1 | 37 | LT_OEX_1 | B2371 | E. coli | 6610 | Cytoplasmic | 6947, 6948 |
| 1 | 38 | LT_OEX_1 | B2881 | E. coli | 6950 | Cytoplasmic | 7075, 7076, 7077 |
| 1 | 39 | LT_OEX_1 | B3106 | E. coli | 7079 | Cytoplasmic | 7268, 7269 |
| 1 | 40 | LT_OEX_1 | B3400 | E. coli | 7271 | Plastidic | 7464, 7465, 7466 |
| 1 | 41 | LT_OEX_1 | B3410 | E. coli | 7468 | Cytoplasmic | 7489, 7490, 7491 |
| 1 | 42 | LT_OEX_1 | B4209 | E. coli | 7493 | Plastidic | 7586, 7587, 7588, 7589, 7590 |
| 1 | 43 | LT_OEX_1 | SLL1545 | Synechocystis | 7592 | Cytoplasmic | 7669 |
| 1 | 44 | LT_OEX_1 | SLR1348 | Synechocystis | 7671 | Mitochondric | 8232, 8233, 8234, 8235 |
| 1 | 45 | LT_OEX_1 | YGR191W | S. cerevisiae | 8237 | Plastidic | 8560, 8561, 8562 |
| 1 | 46 | LT_OEX_1 | AT1G22920 | A. thaliana | 8564 | Cytoplasmic | 8641, 8642, 8643, 8644, 8645, 8646, 8647 |
| 1 | 47 | LT_OEX_1 | B1600 | E. coli | 8649 | Plastidic | 8758, 8759 |
| 1 | 48 | LT_OEX_1 | B1900 | E. coli | 8761 | Plastidic | 8852, 8853, 8854, 8855, 8856, 8857, 8858, 8859, 8860 |
| 1 | 49 | LT_OEX_1 | SLL0099 | Synechocystis | 8862 | Cytoplasmic | 9043, 9044, 9045 |
| 1 | 50 | LT_OEX_1 | SLL0383 | Synechocystis | 9047 | Cytoplasmic | 9278, 9279 |
| 1 | 51 | LT_OEX_1 | SLR1094 | Synechocystis | 9281 | Cytoplasmic | 9302, 9303, 9304, 9305, 9306 |
| 1 | 52 | LT_OEX_1 | SLR1520 | Synechocystis | 9308 | Cytoplasmic | 9427, 9428, 9429 |
| 1 | 53 | LT_OEX_1 | YDL142C | S. cerevisiae | 9431 | Cytoplasmic | 9476, 9477, 9478 |
| 1 | 54 | LT_OEX_1 | YDR147W | S. cerevisiae | 9480 | Cytoplasmic | 9489, 9490, 9491, 9492, 9493, 9494, 9495, 9496, 9497, 9498, 9499 |
| 1 | 55 | LT_OEX_1 | YLR284C | S. cerevisiae | 9501 | Plastidic | 9550, 9551, 9552 |
| 1 | 56 | LT_OEX_1 | YPL148C | S. cerevisiae | 9554 | Plastidic | 9569, 9570, 9571, 9572, 9573 |
| 1 | 57 | LT_OEX_1 | YPR074C | S. cerevisiae | 9575 | Plastidic | 10396, 10397, 10398, 10399, 10400, 10401, 10402, 10403 |
| 1 | 58 | LT_OEX_1 | B1008 | E. coli | 10405 | Plastidic | 10498, 10499, 10500, 10501, 10502 |
| 1 | 59 | LT_OEX_1 | B1529 | E. coli | 10504 | Plastidic | 10587, 10588, 10589, 10590 |
| 1 | 60 | LT_OEX_1 | B3347 | E. coli | 10592 | Plastidic | 10931, 10932, 10933 |
| 1 | 61 | LT_OEX_1 | YBR176W | S. cerevisiae | 10935 | Cytoplasmic | 11458, 11459, 11460 |
| 1 | 62 | LT_OEX_1 | YGR177C | S. cerevisiae | 11462 | Cytoplasmic | 11489, 11490, 11491, 11492, 11493, 11494, 11495, 11496, 11497, 11498, 11499, 11500 |
| 1 | 63 | LT_OEX_1 | YHR176W | S. cerevisiae | 11502 | Cytoplasmic | 11561, 11562, 11563 |
| 1 | 64 | LT_OEX_1 | B2881_2 | E. coli | 11565 | Cytoplasmic | 11692, 11693, 11694 |
| 1 | 65 | LT_OEX_1 | B3945_2 | E. coli | 11696 | Cytoplasmic | 11901, 11902, 11903, 11904, 11905, 11906 |
| 1 | 66 | LT_OEX_1 | YHR204W_2 | S. cerevisiae | 11908 | Cytoplasmic | 11935, 11936, 11937, 11938, 11939, 11940, 11941, 11942, 11943 |
| 1 | 67 | LT_OEX_1 | YNL142W_2 | S. cerevisiae | 11945 | Cytoplasmic | 12352, 12353, 12354, 12355, 12356 |
| 1 | 68 a | LT_OEX_1 | YOL058W_2 | S. cerevisiae | 12358 | Plastidic | 12933, 12934, 12935 |
| 1 | 68 b | LT_OEX_1 | YOL058W_2 | S. cerevisiae | 12358 | Cytoplasmic | 12933, 12934, 12935 |
| 1 | 69 | LT_OEX_1 | YPR035W_2 | S. cerevisiae | 12937 | Cytoplasmic | 13254, 13255, 13256, 13257, 13258, 13259, 13260, 13261, 13262 |

SEQUENCE LISTING (13274 sequences)

SEQ ID NO: 1 - DNA, 9045 bp, Artificial sequence
  VC-MME220-1
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 2 - DNA, 8883 bp, Artificial sequence
  VC-MME221-1
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 3 - DNA, 9469 bp, Artificial sequence
  VC-MME354-1
  CDS (2295)..(2404): FNR transit peptide
  CDS (2482)..(2545): FNR transit peptide
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattcgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctctgaattccagctgaccacccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 4 - protein, 58 aa, Artificial sequence
  Synthetic Construct
MTTAVTAAVSFPSTKTTSLSARSSSVISPDKISYKKVPLYYRNVSATGKMGPIRAQIA

SEQ ID NO: 5 - DNA, 9465 bp, Artificial sequence
  VC-MME432-1
  CDS (2290)..(2400): FNR transit peptide
  CDS (2478)..(2540): FNR transit peptide
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccaaacgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctcttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 6 - protein, 58 aa, Artificial sequence; identical to SEQ ID NO: 4
  Synthetic Construct

SEQ ID NO: 7 - DNA, 19 bp, Artificial sequence
  adapter sequence added to gene specific primers for cloning purposes
ggaattccagctgaccacc

SEQ ID NO: 8 - DNA, 20 bp, Artificial sequence
  adapter sequence added to gene specific primers for cloning purposes
gatccccgggaattgccatg

SEQ ID NO: 9 - DNA, 10 bp, Artificial sequence
  adapter sequence added to gene specific primers for cloning purposes
ttgctcttcc

SEQ ID NO: 10 - DNA, 10 bp, Artificial sequence
  adapter sequence added to gene specific primers for cloning purposes
ttgctcttcg

SEQ ID NO: 11 - DNA, 34 bp, Artificial sequence
  Amplification of the targeting sequence of the gene FNR from Spinacia oleracea to generate the S.cerevisiae plastidic targeting vector VC-MME354-1
atagaattcgcataaacttatcttcatagttgcc

SEQ ID NO: 12 - DNA, 27 bp, Artificial sequence
  Amplification of the targeting sequence of the gene FNR from Spinacia oleracea to generate the S.cerevisiae plastidic targeting vector VC-MME354-1
atagaattcagaggcgatctgggccct

SEQ ID NO: 13 - DNA, 36 bp, Artificial sequence
  Amplification of the targeting sequence of the gene FNR from Spinacia oleracea to generate the E.coli plastidic targeting vector VC-MME432-1
atagtttaaacgcataaacttatcttcatagttgcc

SEQ ID NO: 14 - DNA, 34 bp, Artificial sequence
  Amplification of the targeting sequence of the gene FNR from Spinacia oleracea to generate the E.coli plastidic targeting vector VC-MME432-1
ataccatggaagagcaagaggcgatctgggccct

SEQ ID NO: 15 - DNA, 9044 bp, Artificial sequence
  VC-MME489-1p
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattccagctgaccacccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 16 - DNA, 9041 bp, Artificial sequence
  pMTX0270p
gctttgggcggatccggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 17 - protein, 62 aa, Acetabularia mediterranea
MASIMMNKSVVLSKECAKPLATPKVTLNKRGFATTIATKNREMMVWQPFNNKMFETFSFLPP

SEQ ID NO: 18 - protein, 90 aa, Arabidopsis thaliana
MAASLQSTATFLQSAKIATAPSRGSSHLRSTQAVGKSFGLETSSARLTCSFQSDFKDFTGKCSDAVKIAGFALATSALVVSGASAEGAPK

SEQ ID NO: 19 - protein, 96 aa, Arabidopsis thaliana
MAQVSRICNGVQNPSLICNLSKSSQRKSPLSVSLKTQQHPRAYPISSSWGLKKSGMTLIGSELRPLKVMSSVSTAEKASEIVLQPIREISGLIKLP

SEQ ID NO: 20 - protein, 100 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGA

SEQ ID NO: 21 - protein, 46 aa, Arabidopsis thaliana
MITSSLTCSLQALKLSSPFAHGSTPLSSLSKPNSFPNHRMPALVPV

SEQ ID NO: 22 - protein, 93 aa, Arabidopsis thaliana
MASLLGTSSSAIWASPSLSSPSSKPSSSPICFRPGKLFGSKLNAGIQIRPKKNRSRYHVSVMNVATEINSTEQVVGKFDSKKSARPVYPFAAI

SEQ ID NO: 23 - protein, 52 aa, Arabidopsis thaliana
MASTALSSAIVGTSFIRRSPAPISLRSLPSANTQSLFGLKSGTARGGRVVAM

SEQ ID NO: 24 - protein, 39 aa, Arabidopsis thaliana
MAASTMALSSPAFAGKAVNLSPAASEVLGSGRVTNRKTV

SEQ ID NO: 25 - protein, 92 aa, Arabidopsis thaliana
MAAITSATVTIPSFTGLKLAVSSKPKTLSTISRSSSATRAPPKLALKSSLKDFGVIAVATAASIVLAGNAMAMEVLLGSDDGSLAFVPSEFT

SEQ ID NO: 26 - protein, 85 aa, Arabidopsis thaliana
MAAAVSTVGAINRAPLSLNGSGSGAVSAPASTFLGKKVVTVSRFAQSNKKSNGSFKVLAVKEDKQTDGDRWRGLAYDTSDDQIDI

SEQ ID NO: 27 - protein, 54 aa, Arabidopsis thaliana
MKSSMLSSTAWTSPAQATMVAPFTGLKSSASFPVTRKANNDITSITSNGGRVSC

SEQ ID NO: 28 - protein, 91 aa, Arabidopsis thaliana
MAASGTSATFRASVSSAPSSSSQLTHLKSPFKAVKYTPLPSSRSKSSSFSVSCTIAKDPPVLMAAGSDPALWQRPDSFGRFGKFGGKYVPE

SEQ ID NO: 29 - protein, 80 aa, Brassica campestris
MSTTFCSSVCMQATSLAATTRISFQKPALVSTTNLSFNLRRSIPTRFSISCAAKPETVEKVSKIVKKQLSLKDDQKVVAE

SEQ ID NO: 30 - protein, 51 aa, Brassica napus
MATTFSASVSMQATSLATTTRISFQKPVLVSNHGRTNLSFNLSRTRLSISC

SEQ ID NO: 31 - protein, 44 aa, Chlamydomonas reinhardtii
MQALSSRVNIAAKPQRAQRLVVRAEEVKAAPKKEVGPKRGSLVK

SEQ ID NO: 32 - protein, 51 aa, Cucurbita moschata
MAELIQDKESAQSAATAAAASSGYERRNEPAHSRKFLEVRSEEELLSCIKK

SEQ ID NO: 33 - protein, 62 aa, Spinacea oleracea
MSTINGCLTSISPSRTQLKNTSTLRPTFIANSRVNPSSSVPPSLIRNQPVFAAPAPIITPTL

SEQ ID NO: 34 - protein, 75 aa, Spinacea oleracea
MTTAVTAAVSFPSTKTTSLSARCSSVISPDKISYKKVPLYYRNVSATGKMGPIRAQIASDVEAPPPAPAKVEKMS

SEQ ID NO: 35 - protein, 55 aa, Spinacea oleracea
MTTAVTAAVSFPSTKTTSLSARSSSVISPDKISYKKVPLYYRNVSATGKMGPIRA

SEQ ID NO: 36 - DNA, 419 bp, Spinacia oleracea
  5'UTR (1)..(168)
  CDS (166)..(273)
  CDS (351)..(419)
gcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctct

SEQ ID NO: 37 - protein, 59 aa, Spinacia oleracea
MTTAVTAAVSFPSTKTTSLSARSSSVISPDKISYKKVPLYYRNVSATGKMGPIRAQIAS

SEQ ID NO: 38 - DNA, 1104 bp, Escherichia coli
  CDS (1)..(1104): transl_table=11
atgcaggacgagtattacatggcgcgggcgctaaagctggcgcaacgaggacgttttaccacgcatcccaacccgaatgtcgggtgcgtcattgtcaaagatggcgaaattgtcggtgaaggttaccaccaacgtgcgggtgaaccacatgccgaagtacacgcgttgcgtatggcgggtgaaaaagccaaaggtgcgaccgcctatgtcacactcgaaccctgtagccatcatggtcgtacgccaccgtgctgtgacgcactcatcgccgctggcgtagcgcgcgtggttgcctcgatgcaagatcctaacccgcaggtcgctgggcgtggactttaccgtctgcaacaggctggcattgacgtcagccacggcctgatgatgagtgaagccgagcaattgaataaaggctttctcaagcggatgcgcaccggctttccttatattcagttaaaacttggcgcatcgcttgatggtcgcacggcgatggcgagcggcgaaagccagtggatcacttcgccccaggcgcggcgtgatgtacaactactgcgcgcgcaaagtcatgccattttaaccagcagcgccacggtgctggcggatgatcctgccttaacggtgcgttggtctgaactggatgaacaaactcaggcgctctatccgcaacaaaatctccgtcagccgatacgtattgtgattgatagccaaaatcgcgtgacgccggtacatcgcattgtgcagcagcccggcgaaacctggttcgcgcgtacgcaggaagattctcgtgagtggccggaaacggtgcgtaccttgctgattccagagcataaaggtcatctggatctggttgtactgatgatgcaactgggtaaacagcaaattaacagcatctgggtggaagcggggccaacgctcgctggcgcattgctgcaggcgggtttagtcgatgagctgattgtctatatcgcacctaaactattaggcagcgacgcccgcggattatgcacgctgccagggcttgagaaattagccgacgccccccaatttaaattcaaagagatacgtcatgtaggcccggatgtttgcctgcatttagtgggtgcataa

SEQ ID NO: 39 - protein, 367 aa, Escherichia coli
MQDEYYMARALKLAQRGRFTTHPNPNVGCVIVKDGEIVGEGYHQRAGEPHAEVHALRMAGEKAKGATAYVTLEPCSHHGRTPPCCDALIAAGVARVVASMQDPNPQVAGRGLYRLQQAGIDVSHGLMMSEAEQLNKGFLKRMRTGFPYIQLKLGASLDGRTAMASGESQWITSPQARRDVQLLRAQSHAILTSSATVLADDPALTVRWSELDEQTQALYPQQNLRQPIRIVIDSQNRVTPVHRIVQQPGETWFARTQEDSREWPETVRTLLIPEHKGHLDLVVLMMQLGKQQINSIWVEAGPTLAGALLQAGLVDELIVYIAPKLLGSDARGLCTLPGLEKLADAPQFKFKEIRHVGPDVCLHLVGA

SEQ ID NO: 40 - DNA, 1104 bp, Vibrio cholerae O1 biovar eltor str. N16961
  CDS (1)..(1104): transl_table=11
atgcctatgtttacctcttttgatcatcaaatgatgtctcgcgcgattgaacttgcgtggcgcgggcgttttaccacttctcctaatcctaatgtcggctgcgtgatcactcgcggtgagcagattgtaggggaaggtttccattttcgcgcgggcgaaccccatgctgaagtgcatgctatgcgccaagccggtgagcttactcgcggtgcgaccgcttatgtcactttagagccttgctctcattatggtcgcacaccgccttgtgctgaagggcttattaaagccggggttgcgaaagtgatttgcgcaatgcaagaccctaacccacaagtggcggggaagggcgtacaaatgctgcgtgatgccgggattgaggttgaagtggggttgctggaagcggatgctcgagtactcaaccgcggttttctaaaacgtatggaaaccggcatgccttttgtgcagcttaaaatggcggcgagtctcgatggacaaaccgcgctcgctaacggtaaaagccagtggattacctctcctgcagcacgtaaagatgttcagcggtttcgcgcgcaagccagtgcgattctctccaccagtcaaacggtgctggcggataatgcttctctggcggtgcgttggtacgatttaccgtcatcggtacaggcgcaatacgcagaagcggatttgcgtcagccactgcgggtgattttggatcgtcaacatcaattgcatccagagttagcgttataccaaacaccttcacccgtgctgcgagttgccagcgagaatgccgaactctgtatctctgctgagaacggaaagcttgatttgcgtgagcttttggcactactcgctcagcaacacaatgtgaatcaactctgggtagaggcggggagccaactggctcaatctttgattgagcaaaagttggtggatgaaatcattctctatttagcgccgaaactgatgggcagtgatggccgtggtttatttggcgcgctcggtttgacggaaatggctgaggccattgaactcaaaatagaagattgtcgaatggtgggggcagatttgcggatcatcgccaccccaaaaacaaaagattag

SEQ ID NO: 41 - protein, 367 aa, Vibrio cholerae O1 biovar eltor str. N16961
MPMFTSFDHQMMSRAIELAWRGRFTTSPNPNVGCVITRGEQIVGEGFHFRAGEPHAEVHAMRQAGELTRGATAYVTLEPCSHYGRTPPCAEGLIKAGVAKVICAMQDPNPQVAGKGVQMLRDAGIEVEVGLLEADARVLNRGFLKRMETGMPFVQLKMAASLDGQTALANGKSQWITSPAARKDVQRFRAQASAILSTSQTVLADNASLAVRWYDLPSSVQAQYAEADLRQPLRVILDRQHQLHPELALYQTPSPVLRVASENAELCISAENGKLDLRELLALLAQQHNVNQLWVEAGSQLAQSLIEQKLVDEIILYLAPKLMGSDGRGLFGALGLTEMAEAIELKIEDCRMVGADLRIIATPKTKD

SEQ ID NO: 42 - DNA, 1131 bp, Pasteurella multocida subsp. multocida str. Pm70
  CDS (1)..(1131): transl_table=11
atgatgacatttacggcacaagatgtagtgtacatgcaaatggcattagagttagcggagaaagggcaatttactactacaccgaacccctcagtgggttgcgtattagtgaaagacggtattattgttggacgtggctttcatgttaaagcaggcgaggcgcatgctgaagtcatggcattgcgagaggcgggagaaaatgcacgaggtgcaaccgcttatgtgacattagaaccgtgctcacattttggacgtactcccccttgtgcccaaggtttgatcgatgctggtgtagtgaaagtcgtgagtgcgatgtgcgatcccaatccgcaagtggcaggtcgaggattaagcatgttatctgatgcggggatcgaaagtgcggtcggtttattagctgaaaaggcggagtggcttaatcgtggttttcttaaacgtatgcgtactggcagaccttatgtacaactaaaaatggctatgagtttagatggaagaaccgcgatggcaaacggggaaagtaagtggattaccggtgagcttgctcgtgcagatgtgcaagcagaacgagccaaagcctcagcgattttatccaccagtgcaacggtgttagctgatgatcccttattaaatgtacgctggcaacaattacctgacaaggtgaaagccgattatacacaagcgcagctacgtcaacctgtgcgagtgattttagattctcaacatcgagttcaaccctcacaccgacttttcagtctgtcttcgccagtgtggttagtgagtcaaactgcgcgttcgttacttgagtttcctgcacattgcgaacaaatacagctttccgcttctaccaacgctttagctgatttaatggcagaattaggacaacgtcaaatcaatacgctttggattgaagccggtgcgacattggctggtgcattaattgaggcaaaattagtggatgaattgatcatttacattgcaccgaaattattaggtgatgccgcacgaggattatgtaaattacctcatttaagcaccttggctgaggcaagtttatggcaattgcattccattgagaaactcggcgatgatctgaaaacgatttaccacccacgaattacggagccaacatga

SEQ ID NO: 43 - protein, 376 aa, Pasteurella multocida subsp. multocida str. Pm70
MMTFTAQDVVYMQMALELAEKGQFTTTPNPSVGCVLVKDGIIVGRGFHVKAGEAHAEVMALREAGENARGATAYVTLEPCSHFGRTPPCAQGLIDAGVVKVVSAMCDPNPQVAGRGLSMLSDAGIESAVGLLAEKAEWLNRGFLKRMRTGRPYVQLKMAMSLDGRTAMANGESKWITGELARADVQAERAKASAILSTSATVLADDPLLNVRWQQLPDKVKADYTQAQLRQPVRVILDSQHRVQPSHRLFSLSSPVWLVSQTARSLLEFPAHCEQIQLSASTNALADLMAELGQRQINTLWIEAGATLAGALIEAKLVDELIIYIAPKLLGDAARGLCKLPHLSTLAEASLWQLHSIEKLGDDLKTIYHPRITEPT

SEQ ID NO: 44 - DNA, 1122 bp, Pseudomonas aeruginosa PAO1
  CDS (1)..(1122): transl_table=11
atgaacgccgccgacccgctgtacatggcccgcgccctggaactggcgcgccaggggctgtactccacccagccgaatccgcgcgtcggctgcgtgctggtcaaggacggccaggtggtcggcgagggctggcacgtccgcgccggcgagccgcacgccgaggtccatgccctgcgccaggccggcgagaatgcacgcggcgccaccgcctacgtgaccctcgagccctgcagccacttcggccgcaccccgccgtgcgccgatgcgctggtgggcgccggggtggcgcgggtggtcgcggcgatgcaggatcccaaccccgaggtcgccggtcgcggcctgctgcgtctgatgcaggccggcatcgcggtgcagagcggcgtcctcgaagccgaggcgcgggaactcaacatcggtttcatcaagcgcatggaacatggcctgccgttcgtccgggtcaagctggcgatgagcctggacgggcgcaccgccatggccagcggggaaagccagtggatcaccgggccctccgcgcgttcggcggtgcagcgcttgcgcgctcgctccagcgtggtgttgtccggcgccgatacgctgctggcggacgatgcgcggctcaacgtacgccccgacgaactgggcctgaacgccgagcttaccgcgctcgccgcggctcgccagccgttgcgggtgctggtcgacgggcgcctgcgggtgccgctggagtcggcgttctaccaggccggtccggcgctggtggcgacctgcgccgccgcctcggcgcgcgaacgcttccaggacgccggccacgaactgctggcgctgccctccgccgagggccacgtcgatttgcacaagctgctcctggaactggcggcgcgcggcgccaacgaagtgctggtggaggccggcccgcgtctggccggcgccttcgcccggctggggctggtggatgagtaccggctgttcgtcgcgccgaagttcctcggctccagcgcccgtcctttgctcgattggccgctggcgcggatggccgatgcggcgcagttgcggatcgacgacatccgcgcggtgggcgacgactggctggtcaccgcgcggccccatctgcgggacgcctga

SEQ ID NO: 45 - protein, 373 aa, Pseudomonas aeruginosa PAO1
MNAADPLYMARALELARQGLYSTQPNPRVGCVLVKDGQVVGEGWHVRAGEPHAEVHALRQAGENARGATAYVTLEPCSHFGRTPPCADALVGAGVARVVAAMQDPNPEVAGRGLLRLMQAGIAVQSGVLEAEARELNIGFIKRMEHGLPFVRVKLAMSLDGRTAMASGESQWITGPSARSAVQRLRARSSVVLSGADTLLADDARLNVRPDELGLNAELTALAAARQPLRVLVDGRLRVPLESAFYQAGPALVATCAAASARERFQDAGHELLALPSAEGHVDLHKLLLELAARGANEVLVEAGPRLAGAFARLGLVDEYRLFVAPKFLGSSARPLLDWPLARMADAAQLRIDDIRAVGDDWLVTARPHLRDA

SEQ ID NO: 46 - DNA, 1095 bp, Xylella fastidiosa 9a5c
  CDS (1)..(1095): transl_table=11
atgagcgcattttccgtggatgattaccgtcacatggaacgggccttgtgtttggctgagcgaggtgcttacacgacgcgtcctaacccaatggtgggttgtgtgattgtgcgtgatggtgaagtagtgggagagggttggcaccagcgtgctggcgatccgcatgctgaggtatttgcattgtgtgcggctggagaccgcgcacgaggtgcaacggcttacgtcacgttggagccgtgtgcgcacttggggcgcactccgccgtgtgcgatggcgttgattgatgccggagtgagacgggtggtggcggcgatggtcgatccatttccgttagtcaatggtgggggagtcactctgttacgtgcggctggggtgacggttgagcatggtttgatggaggcgcaggcgcgtgcactcaaccgtggctttctgtcgcgggtggagcgtggtcggccatgggtgcggatcaagcttggtagcagtttggatgggcgtaccgcgttggccagtggcgaatccaagtggattaccggggaggcggcacgtgctgatgtgcagcgttggcgcgcgcgcgctagcgcgattttgacgggggctgggacggtgcttgccgatgatccggcgttaacggtgcgcctgggtggggaggagggagcgtttttgccgccgttgcgggtggtgcttgattctaggttgcgttcacttagttgcgtgaaggtgcgtgacggtactgcaccaacgttgtatctgcatggttttggggtcacgtccccggtgttgcaacacgtcgatttttccgaggttcagcaacgtgatgctgggcttgatctggaggctgtgttacgcctgttgggtgagcgtggcatcaatgaggtacaggttgaggctggggcgacgttatgcggggcgttgctgcacgctgggttggtggatgagttactgatttatattgcaccgttgttgctgggtgatacggcacggccattactggctggattggatatcgggcgcatggatcagtgcattggtttgaaggtgctggaggtcgttcaggtcggcaacgatctgcgattgttattacgtccgtgtggttga

SEQ ID NO: 47 - protein, 364 aa, Xylella fastidiosa 9a5c
MSAFSVDDYRHMERALCLAERGAYTTRPNPMVGCVIVRDGEVVGEGWHQRAGDPHAEVFALCAAGDRARGATAYVTLEPCAHLGRTPPCAMALIDAGVRRVVAAMVDPFPLVNGGGVTLLRAAGVTVEHGLMEAQARALNRGFLSRVERGRPWVRIKLGSSLDGRTALASGESKWITGEAARADVQRWRARASAILTGAGTVLADDPALTVRLGGEEGAFLPPLRVVLDSRLRSLSCVKVRDGTAPTLYLHGFGVTSPVLQHVDFSEVQQRDAGLDLEAVLRLLGERGINEVQVEAGATLCGALLHAGLVDELLIYIAPLLLGDTARPLLAGLDIGRMDQCIGLKVLEVVQVGNDLRLLLRPCG

SEQ ID NO: 48 - DNA, 1104 bp, Salmonella typhimurium LT2
  CDS (1)..(1104): transl_table=11
atgcaggatgagttttacatggcgcgagcgctcaaactggcgcagcgtggacgtttcaccactcaccctaaccctaatgtcggctgtgtcattgttaacaatggcgacatcgtcggcgaaggttatcaccatcgcgccggagagccgcacgccgaggttcatgcgctgcggatggcgggcgcaaaagccaaaggcgcaaccgcctatgtcacgcttgaaccctgtagccatcatgggcgaacgccgccatgttgcgatgcgctgattgcggccggcgtcgcgcgcgtggtcgccgcgatgcaggacccgaacccacaggtcgccgggcgtgggctgtatcgcctgcaacaggcgggtattgcggtcagccacgggttaatgatgagtgaagcggaggcgctcaataaaggcttcctcaagcggatgcgtaccggattcccttatcttcagcttaaactgggcgcctccgtcgacggacggacggcgatggccagcggcgaaagccagtggatcacctcgccgcaggcccggcgtgacgttcagcgcttgcgtgcgcaaagccacgctatcttaaccagtagcgcgacggtattggctgacgatccggccttgacggtgcgttgggcggagttagacgcctctacgcaggcgtcttacccgcaggaaaatctgcgccagccggtgcgaattgttatcgacagccaaaaccgggtaacgcctgcgcatcgtattgtgcagcagcctggcgaaacgtggatcgcgcgtacccaggaagatagccgcgcgtggcccgatgcggttcgtactatcagcgtgccggcgcacaacggacatttggatctggttgtgctgatgatgcagttaggcaggcagcagattaatagcatatgggttgaagccggaccgggactggcgggcgcgttgctgcaagccgggctggtggatgaactgattgtctatgtcgcgcctaaattgttgggaacccaggcgcggggattatgcgaattgccggggcttgagaagctcgccgacgcgccgcaatttaccttcagcgaaatacgtcatgtcggcccggatgtttgcctgcatatggtgagcgcatga

SEQ ID NO: 49 - protein, 367 aa, Salmonella typhimurium LT2
MQDEFYMARALKLAQRGRFTTHPNPNVGCVIVNNGDIVGEGYHHRAGEPHAEVHALRMAGAKAKGATAYVTLEPCSHHGRTPPCCDALIAAGVARVVAAMQDPNPQVAGRGLYRLQQAGIAVSHGLMMSEAEALNKGFLKRMRTGFPYLQLKLGASVDGRTAMASGESQWITSPQARRDVQRLRAQSHAILTSSATVLADDPALTVRWAELDASTQASYPQENLRQPVRIVIDSQNRVTPAHRIVQQPGETWIARTQEDSRAWPDAVRTISVPAHNGHLDLVVLMMQLGRQQINSIWVEAGPGLAGALLQAGLVDELIVYVAPKLLGTQARGLCELPGLEKLADAPQFTFSEIRHVGPDVCLHMVSA

SEQ ID NO: 50 - DNA, 1110 bp, Xanthomonas axonopodis pv. citri str. 306
  CDS (1)..(1110): transl_table=11
atgagtgaggccgcaacgaccgccagtgccgacgaccatcgctggatggcgcaggcgttgcgtctggccgagcgcggcgcctacaccacccgccccaatccgatggtgggctgcgtgatcgtgcgcgatggcgtatgcgtgggcgagggctttcatcaacgtgccggcggcccgcatgccgaagtcttcgcgctgcgtgcagcgggtgagttggcgcgcggtgccaccgcgtatgtgacgctggagccatgcgcgcattacggacgcacgccgccgtgtgcgctggccttgatcgaggcaggcgtcagacgtgtggtcgcggcgatggccgacccgtttccgcaggtcaatggcggcggtttcgcgttgctgcgcgaggcagggatcgaagtgctgagcggcgtgatgcaggcgcaggcgcgcacgcttaaccggggatttctgtcgcgggtggagcgtgggcggccgtggttgcgggtcaaactcggcgccagcctggacggccgtaccgcgctggccagcggcgaatccaaatggatcaccagtgccgatgcgcgtgcagatgtgcagcgctggcgcgcacgtgcgggcgcgatcctgaccggtgcaggtacggtgatggccgacgacccatccatgacggtgcggctgggcgaggacacgccggtcgtgccgccgttgcgcgtggtgctcgatgccaggctgcggacgttggcgtgcaggaacattcgtcagggcgatgcgcccacgctgtatctgcatggcgagaatgtggccgcgcagtcgctggacgatgcgcagttccttgcgatgccgttgcatgccggccgcttcgatctggcggctgtgttggccctgctagccgagcgcggcatcaacgaagtccacgtggaaggcggcgccacgctgagcggtgcgctgctgcaggccgggctggtcgacgaactgctggtctacatggccccggtgttgctgggcgacaccgcaaagcccttgctcgctggccttggcatcgaaacgatggcgcagcgcgctgcgctgcagctgctggatgtgcgccagctgggccaggatctgcgtctgcgctatgcgccggttgttgccgggtga

SEQ ID NO: 51 - protein, 369 aa, Xanthomonas axonopodis pv. citri str. 306
MSEAATTASADDHRWMAQALRLAERGAYTTRPNPMVGCVIVRDGVCVGEGFHQRAGGPHAEVFALRAAGELARGATAYVTLEPCAHYGRTPPCALALIEAGVRRVVAAMADPFPQVNGGGFALLREAGIEVLSGVMQAQARTLNRGFLSRVERGRPWLRVKLGASLDGRTALASGESKWITSADARADVQRWRARAGAILTGAGTVMADDPSMTVRLGEDTPVVPPLRVVLDARLRTLACRNIRQGDAPTLYLHGENVAAQSLDDAQFLAMPLHAGRFDLAAVLALLAERGINEVHVEGGATLSGALLQAGLVDELLVYMAPVLLGDTAKPLLAGLGIETMAQRAALQLLDVRQLGQDLRLRYAPVVAG

SEQ ID NO: 52 - DNA, 1146 bp, Shewanella oneidensis MR-1
  CDS (1)..(1146): transl_table=11
atgaattggtcagtactcgataaccaaatgatgagccgagctattcaattggctcgcaaaggattttataccactcgccccaatcccagtgtgggctgcgttatcgttaacgataaccagattgtcggtgaaggttatcatcaaaaagccggagagccccacgctgaagtgcatgcgctgcgcatggctggcgagcttgcccgtggcgcgactgcttatgtcaccttagaaccctgcagccattatggtcgtacgccgccctgcgccttggcgctgatcaatattggtgtaaagcgggtggtggtggcggttgaagatcctaatccgcaggtcggcgggcgcggtattcaaatgctgcgcgatgcgggtattcaagtggatgtgggcttgcatcgtgatgaggcctatgccttaaatcttggttttatgaagcgcatggagtcgggtctaccttgggtgacggtaaagcttgccgcgagtcttgatggtaaaactgcgttatcaaacggggtgtctaaatggatcactggccctgaagctcgccgcgatgtgcagcgcttaagattacgatcctgcgcgctgatcacggggattgaaacggtactggccgatgatccatcgctcaatgtgcgctactcagagcttggcagtttaagagcgcaattgagtgagtcgcaggttttacagccgctgcgagtggttttggacagtcgcgcccgcatgcctatcacggcagcattgtttgcgattgaatcacccattttattagtctcgacagtgagctattcgtcagactttatggtgcaattacccgcccatgtgacttgcctccaattaccagccattgagggtcgaatctccttgtctgcactattaagctatttaggcaaaagctgtaatcaggtgcttatcgaagcgggcgcgactttagctggcgcctttatcggctcaggattagccgatgaattagtgctttatcaagcgatgaaaatccttggcggccaaggacgtaatctacttgaattacccgattatcaaatgatggccgatattccgaccctcaaattggtcgacgagcgtaaagtgggcgcggatacgcgcttcaccttgaggctcgagtccaatccatctttagcgaataagtga

SEQ ID NO: 53 - protein, 381 aa, Shewanella oneidensis MR-1
MNWSVLDNQMMSRAIQLARKGFYTTRPNPSVGCVIVNDNQIVGEGYHQKAGEPHAEVHALRMAGELARGATAYVTLEPCSHYGRTPPCALALINIGVKRVVVAVEDPNPQVGGRGIQMLRDAGIQVDVGLHRDEAYALNLGFMKRMESGLPWVTVKLAASLDGKTALSNGVSKWITGPEARRDVQRLRLRSCALITGIETVLADDPSLNVRYSELGSLRAQLSESQVLQPLRVVLDSRARMPITAALFAIESPILLVSTVSYSSDFMVQLPAHVTCLQLPAIEGRISLSALLSYLGKSCNQVLIEAGATLAGAFIGSGLADELVLYQAMKILGGQGRNLLELPDYQMMADIPTLKLVDERKVGADTRFTLRLESNPSLANK

SEQ ID NO: 54 - DNA, 1137 bp, Pseudomonas putida KT2440
  CDS (1)..(1137): transl_table=11
gtgaacatgcccagccaagccgccatccttgacgcccactacatggcccgtgcgctggagctggcgcgtaaaggcctgtacaccacccacccgaacccgcgcgtaggctgcgtgatcgtgcgtgatggcgaagtggttggcgaaggctggcacgttcgcgccggcgagccccatgccgaagtgcatgccctgcgtcaggccggtgaacttgcccgaggtgcttgtgcctatgtcaccctggaaccatgcagccaccatggccgtacgccgccgtgtgccgaagcgctggtcaaggccggtgtggcgcgtgtagtcgcagccatgcaggaccctaacccgcaagtggcgggacagggcctgcggcgcctggccgaagccggaatcgaagtggccagcggggtgctcgaagccgaggcccgcgccctcaacccaggcttcctcaagcgtatggagcacggcctgccgttcgttcgcgccaagctggccatgagcctggacggccgcaccgccatggccagtggtgaaagccagtggatcaccggcccggccgcccgctcagccgtgcagcgcttgcgcgcccgctccagcgtggtgctgaccagcgccgccagcgtgctggcagacaacgcacgcatgaccgtgcgtggtgccgagctgggcctggatgccgaaactactgccctggctcttagccgcacacccttgcgggtgctggtcgatggccgtctgcgcctgcccctggcggcgccgttcttccaggccggcccggctctggtggtgactgctgtcgcagatgacccgcgctatgccgctgccggccacgaattgctcagcttgccgggcgacaatggccaggtcgacctgggggcgctgcttcacgctctggccgcccgcggcgtcaacgaaatcctgctggaagccggtgccggcctggtcggtgccttcgcacggcaaggcctggtcgacgaataccagctgttcgtcgctggcaccttcctcggctcccaggcccggccgctactggactggccgatggacaagatgagcgaagcaccacggctgaaaattaccgaaatgcgcgcagtgggcgatgactggcgggtcacggccatccccctgccagcgcccggcgtataa

SEQ ID NO: 55 - protein, 378 aa, Pseudomonas putida KT2440
MNMPSQAAILDAHYMARALELARKGLYTTHPNPRVGCVIVRDGEVVGEGWHVRAGEPHAEVHALRQAGELARGACAYVTLEPCSHHGRTPPCAEALVKAGVARVVAAMQDPNPQVAGQGLRRLAEAGIEVASGVLEAEARALNPGFLKRMEHGLPFVRAKLAMSLDGRTAMASGESQWITGPAARSAVQRLRARSSVVLTSAASVLADNARMTVRGAELGLDAETTALALSRTPLRVLVDGRLRLPLAAPFFQAGPALVVTAVADDPRYAAAGHELLSLPGDNGQVDLGALLHALAARGVNEILLEAGAGLVGAFARQGLVDEYQLFVAGTFLGSQARPLLDWPMDKMSEAPRLKITEMRAVGDDWRVTAIPLPAPGV

SEQ ID NO: 56 - DNA, 1107 bp, Vibrio vulnificus CMCP6
  CDS (1)..(1107): transl_table=11
atgtcggaatttactgcaatcgatagacaaatgatgctgcgcgccattgctttggcgaaacgcggcctctataccaccgcacctaatcctaatgttggttgtgtcttactgcgcgacggcgaaattgtcggagaaggttttcactttcgcgctggcgagcctcatgcggaagtgcacgcgatgcgcatggctggtgacaaagccaaaggtgcgaccgcttatgtcacgctagagccttgttcacactatggtcgaacgcccccgtgtgcggaaggcttaattaaagctggggtaagccgagtggtgtgtgcaatggaagacccaaacccccaagtcgcggggagaggttttgccatgttgcgagaggcagggatcgaggtatcggtgggcctacttcaagcagaagcagaagcactgaatcctgcttttattaagcgaatgaaaatgggcatgccgtttgttcaactcaaaatggccgcgtccctcgatggtcaaacggctttagccaatggcaagagtcagtggatcacctctccacaagctcgccgagatgtgcaacgttttcgggcgcaatcaggggcgattttgtccaccagtaaaacggtgctcgctgacaatgcgtctcttaatgttcgttggtccgagttaccttcatctgtgcaacgcgctttaccgcaagagcagctgcgtcagcccactcgtgttgtgttagacagacaagccgagctttcgccggagctaaaactttaccaaaccgagggtgagcgactcattgttggtcccaaaggcgatctccctgcacctttggatgagcacggacagatcgatttgccgcaactgttcgcgcaactgagtcaaacgcagttaattaaccatctttgggttgaagcgggagcaacgctggccgctggactgataaaacaccagttggtggacgaactgattgtttaccttgccccaaaactgatgggcagcgatggacgtggattgatgggtgcgctgggtttgcaagccatgtcgcaagtgatcgatttagacattaaagatgtgcgaatggttgggccggatatccgcatcattgcacacatcaaagcaaaagaaagttga

SEQ ID NO: 57 - protein, 368 aa, Vibrio vulnificus CMCP6
MSEFTAIDRQMMLRAIALAKRGLYTTAPNPNVGCVLLRDGEIVGEGFHFRAGEPHAEVHAMRMAGDKAKGATAYVTLEPCSHYGRTPPCAEGLIKAGVSRVVCAMEDPNPQVAGRGFAMLREAGIEVSVGLLQAEAEALNPAFIKRMKMGMPFVQLKMAASLDGQTALANGKSQWITSPQARRDVQRFRAQSGAILSTSKTVLADNASLNVRWSELPSSVQRALPQEQLRQPTRVVLDRQAELSPELKLYQTEGERLIVGPKGDLPAPLDEHGQIDLPQLFAQLSQTQLINHLWVEAGATLAAGLIKHQLVDELIVYLAPKLMGSDGRGLMGALGLQAMSQVIDLDIKDVRMVGPDIRIIAHIKAKES

SEQ ID NO: 58 - DNA, 1095 bp, Xylella fastidiosa Temecula1
  CDS (1)..(1095): transl_table=11
atgagcgcattttccgcggatgatcaccgtcacatggaacgggccttgtgtttggctgagcgtggtgcttacacgacgcgtcctaacccaatggtgggttgtgtgattgtgcgtgatggtgaagtagtgggagagggttggcaccagcgtgctggcgatccgcatgctgaggtatttgcattgtgtgcggctggagaccgcgcacgaggtgcaacggcttacgtcacgttggagccgtgtgcgcactcggggcgtactccgccgtgtgcgatggcgttgattgatgccggagtgagacgggtggtggcggcgatggtcgatccatttccgttagtcaatggtgggggagtcactctgttacgtgcggctggggtgacggttgagcatggtttgatggaggcgcaggcgcgcgcactcaaccgtggctttctgtcgcgggtggagcgtggtcggccatgggtgcggatcaagcttggtagcagtttggatgggcgtaccgcgttggctagtggcgaatccaagtggattaccggggaggcggcacgtgctgatgtgcagcgttggcgcgcgcgcgctagcgcgattttgacgggggctgggacggtgcttgccgatgatccggcgttaacggtgcgcctgggtggggaggagggagcgtttttgccgccgttgcgggtggtgcttgattctagcttgcgttcacttagttgcgtgaaggtgcgtgacggtactgcaccaacgttgtatctgcatggttttggggtcacgtcccctgtgttgcaacacgtcgatttttccgaggttcagcaacgtgatgctgggcttgatctggaggctgtgttacgcctgttgggtgagcgtggcatcaatgaggtgcaggttgaggctggggcgacgttatgcggggccttgctgcacgctgggttggtggatgagttgctgatttatattgcaccgttgttgctgggtgatacggcacggccattactggctggattggatatcgggcgcatggatcagtgcattggtttgaaggtgctggaggtcgctcaggtcggcaatgatctgcgattgttattacgtccgtgtggttga

SEQ ID NO: 59 - protein, 364 aa, Xylella fastidiosa Temecula1
MSAFSADDHRHMERALCLAERGAYTTRPNPMVGCVIVRDGEVVGEGWHQRAGDPHAEVFALCAAGDRARGATAYVTLEPCAHSGRTPPCAMALIDAGVRRVVAAMVDPFPLVNGGGVTLLRAAGVTVEHGLMEAQARALNRGFLSRVERGRPWVRIKLGSSLDGRTALASGESKWITGEAARADVQRWRARASAILTGAGTVLADDPALTVRLGGEEGAFLPPLRVVLDSSLRSLSCVKVRDGTAPTLYLHGFGVTSPVLQHVDFSEVQQRDAGLDLEAVLRLLGERGINEVQVEAGATLCGALLHAGLVDELLIYIAPLLLGDTARPLLAGLDIGRMDQCIGLKVLEVAQVGNDLRLLLRPCG

SEQ ID NO: 60 - DNA, 1146 bp, Pseudomonas syringae pv. tomato str. DC3000
  CDS (1)..(1146): transl_table=11
atgagtgcagtgttgactgaacaggcagccctcgacgttcattacatggcccatgcgctggaactggcgcgcaagggcctttattcgacacaccccaacccgcgagtcggttgcgtgatcgtgcgtgacggccagattgtcggtcagggctggcatgcgcgggctggcgagccgcacgccgaagtgcacgcgctgcgcgaggccggggagcttgcccggggcgcaaccgcctacgtcacacttgaaccgtgcagccatcagggacgcaccccgccgtgcgccgatgcactgatcagcgccgggctggcgcgggtcgttgcggcaatgcaggaccccaatccgcaagtggccggcagcgggcttttgcgcctgatgactgccggtatcagcgttcagtgcggcgtactggaaggcgaggcgcgagcgctgaacaaaggttttatcaagcgcatggaaaccggacggccctatgtgcgggtcaagatggccatgagcctggatggcagaacggccatggccagcggtgaaagccagtggatcaccggccccgaggcgcgttctgcggttcagcgcctgcgcgcccaatcgagcgtggtgctgaccggtgccgatacggtgctggccgacaaggcacgcctgaccgtgcgccctgacgagctggggctcaatgccgaactcactgcgctggcggctgcgtgtccgcccctgcgcgtattgatcgacggacggctgcgcgtgccattggatacgccgttctttcaggcgggcagtgcgctggtcgtgacctgcgccgcggcgtcggcgcggggtcgttatcaggaagacggtcacgagatgctggcgctggccgacagcgccggtcatgttgacctgcgcaggttgatgggcgaactgggcgcgcggggcgtcaacgaggtgctggtcgaagccggtccgcgtctggccggtgccttcacgcgtctcgggctggtcgacgaatttcagctattcattgcaggcaagtttctcggttcgtcggcccggccgctgctcgatctgcccctggcgcagatgagtgaagcgctggagctgaacatcattgaaatgcgagccgtcggcaatgactggcgagtcattgctctccctgtcagtgcacccggcgtataa

SEQ ID NO: 61 - protein, 381 aa, Pseudomonas syringae pv. tomato str. DC3000
MSAVLTEQAALDVHYMAHALELARKGLYSTHPNPRVGCVIVRDGQIVGQGWHARAGEPHAEVHALREAGELARGATAYVTLEPCSHQGRTPPCADALISAGLARVVAAMQDPNPQVAGSGLLRLMTAGISVQCGVLEGEARALNKGFIKRMETGRPYVRVKMAMSLDGRTAMASGESQWITGPEARSAVQRLRAQSSVVLTGADTVLADKARLTVRPDELGLNAELTALAAACPPLRVLIDGRLRVPLDTPFFQAGSALVVTCAAASARGRYQEDGHEMLALADSAGHVDLRRLMGELGARGVNEVLVEAGPRLAGAFTRLGLVDEFQLFIAGKFLGSSARPLLDLPLAQMSEALELNIIEMRAVGNDWRVIALPVSAPGV

SEQ ID NO: 62 - DNA, 1125 bp, Vibrio parahaemolyticus RIMD 2210633
  CDS (1)..(1125): transl_table=11
atgcctcaacacacttctgcgtctccattttctcctcaagatttttcaatgatgtcgcgtgcgctcaagttagctcgacgcggcatttatacgacggctccaaacccgaacgtcggttgcgtaattgttcgtgatggcgtgatcattggtgaaggttatcatcatcgcgctggagagccgcatgctgaagtgtacgcgatgcgcatggctggtgataaagctgaaggtgcaacggcatacgttacccttgaaccgtgctcccactatggacgcacgccaccttgcgctgaagggttgataaaagccaaagtggcgcgagtagtgtgtgcgatggaagatccgaatccaaaagtggctggacgtggcatccaaatgctacgtgaagccggggttgaggttcaggttggattgttagaaaacgatgcgattgagctcaatcgtggcttcattaaattcatgcaaacaggcatgccatttatccaattaaaaatggcagcaagcttagatggacagagtgcgctaagtaatggcaagagccaatggatcacctccccacaggctcgccaagacgtgcagcgttatcgagcgcaaagcggtggcattctgtctacaagcaaaacagtgttggatgataacgcttctctcaacgttcgttgggatgatttgccgcagagtgttcaagcgcactatgagctgacggaagttcgccaaccagcaagggtaatactcgaccgtcaacagaaactgagtgatgaccttaaactgttcagtaccgaaggtgagcgaattattgtcagcagcgaaggcgatgtttgtccacaactagaccaaagcggaaaaattgatttaactgcgaccctaaaagcggtcgtgactcagcataatatcaaccatttatgggtggaagctggcgcgacgctcgcgagttctctaatcaaagctaaccttgtagatgagctgattgtctatctcgctccgaagctcatgggaagcgatggacgtggtttaattggcgcgctgggattgacggagatggcgcaggtcatcgatttaaatattactgatgtgcgaatggtgggcagagatatccgtattaccgccacccttgtacgtaaagaaatttag

SEQ ID NO: 63 - protein, 374 aa, Vibrio parahaemolyticus RIMD 2210633
MPQHTSASPFSPQDFSMMSRALKLARRGIYTTAPNPNVGCVIVRDGVIIGEGYHHRAGEPHAEVYAMRMAGDKAEGATAYVTLEPCSHYGRTPPCAEGLIKAKVARVVCAMEDPNPKVAGRGIQMLREAGVEVQVGLLENDAIELNRGFIKFMQTGMPFIQLKMAASLDGQSALSNGKSQWITSPQARQDVQRYRAQSGGILSTSKTVLDDNASLNVRWDDLPQSVQAHYELTEVRQPARVILDRQQKLSDDLKLFSTEGERIIVSSEGDVCPQLDQSGKIDLTATLKAVVTQHNINHLWVEAGATLASSLIKANLVDELIVYLAPKLMGSDGRGLIGALGLTEMAQVIDLNITDVRMVGRDIRITATLVRKEI

SEQ ID NO: 64 - DNA, 1104 bp, Salmonella enterica subsp. enterica serovar Typhi Ty2
  CDS (1)..(1104): transl_table=11
atgcaggatgagttttacatggcgcgagcgctcaaactggcgcagcgtggacgtttcaccactcacccgaaccctaatgtcggctgtgtcattgttaacaatggcgacatcgtcggcgaaggttatcaccatcgcgccggagagccgcacgccgaggtccatgcgctgcggatggcgggcgcaaaagccaaaggcgcaaccgcctatgtcacgcttgaaccctgtagccatcatgggcgaacgccgccatgttgcgatgcgctgattgcggctggcgtcgcgcgcgtggtcgccgcgatgcaggacccgaacccacaggtcgccgggcgcgggctgtatcgcctgcaacaggcgggtattgcggtcagccacgggttaatgatgagtgaagcggaggcgctcaataaaggcttcctcaaacggatgcgtaccggattcccttatcttcagcttaaactgggtgcctccgtggatggacggacggcgatggccagcggcgaaagccagtggatcacctcgccgcaggcccggcgcgacgttcagcgcttgcgtgcgcaaagccacgctattttaaccagtagcgcgacggtattggctgacgatccggccttgacggtgcgttgggcggagttagacgcctctacacaggcgtcttacccgcaggaaaatctgcgccagccggtgcgaattgttatcgacagccaaaaccgggtaacgcctgcgcatcgtattgtgcagcagcctggcgaaacgtggattgcgcgtacccaggaagatagccacgcgtggcccgattcggttcgtactatcagcgtgccggcgcacaacggacatttggatctggttgtgctgatgatgcagttaggcaggcagcagattaatagcatatgggttgaggccggaccgggactggcgggcgcgttgctgcaagccgggctggtggatgaactgattgtctatgtcgcgcctaaattgttgggaacccaggcgcggggattatgcgaattgccggggcttgagaagctcgccgacgcgccgcaatttaccttcagcgaaatacgtcatgtcggcccggatgtttgcctgcatatggtgagcgcatga

SEQ ID NO: 65 - protein, 367 aa, Salmonella enterica subsp. enterica serovar Typhi Ty2
MQDEFYMARALKLAQRGRFTTHPNPNVGCVIVNNGDIVGEGYHHRAGEPHAEVHALRMAGAKAKGATAYVTLEPCSHHGRTPPCCDALIAAGVARVVAAMQDPNPQVAGRGLYRLQQAGIAVSHGLMMSEAEALNKGFLKRMRTGFPYLQLKLGASVDGRTAMASGESQWITSPQARRDVQRLRAQSHAILTSSATVLADDPALTVRWAELDASTQASYPQENLRQPVRIVIDSQNRVTPAHRIVQQPGETWIARTQEDSHAWPDSVRTISVPAHNGHLDLVVLMMQLGRQQINSIWVEAGPGLAGALLQAGLVDELIVYVAPKLLGTQARGLCELPGLEKLADAPQFTFSEIRHVGPDVCLHMVSA

SEQ ID NO: 66 - DNA, 1092 bp, Nitrosomonas europaea ATCC 19718
  CDS (1)..(1092): transl_table=11
gtgttcaccgctttggattatgagtatatgtcccatgcgctgcggctggccgaaagggggctgtttaccaccagcccgaatcctcgggtagggtgcgtaatcgtcaatggcggcaaggtagttggaacagggtggcatgagcgggcaggggagccacatgcagaaattcatgcattacggaaagcaggggatttggccaagggcgctactgtttatgtaacactcgagccttgcagtcatcatggccgtacaccaccttgcgtcgaggctttgattcaggcaggggtgtgcaaagtagtcatggcgatgaatgaccctaatccgcatgtaaacggtcaaggaaaggaatggttgcagaaagccggtatcgcaatacaagcaggtttgctggctgatcaagcagagcgattgaatatcggatttgttacccgaatgcgacatgatcgtccatgggtgcggactaagatagcagccagcttcgatggcagaacggctctgaagaatggaaagagccagtggattaccagtgagccggctcggcgggatggccataaatggcgagcacgttcatgtgcgatactgacagggatcagctcggtcaggaaggatgaccctcaactgacggtgcggtatattacggtctccaggcagccaatgcgcatagtggtggattcgaacctggaaactcccttgcaggcaaagttgctgcagaatgcagatacaacttggatcttcacggcacagaccagcaaagaaaaaatacaccgactggaagataccggtgctcacatcgttgttttgcctgatttggccggaaaggttgatctcaaagccatgatggtgaagttggccgaattaggtatcaatgagctgctggttgaagcaggcccggtactgaacggagcgctggtaacagctgggctggtggatgaaatcattttttattttgcccccagcctgttgggtaattcagcacaagcgatgctggcattgcctgaaatcggggatttatcagagaagtatgatttgcaaatatccgatattcgaaaaatcgggatggatgtccgtctgatagcaaggtttatgaaatga

SEQ ID NO: 67 - protein, 363 aa, Nitrosomonas europaea ATCC 19718
MFTALDYEYMSHALRLAERGLFTTSPNPRVGCVIVNGGKVVGTGWHERAGEPHAEIHALRKAGDLAKGATVYVTLEPCSHHGRTPPCVEALIQAGVCKVVMAMNDPNPHVNGQGKEWLQKAGIAIQAGLLADQAERLNIGFVTRMRHDRPWVRTKIAASFDGRTALKNGKSQWITSEPARRDGHKWRARSCAILTGISSVRKDDPQLTVRYITVSRQPMRIVVDSNLETPLQAKLLQNADTTWIFTAQTSKEKIHRLEDTGAHIVVLPDLAGKVDLKAMMVKLAELGINELLVEAGPVLNGALVTAGLVDEIIFYFAPSLLGNSAQAMLALPEIGDLSEKYDLQISDIRKIGMDVRLIARFMK

SEQ ID NO: 68 - DNA, 1137 bp, Candidatus Blochmannia floridanus
  CDS (1)..(1137): transl_table=11
atgataaaagataagctttgtgataatgatttgatatatttatctagagcatttcgattagctcgtaagggtcgttttacgaccatgcctaatcctaatgtagggtgtgttattgtaaaagaaaataaagtgataggagaaggttatcatatacgggctggggaggatcatgctgaaatacatgcattacgtattgctggagattctgcacggggagctactgtttacgtcacattggaaccatgtagtcattatggtcgtactccaccttgtactactgctttgataaattcaggaattaaatgcgttgtgatttctatgctagatcctgaccctgaaataaagggtcgtggggtacggttattacaagaatcaggaattttagtaaggcatagcctgatgttatctgaagctgaacatataaataagggatttattaaacgtatacgtactggtatgccatggattaaagtaaaattagctgcgtctttggatggacgaaccgctatgaaaaccggtgagagtaaatggattacttctgtgcaatcacgtcaagatgtacaatgttttagagcagaaagtgatgtaattttgtctactgctacaactatattgatagataaccctcatttaaatgttcgatggtcattttttccaaaaaatatacaattaaagtattgtagagaacatattagacaaccgttgagagtaattatagatagtgctaatcgtgttttacctactcatcgttttatacaaaattcaggaaaagttattttagtgagattaaaaaaagataatttgaattggcctgaatcagtagaacagttgttagctccagaaataaatttagttggtagttatcaaattaatttagaagcgttgatgaaatatttggggtatgttcgaaaaattaataatgtttgggtagaggcaggtccaacgctatcaggatctttattagatattggtttggtagatgaattgattttatatcagtccataaaatttttgggatcgaatgctaaacctttatgttttttgcctaatattgataatttaaaagatgttaagacttttaaattacttaatattaaaaatattgggcctgatatacgtttaacgttaaaaccataa

SEQ ID NO: 69 - protein, 378 aa, Candidatus Blochmannia floridanus
MIKDKLCDNDLIYLSRAFRLARKGRFTTMPNPNVGCVIVKENKVIGEGYHIRAGEDHAEIHALRIAGDSARGATVYVTLEPCSHYGRTPPCTTALINSGIKCVVISMLDPDPEIKGRGVRLLQESGILVRHSLMLSEAEHINKGFIKRIRTGMPWIKVKLAASLDGRTAMKTGESKWITSVQSRQDVQCFRAESDVILSTATTILIDNPHLNVRWSFFPKNIQLKYCREHIRQPLRVIIDSANRVLPTHRFIQNSGKVILVRLKKDNLNWPESVEQLLAPEINLVGSYQINLEALMKYLGYVRKINNVWVEAGPTLSGSLLDIGLVDELILYQSIKFLGSNAKPLCFLPNIDNLKDVKTFKLLNIKNIGPDIRLTLKP

SEQ ID NO: 70 - DNA, 1110 bp, Photorhabdus luminescens subsp. laumondii TTO1
  CDS (1)..(1110): transl_table=11
gtgaataacgataaaaaatatatggcgcgcgctttggaattggcgcgtcaagggcgctttaccacgtcacctaatcctaacgttggttgtgtgattgtgcatgatggacaaattgttggggaaggttttcatttacgttctggtgagccgcatgctgaggtttacgcgttacagatagccggagataaagctaaaggcgcaactgtttatgtcacgcttgagccatgcagccatcacggtaagaccccgccttgtgccgatgcgttgattgcggctggcgttagccgtgtggttgcggcgatgcaggatcccaatccacaggtagcaggaagagggctttataagctgcaacaggctggtattgcagtagaacatggactgatgatggaagaagctgaatctctcaaccgggggtttttgaagcggatgcgtaccgggtttccatatattcagttgaagatggcgacttctctcgacggccgaacggcattagcttctggtgaaagtaaatggattacatcaccacaagctcgctgtgatgtgcaaaaattccgtgctcaatgtagcgcgattctgagttccagtagcactgttttagctgatgatcctcacttgacagttcgttggagtgaattggacgcagaaattcaggcggtttatcccgaggaaaatctttgtcaaccggtacgtgttattgttgacagtcagaatcgtgttagcccccagcatcaggtcatacagcagcccggttattgttggctggctcgcactaaagtagatgaacatgacttatctgaaaatgtagaacagatactgttacctgctcatggtattggggtagatttggtgtcattgatgatgcagctgggtaagcgccagatcaacacagtctggactgagtgtggggcattgctggcaggcgcattgctaactttagggttggtggatgaattggttctttatgttgcgccaaaagtgctaggtgatacggctcgtggtttgttcactattcctgaactcaaaaatctggcagaggcaccggaatttgacattttcgatgtacagcaagttgggcctgatcttcgtctgcatctgcggcctgtatactga

SEQ ID NO: 71 - protein, 369 aa, Photorhabdus luminescens subsp. laumondii TTO1
MNNDKKYMARALELARQGRFTTSPNPNVGCVIVHDGQIVGEGFHLRSGEPHAEVYALQIAGDKAKGATVYVTLEPCSHHGKTPPCADALIAAGVSRVVAAMQDPNPQVAGRGLYKLQQAGIAVEHGLMMEEAESLNRGFLKRMRTGFPYIQLKMATSLDGRTALASGESKWITSPQARCDVQKFRAQCSAILSSSSTVLADDPHLTVRWSELDAEIQAVYPEENLCQPVRVIVDSQNRVSPQHQVIQQPGYCWLARTKVDEHDLSENVEQILLPAHGIGVDLVSLMMQLGKRQINTVWTECGALLAGALLTLGLVDELVLYVAPKVLGDTARGLFTIPELKNLAEAPEFDIFDVQQVGPDLRLHLRPVY

SEQ ID NO: 72 - DNA, 1107 bp, Vibrio vulnificus YJ016
  CDS (1)..(1107): transl_table=11
atgtcggaatttactgcaatcgatagacaaatgatgctgcgcgccattgctttggcgaaacgcggcctctataccaccgcacctaatcctaatgttggttgtgtattactgcgcgacggcgaaattgtcggagaaggttttcactttcgcgctggcgagcctcatgcggaagtgcacgcgatgcgcatggctgctgacaaagccaaaggtgcgaccgcttatgtcacgctagagccttgttcacactatggtcgaacgcccccgtgtgcggaaggcttaattaaagctggggtaagccgagtggtgtgtgcaatggaagacccaaacccccaagtcgcggggagaggttttgccatgttgcgagaggcagggatcgaggtatcggtgggcctacttcaagcagaagcagaagcactgaatcctgcttttattaagcgaatgaaaacgggcatgccgtttgttcaactcaaaatggccgcgtccctcgatggtcaaacggctttagccaatggcaagagtcagtggatcacctcaccacaagctcgccgagatgtgcaacgttttcgggcgcaatcaggggcgattttgtccaccagtaaaacggtgctcgctgacaatgcgtctcttaatgttcgttggtccgagttaccttcatctgtgcaacgcgctttaccgcaagaacagctgcgtcagcccactcgtgttgtgttagacagacaagccgagctttcgccggagctaaaactttaccaaaccgagggtgagcgactcattgttggtcctaaaggcgatctccctgcacctttggatgagcacggacagatcaatttgccccaactgttcacgcaactgagtcaaacacagtcaatcaaccatctttgggttgaagcgggagcaacgctggccgcaggactgataaaacaccagttggtggacgaactgattgtttacctcgcccccaaactgatgggcagtgatggacgtggattgatgggtgcgctcggtttgcaagccatgtcacacgtgatcgatttagacattaaagatgtgcgaatggttgggccggatatccgcatcattgcgcacatcaaagcaaaagaaagttga

SEQ ID NO: 73 - protein, 368 aa, Vibrio vulnificus YJ016
MSEFTAIDRQMMLRAIALAKRGLYTTAPNPNVGCVLLRDGEIVGEGFHFRAGEPHAEVHAMRMAADKAKGATAYVTLEPCSHYGRTPPCAEGLIKAGVSRVVCAMEDPNPQVAGRGFAMLREAGIEVSVGLLQAEAEALNPAFIKRMKTGMPFVQLKMAASLDGQTALANGKSQWITSPQARRDVQRFRAQSGAILSTSKTVLADNASLNVRWSELPSSVQRALPQEQLRQPTRVVLDRQAELSPELKLYQTEGERLIVGPKGDLPAPLDEHGQINLPQLFTQLSQTQSINHLWVEAGATLAAGLIKHQLVDELIVYLAPKLMGSDGRGLMGALGLQAMSHVIDLDIKDVRMVGPDIRIIAHIKAKES

SEQ ID NO: 74 - DNA, 1110 bp, Erwinia carotovora subsp. atroseptica SCRI1043
  CDS (1)..(1110): transl_table=11
ttgccgcaggatgaattatatatggcgcgtgcgttagagctggcgcgccgtggccgttttacgacggcacccaaccccaatgtcggctgcgtgatcgtgcgtgatggcgaaattgtcggtgagggctaccatttccgagctggtgaacctcacgcagaggtacatgcgctgagaatggctggggaacgcgctcgtggcgcgactgcctatgtcacgctggagccttgcagccaccatggccgaacgccgccttgcgccgatgcgctgattactgctggcgtttctcgtgtggttgcggcgatgcaggatccaaatccgcaggttgctggtcgtggtttacatcgcttacagcaagccgggattaccgttagccatggcttgatgatggccgaagctgagaaagtcaatgtaggcttcctgaaacgcatgcggacgggttttccttacgtgcaactcaaaatggcggcgtctttggatggtcgtactgcgatggcatcgggagaaagccagtggattacttcaccgcaggcgcggcaggatgtgcagcgttttcgcgctgagagcgcggcgattctgagcagcagtacgacggtattggccgatgacccttctctcactgtacggtggtcagaactggatgctgatgtccagaaacactattcagaagcggatctcaggcaaccagtccgagtgattgtggatagccagcagcgcgtaacaccgcagcatcggattattagccaaccgggtgagacctggctggcgcgcgtgcaggccgatgagcaagcatggccacagaacgttgagcacctcatgctaccgcagcacaatggtggtgttgatttggtggcgctgatgatggtgctggggagacgccagattaactccgtctgggttgaagcgggtgccagtctggcgggagcattgctcaatgcttgtgtggttgatgagcttatcgtttatcttgcccccaaactattgggtgaaaatgcccgttcgctgtgcctcttgccagggctgactcagctgtcccaggcgccggaatttgacatcgtagaggttcgccaggttggccccgatttgcgattacgcctgaaacccaaattctga

SEQ ID NO: 75 - protein, 369 aa, Erwinia carotovora subsp. atroseptica SCRI1043
MPQDELYMARALELARRGRFTTAPNPNVGCVIVRDGEIVGEGYHFRAGEPHAEVHALRMAGERARGATAYVTLEPCSHHGRTPPCADALITAGVSRVVAAMQDPNPQVAGRGLHRLQQAGITVSHGLMMAEAEKVNVGFLKRMRTGFPYVQLKMAASLDGRTAMASGESQWITSPQARQDVQRFRAESAAILSSSTTVLADDPSLTVRWSELDADVQKHYSEADLRQPVRVIVDSQQRVTPQHRIISQPGETWLARVQADEQAWPQNVEHLMLPQHNGGVDLVALMMVLGRRQINSVWVEAGASLAGALLNACVVDELIVYLAPKLLGENARSLCLLPGLTQLSQAPEFDIVEVRQVGPDLRLRLKPKF

SEQ ID NO: 76 - DNA, 1110 bp, Yersinia pseudotuberculosis IP 32953
  CDS (1)..(1110): transl_table=11
atgcagcccgatgagttctatatggcccgagcttttgaactggcgcgtttggggcgctttacgacgtcgcctaaccccaatgtaggctgtgtcttggttcgtgatggcgagatcgtcggcgaaggttaccacttacgtgctggagagccgcatgctgaagtgcatgcgttacgtatggcgggtgagaaagcgcgaggagccacggcttatgtcactctcgagccgtgtagccattatggtcggacgccaccttgtgctgatgcgttggtcgccgcaggtgtgatacgggttgttgctgccatgcaggatcctaatccagaagttgccgggcgagggctgtataaattaaaacaggccggtatcgctgtcgatcatggcttgatgttagctgaggccgaggctgttaaccttggtttcttgaagcgtatgcggactggtttcccttatgtgcaattgaaaatggcggcatcattggacgggcgtacagccatggcatcaggtgagagccagtggattacctcaccacaggcacgccaggatgtgcaacgctttagggccgagagttcagctattctcagtaccagtgccacagtattggcagatgacccttcgctgacggtacgctggcaggatttagatgccgaaacgcaggttttgtatcctcatgatagtgttcgacagccagtaaaaattatactcgatagccataaccgcgtgactccacggcataaagtgatacagcaagacggcccatgctggctggctcgcgtagatgccgatgatcagccatggcctggcaatatcgaacaactgttgctaccacgttatggtaatggcgtggacttggttgtgttgatgatgcaattggggaaacggaatattaactctgtctgggtagaggctgggccacaactggcgggtgcattgttacaagccggagtggtggatgagttaatcctttatatcgcccccaaactcttgggcagtgatgcgcgtggattatgcgagctagctgggctgacgaatttatcgcaagcgcctgagtttgcatttagcgatgtacggctggtcggtccggacttgcgtttacgcttgaagccaaagtattaa

SEQ ID NO: 77 - protein, 369 aa, Yersinia pseudotuberculosis IP 32953
MQPDEFYMARAFELARLGRFTTSPNPNVGCVLVRDGEIVGEGYHLRAGEPHAEVHALRMAGEKARGATAYVTLEPCSHYGRTPPCADALVAAGVIRVVAAMQDPNPEVAGRGLYKLKQAGIAVDHGLMLAEAEAVNLGFLKRMRTGFPYVQLKMAASLDGRTAMASGESQWITSPQARQDVQRFRAESSAILSTSATVLADDPSLTVRWQDLDAETQVLYPHDSVRQPVKIILDSHNRVTPRHKVIQQDGPCWLARVDADDQPWPGNIEQLLLPRYGNGVDLVVLMMQLGKRNINSVWVEAGPQLAGALLQAGVVDELILYIAPKLLGSDARGLCELAGLTNLSQAPEFAFSDVRLVGPDLRLRLKPKY

SEQ ID NO: 78 - DNA, 1122 bp, Mannheimia succiniciproducens MBEL55E
  CDS (1)..(1122): transl_table=11
atgagcgaatttaccgaacaagatcgcgcatttatgcaactagccattgaattagctgaaaaggggcaatttactactacccctaatccgtccgtcggttgtgttttagtgaaacagggtgaaatcgtcggcaaaggttttcattttaaagcgggcgaacctcatgcggaggttatggctatgcgcgaggcggggaaaaacgcaaaaggcgccaccgcttatgtaactcttgagccttgttcccatttcgggcgtacgccgccgtgtgcgaaagggttaattgaagccggcgtggttaaagtgattgcggcaatggaagatccgaatccttctgttgccggtcaagggctgaaaatgttacaacaggcggggattgaaactgcggtagggttattacaagaacaagcggagcggttaaatcgcggttttttaaaacgtatgcgaaccgggctcccctatgtgcaattgaaaatggcaatgacaattgacggcagaaccgccacatcgactggtgaaagccagtggattaccggtgaatcggcacgcattgacgtgcaacaggagcgagcaaaggcttccgctattttatcggctagcggtacggtgctggctgataacccaagtttaaatgtgcgctgggagcaatttcccgaacagttaaaagcagattataaaaaagaaacggtgcgccagccggtacgtgtgattattgattctaaacagcaaatttcatctcagcttaatctgtttaagatagattcgcctgtttggttggcgggtatacaaccgcgggatcttacggattttcctgcgaattgcgaaattatctgtttaatgcctgaaaaggaacaaagcttactgcaagccttgatgatagaattaggcaaacgccaaattaattccgtttgggtagaagcgggtgctaaattggcgggggcattaatcgagcagaatttagtggatgaattggtgttatatatagcgcctaaattattgggtgacgaagcaaaaggcctatgtcatttgccgcatttaactaaattagcggatgcgcctttatggcggctccaatccatggaaaaagtaggtgatgatattaaaatgatttacatgaggaagtaa

SEQ ID NO: 79 - protein, 373 aa, Mannheimia succiniciproducens MBEL55E
MSEFTEQDRAFMQLAIELAEKGQFTTTPNPSVGCVLVKQGEIVGKGFHFKAGEPHAEVMAMREAGKNAKGATAYVTLEPCSHFGRTPPCAKGLIEAGVVKVIAAMEDPNPSVAGQGLKMLQQAGIETAVGLLQEQAERLNRGFLKRMRTGLPYVQLKMAMTIDGRTATSTGESQWITGESARIDVQQERAKASAILSASGTVLADNPSLNVRWEQFPEQLKADYKKETVRQPVRVIIDSKQQISSQLNLFKIDSPVWLAGIQPRDLTDFPANCEIICLMPEKEQSLLQALMIELGKRQINSVWVEAGAKLAGALIEQNLVDELVLYIAPKLLGDEAKGLCHLPHLTKLADAPLWRLQSMEKVGDDIKMIYMRK

SEQ ID NO: 80 - DNA, 1137 bp, Methylococcus capsulatus str. Bath
  CDS (1)..(1137): transl_table=11
gtgtcttcatcgatattccctttgtctgatggcgccagctggtctcccgaggatcactgcttcatggcgcatgccttgcgtctggccgaaaagggtatgtatacgaccgaccccaacccccgggtgggttccgtcgtggtgcaaggaaacgaagtggtcggcgcgggctggcaccagcgggccggcggcccccatgccgagatcgcggcgctgcgggatgcccgggggcgggcggcaggggccacggtctatgtgacgctggagccttgttcgcatcatggccgcacaccgccctgcgccgatgccctgatcgaggcgggggtgcatcgggtggtggcagccatgcaggatcccaatccacgggtggccgggcaaggtctcgaacggttgcggcgggcgggcatcgaagtgtcctgcggtttgctggcgcgggaggcggagcgcttgaatcagggcttcgtcaagcggatgcgtttgggtttgccgtttgtccggagcaagctggccatgagcctcgacgggcgtaccgccctggcgtccggtgacagcaaatggatcaccggagatgcggctcggcgcgacgtccatcgcctgagggcgcgcagctcggttatcgtgacagggatcggcaccttgcgagccgacgatccttttctcaccgcccggccgaatgatgcgaccgagctggagcagccggcacgggtgattctggacagccgtctgcggtcaccgccgaacgcacgggttttccagcagcccggacgtacgctggtgctgaccacggcgagcgatccccgggcgcggcaagcactgctcgatgtcggcgccgaagtgctggaggtcgagcccgatggcgcgggaaggccggacgtggcagccgtcgtgcggctgctgggacggctggagttcaacgaggtgcttttcgaagccggtgctagcctgaacggagcgctgctgtcggccggcgtggtcgatgagtgggtcgtctatctcgctccttgtgtcttgggagacgaagcgcgtgggctgttccgtctgcccggtctggccgggatggcggaccgtccggaactggcgatcgtggatgcgcggcgggtcggcagtgacatgcggctgatcctgcggtcgagcggctga

SEQ ID NO: 81 - protein, 378 aa, Methylococcus capsulatus str. Bath
MSSSIFPLSDGASWSPEDHCFMAHALRLAEKGMYTTDPNPRVGSVVVQGNEVVGAGWHQRAGGPHAEIAALRDARGRAAGATVYVTLEPCSHHGRTPPCADALIEAGVHRVVAAMQDPNPRVAGQGLERLRRAGIEVSCGLLAREAERLNQGFVKRMRLGLPFVRSKLAMSLDGRTALASGDSKWITGDAARRDVHRLRARSSVIVTGIGTLRADDPFLTARPNDATELEQPARVILDSRLRSPPNARVFQQPGRTLVLTTASDPRARQALLDVGAEVLEVEPDGAGRPDVAAVVRLLGRLEFNEVLFEAGASLNGALLSAGVVDEWVVYLAPCVLGDEARGLFRLPGLAGMADRPELAIVDARRVGSDMRLILRSSG

SEQ ID NO: 82 - DNA, 1101 bp, Pseudomonas syringae pv. syringae B728a
  CDS (1)..(1101): transl_table=11
atggcgcgagcactcgagctggcgcgcaaggggctgtactccacgcatcccaacccgcgagtcggctgcgtgatcgtgcgtgaaggccggatcgttggcgaaggctggcatgcgcgcgccggtgaaccgcatgccgaagtgcatgccttgcgccaggccggcgagctggccagaggcgcgaccgcctacgtcaccctcgagccgtgcagtcaccaggggcgcacaccgccctgtgccgatgcactgatcgaagccgggctgacgcgggttgtcgcagcgatgcaggaccccaaccccgaagtttccggtcgcggcctgttgcgcctcatgaatgccggcatcggcgttcagtgtggtgtgctggaaagcgaagcgcgagcgctgaacaaaggctttctcaagcgcatggagaccggcctgccgtatgtgcgggtcaaaatggccatgagcctggatggccgaacggcgatggccagcggggaaagccagtggatcaccggccccgaggcgcgctctgccgtacagcgcctgcgcgcccagtcgagcgtggtgctcagcggtgccgacacggtgctggccgacaaggctcgtctcaccgtacgccctgatgaactggggctcgatgccgaattgaccgcgctggccgcggcacgcgcgccgttgcgcgtgttgatcgacggccgtttgcgtgtgccgctcgatgcaccgttcttccaggcaggcagtgcgctggtcgtgacctgcgctgctgcgtcggcgcgaggccgctatcaggaggagggccacgaaatgctcgcgctggccgacagcgccggtcatgtggacctgcgcaggttgatggacgaactcgcagcgcggggcgtcaatgaagtgctggtcgaggccggtccgcgactggcgggggcttttgcgcggctcgggctggtcgacgagtttcagctcttcattgccggcaagtttctcggctcatcggcccgtccgctgctcgatctgccactggcgcagatgagcgaggcactggaactgaacattgtggaaatgcgtgctgtcggtaatgactggcgagtcatcgctctccctgtgcgcacacccggcgtataa

SEQ ID NO: 83 - protein, 366 aa, Pseudomonas syringae pv. syringae B728a
MARALELARKGLYSTHPNPRVGCVIVREGRIVGEGWHARAGEPHAEVHALRQAGELARGATAYVTLEPCSHQGRTPPCADALIEAGLTRVVAAMQDPNPEVSGRGLLRLMNAGIGVQCGVLESEARALNKGFLKRMETGLPYVRVKMAMSLDGRTAMASGESQWITGPEARSAVQRLRAQSSVVLSGADTVLADKARLTVRPDELGLDAELTALAAARAPLRVLIDGRLRVPLDAPFFQAGSALVVTCAAASARGRYQEEGHEMLALADSAGHVDLRRLMDELAARGVNEVLVEAGPRLAGAFARLGLVDEFQLFIAGKFLGSSARPLLDLPLAQMSEALELNIVEMRAVGNDWRVIALPVRTPGV

SEQ ID NO: 84 - DNA, 1119 bp, Haemophilus influenzae 86-028NP
  CDS (1)..(1119): transl_table=11
atgcttgaattctcctcacaagattgcgtatttatgcaacgtgccttagatttagccgccaaaggtcaatataccactacaccgaacccatcggtgggatgcgtattggttaaaaatggtgaaattgtgggggagggctttcattttaaggcaggacaacctcatgctgaacgcgttgctttagctcaagctggtgaaaatgctaaaggagcaaccgcttacgtcaccttagagccttgttctcactatgggagaacaccaccttgtgcattaggattaattgaggcgggcgtagtgaaagtcattgcggctatgcaagatccgaatcctcaagtcgcaggaaaaggtttgaaaatgttgtctgatgctggtatcgaaagtgcagtgaatctattaaacgatcaagcggaaaaaataaataaaggctttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttctgcgacagtacttgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagagctgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaa

SEQ ID NO: 85 - protein, 372 aa, Haemophilus influenzae 86-028NP
MLEFSSQDCVFMQRALDLAAKGQYTTTPNPSVGCVLVKNGEIVGEGFHFKAGQPHAERVALAQAGENAKGATAYVTLEPCSHYGRTPPCALGLIEAGVVKVIAAMQDPNPQVAGKGLKMLSDAGIESAVNLLNDQAEKINKGFLKRMRQGMPFVQLKLAMSLDGRTAMASGESKWITGPDARSDVQKMRAKSSALLSTSATVLADDPSLNVRWDEFPENLKTEYKKEWLRQPVRVILDSQHRIQPTHKLFLTHSPVWLVSSETRDLTGFPDFCEQIILPKENLLKELMRELGKRQINTLWVEAGANLAGSLIDAKLVDELIIYIAPKLLGDNARGLCQLPNLTKLADAPLWQLNELEQIGDDIKLTYTPKGV

SEQ ID NO: 86 - DNA, 1134 bp, Pseudomonas fluorescens Pf-5
  CDS (1)..(1134): transl_table=11
atgaaccagcctgccgagcaagcggtcctcgacgcccactacatggcccgtgctctggaactggcgcgcaagggccgctactccacccatcccaacccgcgtgtcggctgcgtcatcgtgcgcgacggccaggtggtgggcgagggctggcacgtgcgggccggcgagccccatgccgaggtgcatgccctgcgcgcggccggtgaactggcccgtggcgccaccgcctatgtgaccctcgaaccctgcagccatcacgggcgtacgccgccctgcgccgacgccctggtgaatgccggtgtggcacgggtggtcgcggccatgcaggaccccaacccggaagtggccggccgtggcttgcagcgcctggcccaggccggcatcgacacccatggcggtgtgctggaaggcgaggcgcgggcgatcaataaaggctttctgaaacgcatggagcacggcttgccttatgtgcgggtcaagctggccatgagcctggatggccgcaccgccatggccagtggcgagagccagtggatcactggccctgcggcgcgctctgcagtgcagcgcctgcgggccgagtccagcgtggtactgaccggcgccgacacggtgctggcggacgacgcgcggctgaccgtgcgcgccgccgaactgggcctggatgccgagcagaccgccctggccatgagccggccgccgctgcgggtgctgatcgacggccgcctgcgggtgcctctggatgcgccattcttcaaggcaggcccagcgttggttgccacttgtgcggcggtggaagagcaatacgccaacggcccggaatgcctgattgttcccggccccgatggccaggtggatctgcgtcgcctgctgttggagctggcggcccgtggggtcaacgaagtgctggtggaagccggcccacgcctggccggggcctttgcccagcagggcctggtggacgagtaccagatattcgtcgccggcaagttcctcggctcctctgcgcggccgttgctggactggccgctggcgcagatgagccaggcgccattgctgaagatcatagaaatgcgtgcggtgggcgatgactggcgagtcactgccatcccggccccgccagcgagcgtataa

SEQ ID NO: 87 - protein, 377 aa, Pseudomonas fluorescens Pf-5
MNQPAEQAVLDAHYMARALELARKGRYSTHPNPRVGCVIVRDGQVVGEGWHVRAGEPHAEVHALRAAGELARGATAYVTLEPCSHHGRTPPCADALVNAGVARVVAAMQDPNPEVAGRGLQRLAQAGIDTHGGVLEGEARAINKGFLKRMEHGLPYVRVKLAMSLDGRTAMASGESQWITGPAARSAVQRLRAESSVVLTGADTVLADDARLTVRAAELGLDAEQTALAMSRPPLRVLIDGRLRVPLDAPFFKAGPALVATCAAVEEQYANGPECLIVPGPDGQVDLRRLLLELAARGVNEVLVEAGPRLAGAFAQQGLVDEYQIFVAGKFLGSSARPLLDWPLAQMSQAPLLKIIEMRAVGDDWRVTAIPAPPASV

SEQ ID NO: 88 - DNA, 1170 bp, Colwellia psychrerythraea 34H
  CDS (1)..(1170): transl_table=11
atgtctagggctatagatttagctaaaaaaggacatttcactacttctcccaaccctagagttggttgtgtgttagtgagctataaagaaggtgttggtaaggtcattggtgaaggttatcatcaaaaagctgggcagggtcatgcagaagttaatgcgttagctgaggcaaaagtgaacaatcccgctttaatcaagggggctacagcctatgttacccttgagccttgcagccattttggccgtacgccgccatgtgccaaagcattagttgatgctggtgttagtcatgttattgccgctatggttgatcccaatccacaagtttctggtaatggtttatctctattagaaaaagcgggcatcacggtacaatcgggtttgttagaacaaagcgcaaggctactcaacgtcgggtttattcataagatggtcaataatcttccatatgtacgctgtaaattagcagcgagtcttgatggaaaaacagccatggccagtggcgaaagtaaatggattacgtcagcagatgctcgacaagatgttcaacgtctacgcgcccagagttgcgcgattatcacaggtgcagattcagtactttttgataatgctaagatgacagtacgttggtctgagctaggtgagttaaaaagtaactacccaaaagaagcccttcgtcagcctttacgtattgtaattgatagtcaaaatagactgacgccaaaccttgcattattcgaacatcagtcaccaattttaattattaatggcatagatccggactacgttgaaaataaaattgaatcacatcttgaaaacttaccaaaatggccgcatttcgtagaacaggtgcaattacctgtgactgaaaactcgcagggtaaattgaaaataaatttaaaggctttgttagaatacctagcaaagcgagggctcaatgatattttaattgagtcaggcgcacggttaagtggtgcctttattgaacaaaatttagtgaatgaacttattctgtatcaagcgcccaaattaatgggtggcgatggtaaaaacttaatggaaatgccctcagtatcaaagctgaaccaagccaaggcattaactattagtgatattcgtatggttggtgtggatattcgcatcactagccaacttactaatactgaataa

SEQ ID NO: 89 - protein, 389 aa, Colwellia psychrerythraea 34H
MSRAIDLAKKGHFTTSPNPRVGCVLVSYKEGVGKVIGEGYHQKAGQGHAEVNALAEAKVNNPALIKGATAYVTLEPCSHFGRTPPCAKALVDAGVSHVIAAMVDPNPQVSGNGLSLLEKAGITVQSGLLEQSARLLNVGFIHKMVNNLPYVRCKLAASLDGKTAMASGESKWITSADARQDVQRLRAQSCAIITGADSVLFDNAKMTVRWSELGELKSNYPKEALRQPLRIVIDSQNRLTPNLALFEHQSPILIINGIDPDYVENKIESHLENLPKWPHFVEQVQLPVTENSQGKLKINLKALLEYLAKRGLNDILIESGARLSGAFIEQNLVNELILYQAPKLMGGDGKNLMEMPSVSKLNQAKALTISDIRMVGVDIRITSQLTNTE

SEQ ID NO: 90 - DNA, 1137 bp, Pseudomonas syringae pv. phaseolicola 1448A
  CDS (1)..(1137): transl_table=11
ttgctgactgaactggcggctctcgacgttcattacatggcgcgtgcgctggagctggcgcgtaacgggctctactccacgcaccccaacccgcgcgtcggctgcgttattgtgcgtgacggccagatcgtcggtgagggctggcatgtacgggctggcgagccgcatgccgaagtgcatgccctgcgccaggccggcgaacttgccagaggcgcgaccgcctacgtcacccttgaaccgtgcagccatcaggggcgcacgccgccctgtgccgatgcgctggtcaacgccgggctggcgcgggtcgtcgcggccatgcaggaccccaaccctgaagtgtccggtcgtggcctgttgcgcctgatgaatgccggtatcggcgttcagtgcggcgtgctggaaagcgaagcgcgagcgctgaacaaaggctttctcaagcgcatggaaaccggacagccctacatacgcgtgaagatggccatgagcctggatggccgaaccgctatggccagcggcgaaagccagtggatcaccggtcccgaggcgcgttccgccgttcagcgtctgcgcgcgcagtcgagcgtagtgctgaccggagccgatacggtgctggccgacaaggcccgcctcaccgtgcgccccgatgagttgggtctcaatgcagaattgaccgcgctggccgctgcgcgtccgcccctgcgggtattgattgacggtcgtctgcgcgtaccgctggacgcgccgttctttcaggcgggcagtgcgctggtcgtgacctgtgctgcggcgtcggcgcgaggtcgctatcaggaagaaggccacgaaatgctggcactggctgacagcgccggtcatgtggacctgcgcaagttgatgggcgaactggccacgcgtggtgtcaatgaagtgctggtcgaagccggtccgcggctggcgggtgcctttgcgcgtctcgggctggtcgacgagtttcagatattcattgccggcaagtttctcggctcatcggcccggccgttgctcgacctgccgctggcgcagatgagcgaagcgctggagctgaacatcgtgcaaatgcgtgccgtcggtaatgactggcgagtcatcgctctccctgtgcgcgcacccggcgtataa

SEQ ID NO: 91 - protein, 378 aa, Pseudomonas syringae pv. phaseolicola 1448A
MLTELAALDVHYMARALELARNGLYSTHPNPRVGCVIVRDGQIVGEGWHVRAGEPHAEVHALRQAGELARGATAYVTLEPCSHQGRTPPCADALVNAGLARVVAAMQDPNPEVSGRGLLRLMNAGIGVQCGVLESEARALNKGFLKRMETGQPYIRVKMAMSLDGRTAMASGESQWITGPEARSAVQRLRAQSSVVLTGADTVLADKARLTVRPDELGLNAELTALAAARPPLRVLIDGRLRVPLDAPFFQAGSALVVTCAAASARGRYQEEGHEMLALADSAGHVDLRKLMGELATRGVNEVLVEAGPRLAGAFARLGLVDEFQIFIAGKFLGSSARPLLDLPLAQMSEALELNIVQMRAVGNDWRVIALPVRAPGV

SEQ ID NO: 92 - DNA, 1104 bp, Dechloromonas aromatica RCB
  CDS (1)..(1104): transl_table=11
atgagcttttccgccgtcgaccacggcatgatggcccgcgccctgcaactggctgagcgcggcttgtggacgacgtcgccgaatccccgtgttggctgtgtgctggtccgtgacggcgagattgtcggcgaaggctggcacgagaaggccggggagccgcatgccgaagttcacgccttgcgctcggccggtgagagggcgaaaggtactaccgcctacgtgaccctggaaccgtgcagtcaccacggtcgcacaccgccgtgtgccgaagccctgatcgcggccggggtctcccgtgttgtggcagcgatgaccgatcccaatccgctggtctccggtaaaggcctggccttgttgcgggcggcgggtatcgaaacggcgagtggcctgctcgaaaacgaggcgcgcgaactcaatatcggtttcgtctcgcgcatgacccgtggtcggccctggctgcgcctgaaggtggcagccagcctggatggcaagaccgcattgaacaatggcgtcagccagtggattaccggcccggatgcccgccgcgatggccatgcctggcgggcacgcgcttgcgcgattctgaccggcatcggtacggtgcgcgacgacgacccgcaactgtcagtgcgtgatgtggcgacgacccgccaacccctgcgagtggttgtcgacagcaagctggaaacgccggtaaacgcccggattctgcaaggcggcccggtcctgatcgcgggagccgttgagaacaacgcaagaatcgagtcactgcgctcgcttggcgctgacgtgcttatcctgcccaatccgtcgggcaaggtggatttgatcgcgctgcttgttgcgctggggcagcgtggtatcaacgaagtgcatgccgaagcaggcttcaagctgaatggctcgttgctgcgcgaaggcctggtcgatgaactgctgctttatctggccccctgcctgatcggccatcaagcgagcggcctgttcaacttgccggaactgactacgctggacggcaagcagcgcttgcagattcgtgacctgcgtcaggtcggggcagatattcgggtgcttgcccgcctgggcaattctgacgcgcgctga

SEQ ID NO: 93 - protein, 367 aa, Dechloromonas aromatica RCB
MSFSAVDHGMMARALQLAERGLWTTSPNPRVGCVLVRDGEIVGEGWHEKAGEPHAEVHALRSAGERAKGTTAYVTLEPCSHHGRTPPCAEALIAAGVSRVVAAMTDPNPLVSGKGLALLRAAGIETASGLLENEARELNIGFVSRMTRGRPWLRLKVAASLDGKTALNNGVSQWITGPDARRDGHAWRARACAILTGIGTVRDDDPQLSVRDVATTRQPLRVVVDSKLETPVNARILQGGPVLIAGAVENNARIESLRSLGADVLILPNPSGKVDLIALLVALGQRGINEVHAEAGFKLNGSLLREGLVDELLLYLAPCLIGHQASGLFNLPELTTLDGKQRLQIRDLRQVGADIRVLARLGNSDAR

SEQ ID NO: 94 - DNA, 1080 bp, Thiobacillus denitrificans ATCC 25259
  CDS (1)..(1080): transl_table=11
atgagatttaccgccgccgattcccgtttcatgtcgcgcgccctgcaactcgcggcgcgcgggcttttcacgacgagccccaatccgcgcgtcggctgcgtcctcgtcaaggatgatcgcatcgtcggcgaaggctggcacgaacgcgccggcacgccgcacgccgaaatccatgccctgcgcgccgcgggcgaagccgcgcgcggcgcaacggcctacgtcacgctcgagccctgctcgcaccatggccgcacgccgccctgcgcggaggcgctcatcgacgccggcgtcagccgcgtcgtcgcggcgatgaccgatcccaacccgctggtcgccggcggtggcatttcgatgctgacgctcgcggggatcgcggccgaggtcgggttgatggaggccgaggcgcgcgcgctcaatcccggcttcgtttcgcgcatgacgcggcgccgtccctgggtgcggctcaagaccgcgtcgacgctggacggcaagaccgcgctcgccaacggcgcctcgcagtggatcaccggcgaggccgcacgcgccgacgtccaaagactgcgcgcgcgcgcctgcgcaatcctgaccggcagcggcacggtgctcgccgacgatccgcgcatgaacgtgcgtgacttcgacatcggccgggcgccgctacgcgtcgtcgtcgattcgaccctgcgcacgccggccagcgcggcgatcctgcccgcgctcgtcgcctgccgcgacgcctcgccggctacgcggacggcgctcgaagcggcgggggcggaggtgatcgagatgccgggcgtagatggccgcgtcgacctcgccgcgctgctcgcgctcctcgcgcagcgcggcgtcaacgaagtccacgtcgaagccggtgcggcgctgaacggcgcgctgctcgcggccggcttggtcgacgagtgggtcgcctacctcgcgccgctcgcggtcggcgatgacgcgcgcgggctgttcgcccacgcgccgctcgccacgctcgccgaggccgcgcgtttccggttgcaagacctgcggcagatcggcggcgacctgcgcctgaccctgctgccggcatga

SEQ ID NO: 95 - protein, 359 aa, Thiobacillus denitrificans ATCC 25259
MRFTAADSRFMSRALQLAARGLFTTSPNPRVGCVLVKDDRIVGEGWHERAGTPHAEIHALRAAGEAARGATAYVTLEPCSHHGRTPPCAEALIDAGVSRVVAAMTDPNPLVAGGGISMLTLAGIAAEVGLMEAEARALNPGFVSRMTRRRPWVRLKTASTLDGKTALANGASQWITGEAARADVQRLRARACAILTGSGTVLADDPRMNVRDFDIGRAPLRVVVDSTLRTPASAAILPALVACRDASPATRTALEAAGAEVIEMPGVDGRVDLAALLALLAQRGVNEVHVEAGAALNGALLAAGLVDEWVAYLAPLAVGDDARGLFAHAPLATLAEAARFRLQDLRQIGGDLRLTLLPA

SEQ ID NO: 96 - DNA, 1131 bp, Pseudomonas fluorescens PfO-1
  CDS (1)..(1131): transl_table=11
atgaccgccgccgagcaggccatcctcgacgctcacttcatggcccgggccctggagctggcgcgcaaggggcattacacgactcaccccaatccacgggtcggctgcgtgattgtgcgcgacgggcagattgtcggcgaaggctggcatgagcgcgccggcgaaccccacgccgaagtccacgccctgcgcgccgccggtgaacgggcccgtggcgccacggcttacgtcaccctcgaaccttgcagccaccacggccgtacgccgccgtgcgccgatgcgctggtgaatgccggtattggccgggtggttgcggcgatgcgtgatccgaatcctcaagtcgccggacgcggcctgcagcgcttgaccgatgccggcatcgccaccgaaagcggcgtgctggaagctgaggcgcgcaagctcaatcaaggttttctgaagcgcatggaacacggcttgccgttcgtgcgggtcaagttggccatgagcctcgatggccgtacagcgatggaaagcggtgagagccaatggatcaccggccctgccgcgcgttcggcggtgcagcgtctgcgcgcccaggccagcgtggtgctgaccggcgccgacacggtgctggccgatggcgcacgcctgaccgttcgcggcgaggagctggggctggatgccgcacaaaccgcgctggccctgagccgtccgccgctgcgggtactgatcgacggacgtctgcgggtgccgctggatgcgccgttcttcaaggccggcccggcgctggtcgccacctgcgtggccatcgaagaacagtacgcccacggcccggaatgcctgatcgtgccgggcgatgacggtcaggtcgatctgcaccaattgctgatcgaactggccaaccgtggcgtcaacgaagtgctggtcgaggctggcccacgactggccggcgcctttgcccagttcggtctggtcgacgagttcgtgatcttcattgccggcaagttcctcggctccacggcgcgtccgcttctggactggccgctggcctgtatgaaggatgcgcccgagctgaaaatcactgaaattcgcgcggttggcgatgactggcgagtcactgccatccctgtcccatcggcgagcgtataa

SEQ ID NO: 97 - protein, 376 aa, Pseudomonas fluorescens PfO-1
MTAAEQAILDAHFMARALELARKGHYTTHPNPRVGCVIVRDGQIVGEGWHERAGEPHAEVHALRAAGERARGATAYVTLEPCSHHGRTPPCADALVNAGIGRVVAAMRDPNPQVAGRGLQRLTDAGIATESGVLEAEARKLNQGFLKRMEHGLPFVRVKLAMSLDGRTAMESGESQWITGPAARSAVQRLRAQASVVLTGADTVLADGARLTVRGEELGLDAAQTALALSRPPLRVLIDGRLRVPLDAPFFKAGPALVATCVAIEEQYAHGPECLIVPGDDGQVDLHQLLIELANRGVNEVLVEAGPRLAGAFAQFGLVDEFVIFIAGKFLGSTARPLLDWPLACMKDAPELKITEIRAVGDDWRVTAIPVPSASV

SEQ ID NO: 98 - DNA, 1134 bp, Methylobacillus flagellatus KT
  CDS (1)..(1134): transl_table=11
atggcaggcatgaatacctttacctccccagaattctccgccagcgaccaccactatatgaatcttgcgctgcgtgaagcggctcgtggtttgtacagcaccagtcccaatccgcgcgtcggctgcgtgatcgtcaaggatggcaaggtggtggggcgtggcgcgcatctcagggcgggcgagccgcatgcggaggtgcatgccttgagaatggccggagggcaggcggcgggcgcggatgcttacgttaccctggagccgtgcagtcatttcgggcgtacgccgccgtgtgccgatgccctagtcaaggcgggcgtcaggcgcgtagttgccgccatgcaggatcccaatccgctggtatcaggcagcgggttgaagcggctgtccacacatggcatcgaagtcgcctacggtttgttggaacatgaagccagggagctgaatgccgggttcatttcacgcatgaccaggcaacgcccctgggtgcgcagcaagattgccgccagcctggatggcaagaccggcctgaacaatgggcagagcaagtggatcaccggcccgtcggcccgtcagcatgtacaacaatggcgcgcgcaatcctgcgcgatactcaccggtgtcggcactgtgctcgccgacgatcctatgctgaccgtacgggatgtcacgcttctgcagcagcggcatggcgtccagccttggcgcgtgatcgtcgatagccaattgcgcactccgcctgcagctgcgacgctgcaggccggccgcgtgctgatcgcccatgcagccagcctacctgtacaggaaaaagccttgcgggatgccggtgccgaattgatcgccatgcccggcccctcaggacgggtcgatctggaagccctgttgcacgcgctggcccagcggcagatcaacgatgtcatggtggaagctggtgcgagattgaatggcagcctgctgtacggcggactggtggacgaattgctgttgtattacgcaccagtactgctgggaggtggggcgcgtgatatgttcaccatgcccgccttgcaggagatgcagcagaaaattcaactgcatgcgctggatttccgccaggtgggtgctgactggtttgtgcgcgccaagccggtgaagtga

SEQ ID NO: 99 - protein, 377 aa, Methylobacillus flagellatus KT
MAGMNTFTSPEFSASDHHYMNLALREAARGLYSTSPNPRVGCVIVKDGKVVGRGAHLRAGEPHAEVHALRMAGGQAAGADAYVTLEPCSHFGRTPPCADALVKAGVRRVVAAMQDPNPLVSGSGLKRLSTHGIEVAYGLLEHEARELNAGFISRMTRQRPWVRSKIAASLDGKTGLNNGQSKWITGPSARQHVQQWRAQSCAILTGVGTVLADDPMLTVRDVTLLQQRHGVQPWRVIVDSQLRTPPAAATLQAGRVLIAHAASLPVQEKALRDAGAELIAMPGPSGRVDLEALLHALAQRQINDVMVEAGARLNGSLLYGGLVDELLLYYAPVLLGGGARDMFTMPALQEMQQKIQLHALDFRQVGADWFVRAKPVK

SEQ ID NO: 100 - DNA, 1131 bp, Haemophilus somnus 129PT
  CDS (1)..(1131): transl_table=11
atgcaaccaacattttcagctcaagacgaatattttatgcagatagctttagaacttgcgaaaaaaggcatatttaccacaacacctaatcctgctgtgggctgtgttttagtcaaaaatggtgaaattgttgggagaggttttcattttaaagcggggcaaccccatgcggaagttatggcattacgtgatgccggtgatagagcaaagggggcaactgcttatgtgactttagagccttgttctcatttcggaagaacgcctccttgtgcacaaggactaattgaagcaggtattcgcaacgttattgtggcaatgaaagatcctaatccgcaagttgcaggcaaagggttagctatgttgcaagcagcaggtattgaaagtgcggtaggattattacaagaaaaagcggaattattaaacaaaggttttttaacacgaatgagaacacagaaaccttttgttattttgaaaatggcaataagccttgacggtcgaactgctatggctaatggcgagagtaaatggattagcggagaacaggcacggcaagacgtacagcaagagcgggctaaagtttctgcaattttatcgacagctaagacggtgttagccgatgatcccttgttaaatcttcgttgggagcaatttccatcggaattacaacaaaattataaagttgaagaagtgcgtcaacctgtcagaattattcttgatcgtctgcatcttgtgacacctcgtcataaattatttcaatgtcaatctcccgtttggctggtgggtgataaagagcgtgatatgtcagcgtttcctgattattgtcaatatataaaattattcccaagtaacgagcattcttatttggaaaacttgttgattgaattggcaaagcgtcagattaatagtctttggttagaagcgggagaaactttagccggtgcatttattgaggaaaatttagtgaatgagctcattatttatatggcaccaaaattactgggtaatgaagctcgtggtttttgccatttgccacatttgaagcgtttagccgatgcaccaaagtggcaattgttatctttggcacaaattggcgaagacattaagttgaattatcagcgtcacattttatga

SEQ ID NO: 101 - protein, 376 aa, Haemophilus somnus 129PT
MQPTFSAQDEYFMQIALELAKKGIFTTTPNPAVGCVLVKNGEIVGRGFHFKAGQPHAEVMALRDAGDRAKGATAYVTLEPCSHFGRTPPCAQGLIEAGIRNVIVAMKDPNPQVAGKGLAMLQAAGIESAVGLLQEKAELLNKGFLTRMRTQKPFVILKMAISLDGRTAMANGESKWISGEQARQDVQQERAKVSAILSTAKTVLADDPLLNLRWEQFPSELQQNYKVEEVRQPVRIILDRLHLVTPRHKLFQCQSPVWLVGDKERDMSAFPDYCQYIKLFPSNEHSYLENLLIELAKRQINSLWLEAGETLAGAFIEENLVNELIIYMAPKLLGNEARGFCHLPHLKRLADAPKWQLLSLAQIGEDIKLNYQRHIL

SEQ ID NO: 102 - DNA, 1146 bp, Shewanella sp. MR-4
  CDS (1)..(1146): transl_table=11
atgaattggtcagaactcgataaccagatgatgagccgagccatacaactggctcgcaaaggattttataccactcgccccaatcccagtgtgggctgcgttatcgtaaaagataatcagattgtcggtgagggttatcatcaaaaagctggcgagccacatgctgaggtgcatgcactgcggatggctggcgagcttgcccgtggcgcgaccgcctatgtcaccttagaaccttgcagccattatggccgcacaccgccgtgtgccttggcactgattaatattggtgtaaaacgagtcgtggtggcggttgaagatcccaatccgcaggtcggtggtcgcggtattcaaatgctgcgcgatgcgggcattcaagtggatgtcggtttgcaccgcgacgaagcttacgctttaaatcttggttttatgaagcgcatggaatcaggcctaccttgggtgacggtaaagcttgccgcgagcctagatggtaaaaccgcgttatcaaacggtgtgtccaaatggatcacaggccccgaagctcgccgcgatgtgcagcgcttacgtttacgcgcctgcgcgctagtgacggggattgacactgtgctggccgatgacccttcgcttaatgtgcgttactcagagcttggcagtcttagctcacaattgagtgaagcgcagattttacaaccgctgcgggtgatattagacagtcgttgccggatgccgattacggcagccttgcttgcgattgaatcgccgatgttattagtctcaactgagccttactcgccagcctttatggcgcagttgcccgcccatgtgacttgtcttcaattaccggcgattgatggtcgaatctcgctgcctgcactcttaagctatttaggcaaaagctgtaatcaggtgcttatcgaagcgggcgcgaccttagccggcgcctttatcggtgacggattagccgatgaattagtgttgtatcaagcgatgaaaatccttggcgcacagggacgtaatctactcgaattacccgattatcaaatgatggccgatattccgaccctcaaactggtcgatgagcgtaaagtgggcgcggatacgcgtttcaccttgaggcttacatccaatccatctttagcgaataagtga

SEQ ID NO: 103 - protein, 381 aa, Shewanella sp. MR-4
MNWSELDNQMMSRAIQLARKGFYTTRPNPSVGCVIVKDNQIVGEGYHQKAGEPHAEVHALRMAGELARGATAYVTLEPCSHYGRTPPCALALINIGVKRVVVAVEDPNPQVGGRGIQMLRDAGIQVDVGLHRDEAYALNLGFMKRMESGLPWVTVKLAASLDGKTALSNGVSKWITGPEARRDVQRLRLRACALVTGIDTVLADDPSLNVRYSELGSLSSQLSEAQILQPLRVILDSRCRMPITAALLAIESPMLLVSTEPYSPAFMAQLPAHVTCLQLPAIDGRISLPALLSYLGKSCNQVLIEAGATLAGAFIGDGLADELVLYQAMKILGAQGRNLLELPDYQMMADIPTLKLVDERKVGADTRFTLRLTSNPSLANK

SEQ ID NO: 104 - DNA, 1146 bp, Shewanella sp. MR-7
  CDS (1)..(1146): transl_table=11
atgaattggtcagaacttgataaccagatgatgagccgagccatacaactggctcgcaaaggattttataccactcgccccaatcccagtgtgggctgcgttatcgtaaaagataatcagattgtcggtgaaggttatcatcaaaaagccggcgagccccacgccgaggtgcatgcactgcgcatggctggcgagcttgcccgtggcgcgaccgcctatgtcaccttagaaccttgcagccattatggtcgtacgccgccctgcgccttggcgttgatcaacataggtgtaaaacgtgtggtggtggcggttgaagatcccaatccgcaggtcggtggtcgcggtattcaaatgctgcgcgatgcgggcattcaagtggatgtcggtttacatcgcgacgaagcttacgctttaaatcttggttttatgaagcgcatggagtcgggtctaccttgggtgacggtaaagcttgccgcgagtctcgatggtaaaaccgcattatccaacggtgtgtccaaatggatcacaggccccgaagctcgccgcgatgtgcagcgcttacgtatacgcgcctgcgcgctagtgacagggattgacactgtgctagccgatgacccttcgctcaatgtgcgctactcagagcttggcagtcttaactcactattgagtgaggcgcaaattttacaaccgctacgggtgattttagacagtcgctgccgcatgccgattaaggcagctttgcttgcgattgaatcgccgattttattagtctcaactgagccatactcgccagcctttatggcgcagttgccgtcccatgtgacttgtcttcaattaccggcgattgatggtcgcatctcgctgcccacactcttaagctatttaggcaaaagctgtaatcaggtgcttatcgaagcgggcgcgaccttagcgggtgcctttatcggcgcgggattagccgatgagttagtactgtatcaagcgatgaaagtccttggcgcacaagggcgtaatctactcgaattacccgattatcaaatgatggccgatattccgaccctcaaactggtcgatgagcgtaaagtgggcgcggatacgcgtttcaccttaaggctcacgtccaatccatctttagcgaataagtga

SEQ ID NO: 105 - protein, 381 aa, Shewanella sp. MR-7
MNWSELDNQMMSRAIQLARKGFYTTRPNPSVGCVIVKDNQIVGEGYHQKAGEPHAEVHALRMAGELARGATAYVTLEPCSHYGRTPPCALALINIGVKRVVVAVEDPNPQVGGRGIQMLRDAGIQVDVGLHRDEAYALNLGFMKRMESGLPWVTVKLAASLDGKTALSNGVSKWITGPEARRDVQRLRIRACALVTGIDTVLADDPSLNVRYSELGSLNSLLSEAQILQPLRVILDSRCRMPIKAALLAIESPILLVSTEPYSPAFMAQLPSHVTCLQLPAIDGRISLPTLLSYLGKSCNQVLIEAGATLAGAFIGAGLADELVLYQAMKVLGAQGRNLLELPDYQMMADIPTLKLVDERKVGADTRFTLRLTSNPSLANK

SEQ ID NO: 106 - DNA, 1110 bp, Alkalilimnicola ehrlichei MLHE-1
  CDS (1)..(1110): transl_table=11
atgtccggtttctcccccgccgacaacctcttcatgggccgggccctgcgcctggcccgccgcccgcagcagccgccccatcccaaccccgccgtcggctgcgtgctggtgcgcgacgggcttatcgtcggcgagggctggcatgagcgggcgggcgagccccacgcggaggccatggccctgcaccgggccggcgagcaggccagcggcgccaccgcctacgtcaccctggagccgtgcagccaccacggccgcaccccgccctgcagcgaggccctgctggcggccggcgtggtccgggtggtggcggccatgaccgaccccaacccgcaggtggccggccgcgggctgcgccgcttgcgcgccgccgggctggaggtggccaccggcttgatggccgagcaggcggcggcgctgaaccccggcttcacccagcggatgcgcaccgggcggccctggctgcggctgaaatcggcggccagtctcgacgggcggaccgccatggcctccggcgagagccgctggatcacctcgccccaggcccgggccgacgtccaccgctggcgggcgcgcagcgacgccatgctcaccggcatcggcaccgtgctggcggacgacccgcgcctggatgtccgcgatgccggcatcgaggcgccgcgccagccgcgccgctgcgtgctcgaccgcgacctgcggacccccgcggacgcggtcctgctccgcggcgagggcgcgaccctgttccacggcccggacgtggccgccggacagatccggcggctgaccgacgccggcgcccactgcgtggcgctgccgctggcggacgggcgcctggacctgggcgcggccctggactggctgggcggtcaggggtgcaatgaggtgctggtggaggccgggccgaccctgggcggggccttgagccgcgccggtctggtggatgaatggctgctctacctggcgccccacctgatgggcgacgcggcgcggccgctgctgcactggccggggctggagacgatgagccagcgccagcccctccgggtgcaggactgccgcttggtggggccggatctgcggttgacgctgcggctggggagcgggacctga

SEQ ID NO: 107 - protein, 369 aa, Alkalilimnicola ehrlichei MLHE-1
MSGFSPADNLFMGRALRLARRPQQPPHPNPAVGCVLVRDGLIVGEGWHERAGEPHAEAMALHRAGEQASGATAYVTLEPCSHHGRTPPCSEALLAAGVVRVVAAMTDPNPQVAGRGLRRLRAAGLEVATGLMAEQAAALNPGFTQRMRTGRPWLRLKSAASLDGRTAMASGESRWITSPQARADVHRWRARSDAMLTGIGTVLADDPRLDVRDAGIEAPRQPRRCVLDRDLRTPADAVLLRGEGATLFHGPDVAAGQIRRLTDAGAHCVALPLADGRLDLGAALDWLGGQGCNEVLVEAGPTLGGALSRAGLVDEWLLYLAPHLMGDAARPLLHWPGLETMSQRQPLRVQDCRLVGPDLRLTLRLGSGT

SEQ ID NO: 108 - DNA, 1122 bp, Pseudomonas aeruginosa UCBPP-PA14
  CDS (1)..(1122): transl_table=11
atgaacgccgccgacccgctgtacatggcccgcgccctggaactggcgcgccaggggctgtactccacccatccgaatccgcgcgtcggctgcgtgctggtcaaggacggccaggtggtcggcgagggctggcacgtccgcgccggcgagccgcacgccgaggtccatgccctgcgccaggccggcgagaatgcacgcggcgccaccgcctacgtgaccctcgagccctgcagccacttcggccgcaccccgccgtgcgccgacgcgctggtgggcgccggggtggcgcgggtggtcgcggcgatgcaggatcccaaccccgaggtcgccggtcgcggcctgctgcgtctgatgcaggccggcatcgcggtgcagagcggggtcctcgaagccgaggcgcgggaactcaacatcggtttcatcaagcgcatggaacatggcctgccgttcgtccgggtcaagctggcgatgagcctggacgggcgcaccgccatggccagcggggaaagccagtggatcaccgggccctctgcgcgttcggcggtgcagcgcttgcgcgctcgctccagcgtggtgttgtccggcgccgatacgctgctggcggacgatgcgcggctcaacgtacgccccgacgaactgggcctgaacgccgagcttaccgcgctcgccgcggctcgccagccgttgcgggtgctggtcgacgggcgcctgcgggtgccgctggagtcggcgttctaccaggccggtccggcactggtggcgacctgcgccgccgcctcggcgcgcgaacgcttccaggacgccggtcacgaactgctggcgctgccctccgccgaggggcatgtcgacctgcacaagttgctcgtggaactggcggcgcgcggcgccaacgaagtgctggtggaggccggcccccgcctggccggcgccttcgctcgactggggctggtggatgagtaccggctgttcgtcgcgccgaagttcctcggctccagcgcccgtcctttgctcgactggccgctgacgcggatggccgatgcggcgcagttgcggatcgacgacatccgcgcggtgggcgacgactggctggtcaccgcgcggccccatccgcgggacgcttga

SEQ ID NO: 109 - protein, 373 aa, Pseudomonas aeruginosa UCBPP-PA14
MNAADPLYMARALELARQGLYSTHPNPRVGCVLVKDGQVVGEGWHVRAGEPHAEVHALRQAGENARGATAYVTLEPCSHFGRTPPCADALVGAGVARVVAAMQDPNPEVAGRGLLRLMQAGIAVQSGVLEAEARELNIGFIKRMEHGLPFVRVKLAMSLDGRTAMASGESQWITGPSARSAVQRLRARSSVVLSGADTLLADDARLNVRPDELGLNAELTALAAARQPLRVLVDGRLRVPLESAFYQAGPALVATCAAASARERFQDAGHELLALPSAEGHVDLHKLLVELAARGANEVLVEAGPRLAGAFARLGLVDEYRLFVAPKFLGSSARPLLDWPLTRMADAAQLRIDDIRAVGDDWLVTARPHPRDA

SEQ ID NO: 110 - DNA, 1146 bp, Shewanella sp. ANA-3
  CDS (1)..(1146): transl_table=11
atgaattggtcagaactcgataaccagatgatgagccgagccatacaactggctcgcaaaggtttttataccactcgccccaatcccagtgtgggctgcgttatcgtaaaagataatcagattgtcggtgaaggttatcatcaaaaagccggcgagccccacgccgaggtgcatgcactgcgcatggctggcgagcttgcccgtggcgcgaccgcctatgtcaccttagaaccttgcagccattatggccgcacaccgccgtgtgccttggcgctgatcaatattggtgtaaaacgtgtagtggtcgcggttgaagatcccaatccgcaggtcggtggtcgcggtattcaaatgctgcgcgatgcgggcattgaagtggatgtcggcttacatcgcgacgaagcttatgctttaaatcttggttttatgaagcgcatggaatcgggcttaccttgggtgacggtaaagcttgccgcgagtctcgatggtaaaaccgcattatccaacggtgtctctaagtggattacaggccccgaagctcgccgcgatgtgcagcgcttacgtttgcgcgcctgtgcactggtcactgggattgaaaccgtactggccgatgccccttcgcttaatgtgcgctactcagagcttggcagtcttaacttgcaattgagtgaagcgcaaattttacaaccgctgcgggtgattttagatagtcgttgccgcatgccgattacggcagccttgcttgcgattgaatcgccgattttattagtctcaacagagccttactcgccagcctttatggcgcagttgcctgcccatgtgacttgtcttcaattaccggcgattgatggtcgaatctcgctgcctgcactcttaagctatttaggcaaaagctgtaatcaggtgcttatcgaagcgggcgcgaccttagccggcgcctttatcggtgacggattagccgatgagttagtgctgtatcaagcgatgaaaatccttggggcacaaggacgtaatctactcgaattacccgattatcaaatgatggccgatattccgaccctcaaactggtcgatgagcgtaaagtgggcgcggatatgcgtttcaccttgcggctcacgtccaatccatctttagcgaataagtga

SEQ ID NO: 111 - protein, 381 aa, Shewanella sp. ANA-3
MNWSELDNQMMSRAIQLARKGFYTTRPNPSVGCVIVKDNQIVGEGYHQKAGEPHAEVHALRMAGELARGATAYVTLEPCSHYGRTPPCALALINIGVKRVVVAVEDPNPQVGGRGIQMLRDAGIEVDVGLHRDEAYALNLGFMKRMESGLPWVTVKLAASLDGKTALSNGVSKWITGPEARRDVQRLRLRACALVTGIETVLADAPSLNVRYSELGSLNLQLSEAQILQPLRVILDSRCRMPITAALLAIESPILLVSTEPYSPAFMAQLPAHVTCLQLPAIDGRISLPALLSYLGKSCNQVLIEAGATLAGAFIGDGLADELVLYQAMKILGAQGRNLLELPDYQMMADIPTLKLVDERKVGADMRFTLRLTSNPSLANK

SEQ ID NO: 112 - DNA, 1134 bp, Haemophilus somnus 2336
  CDS (1)..(1134): transl_table=11
atgatgcaaccaacattttcagctcaagatgaatattttatgcagatagctttagatcttgcgaaaaaaggcatatttaccacaacacctaatcctgctgtgggctgtgttttagtcaaaaatggtgaaattgttgggagaggttttcattttaaagcggggcaaccccatgcggaagttatggcattacgtgatgccggtgatagagcaaagggggcaactgcttatgtgactttagagccttgttctcatttcggaagaacgcctccttgtgcacaaggactaattgaagcaggtattcgcaacgttattgtggcaatgaaagatcctaatccgcaagttgcaggcaaagggttagctatgttgcaagcagcaggtattgaaagtgcggtaggattattacaagaaaaagcggaattattaaacaaaggttttttaacacgaatgagaacacagaaaccttttgttatcttgaaaatggcaataagccttgacggtcgaactgctatggctaatggcgagagtaaatggattagcggagaacaggcacggcaagacgtacagcaagagcgggctaaagtttctgcaattttatcgacagctaagacggtgttagccgatgatcccttgttaaatcttcgttgggagcaatttccatcggaattacaacaaaattataaagttgaagatgtgcgtcaacctgtcagaattattcttgatcgtcagcatcttgtgacacctcgtcataaattatttcaatgtcaatctcccgtttggctggtgggtgataaagagcgtgatatgtcagcgtttcctgattattgtcaatatataaaattattcccaagtaacgagcattcttatttggaaaacttgttgattgaattggcaaagcgtcagattaatagtctttggttagaagcgggagaaactttagctggtgcatttattgaggaaaatttagtgaatgagctcattatttatatggcaccgaaattactgggtaataaagctcgtggtttttgccatttgccacatttgaagcgtttagccgatgcaccaaagtggcaattgttatctttggcacaaattggcgaagacattaagttgaattatcagcgtcacattttatga

SEQ ID NO: 113 - protein, 377 aa, Haemophilus somnus 2336
MMQPTFSAQDEYFMQIALDLAKKGIFTTTPNPAVGCVLVKNGEIVGRGFHFKAGQPHAEVMALRDAGDRAKGATAYVTLEPCSHFGRTPPCAQGLIEAGIRNVIVAMKDPNPQVAGKGLAMLQAAGIESAVGLLQEKAELLNKGFLTRMRTQKPFVILKMAISLDGRTAMANGESKWISGEQARQDVQQERAKVSAILSTAKTVLADDPLLNLRWEQFPSELQQNYKVEDVRQPVRIILDRQHLVTPRHKLFQCQSPVWLVGDKERDMSAFPDYCQYIKLFPSNEHSYLENLLIELAKRQINSLWLEAGETLAGAFIEENLVNELIIYMAPKLLGNKARGFCHLPHLKRLADAPKWQLLSLAQIGEDIKLNYQRHIL

SEQ ID NO: 114 - DNA, 1119 bp, Haemophilus influenzae R2846
  CDS (1)..(1119): transl_table=11
atgcttgaattttcctcacaagattgcgtatttatgcaacgtgccttagatttagccgccaaaggtcaatataccaccacaccgaacccatcagtgggatgcgtattggttaaaaatggtgaaattgtgggggaaggctttcattttaaggcaggacaacctcatgctgaacgtgttgccttagctcaagcaggagaaaattcaaaaggtgcgacagcttatgttacgcttgagccttgttctcactatgggagaacaccgccttgtgcattaggattaattgaggcgggcgtagtgaaagtcattgcggctatgcaagatccgaatcctcaagtcgcaggaaaaggtttgaaaatgttgtctgatgctggtatcgaaagtgcggtgaatttattaaacgatcaagcggaaaaaataaataaaggctttttaaaacgaatgcgtcaaggtatgccttttgttcaactcaaactcgccatgagtttagatggacgaactgcaatggcaagtggagaaagtaaatggattacgggcccagatgctcgttcggacgtacaaaaaatgcgagcaaaatcatccgcacttttatctacttccacaacagtcattgcagatgatccaagcctgaacgtacgctgggatgaatttcctgaaaatcttaaaacagaatataaaaaagaagatcttcgccagcctgtccgagttattttagattcacaacatcgcattcagccgactcataaactttttttaacccattctcccgtttggttagtctctagtgaaacacgagatttaacaggctttcctgatttttgtgaacaaattattcttccgaaagaaaatttactaaaagaattaatgcgagaattgggaaaacgacaaatcaataccctttgggtagaagctggagcaaatttagcgggcagtttaattgatgcgaaattagtggatgaattgattatttacattgcgccaaaattacttggagacaatgctcgtggtctatgccaattaccgaatttaactaaacttgccgatgcaccattatggcaactcaatgaattagaacaaatcggtgacgatataaaattaacttacacaccgaaaggagtctaa

SEQ ID NO: 115 - protein, 372 aa, Haemophilus influenzae R2846
MLEFSSQDCVFMQRALDLAAKGQYTTTPNPSVGCVLVKNGEIVGEGFHFKAGQPHAERVALAQAGENSKGATAYVTLEPCSHYGRTPPCALGLIEAGVVKVIAAMQDPNPQVAGKGLKMLSDAGIESAVNLLNDQAEKINKGFLKRMRQGMPFVQLKLAMSLDGRTAMASGESKWITGPDARSDVQKMRAKSSALLSTSTTVIADDPSLNVRWDEFPENLKTEYKKEDLRQPVRVILDSQHRIQPTHKLFLTHSPVWLVSSETRDLTGFPDFCEQIILPKENLLKELMRELGKRQINTLWVEAGANLAGSLIDAKLVDELIIYIAPKLLGDNARGLCQLPNLTKLADAPLWQLNELEQIGDDIKLTYTPKGV

SEQ ID NO: 116 - DNA, 1119 bp, Haemophilus influenzae R2866
  CDS (1)..(1119): transl_table=11
atgcttgaattctcctcacaagattgcgtatttatgcaacgtgccttagatttagccgccaaaggtcaatataccactacaccgaacccatcggtgggatgcgtattggtaaaaaatggtgaaattgtgggggagggctttcattttaaggcaggacaacctcatgctgaacgtgttgccttagctcaagcgggtgaaaatgccaaaggtgcaacagcttatgttacgcttgagccttgttctcactatgggagaacaccgccttgtgcattaggattaattgaggcgggcgtagtgaaagtcattgcggctatgcaagatccgaatcctcaagtcgcaggaaaaggtttgaaaatgttgtcagatgcaggcatcgaaagtgcggcaaatttattgaacgatcaagcggaaaaaataaataaaggctttttaaaacgaatgcgtcaaggtatgccttttgttcaacttaaacttgcgatgagtttagatggacgaacagcaatggcaagtggagaaagtaaatggattacgggttcagatgctcgttcggacgtacaaaaaatgcgtgcaaaatcatccgcacttttatccacttctgcgacagtacttacagatgatccaagccttaatgtacgctgggatgaattccctgaaaatcttaaaacagaatataaaaaagaagatcttcgccagcctgtacgagtcattttagattcacaacatcgcattcagccaactcataaactttttttaacacattcccctgtttggttagtttctaatgaaccacgagatttaaccggctttcctgatttctgtgaacaaattattcttccaaaagaaaatttactaaaagaattaatgcaagaattgggaagacgccaaataaataccctttgggtagaagctggagcaaatttagcagggagtttaattgatgcgaaattagtcgatgaattgattatttacgttgcgcccaaattacttggcgacaatgctcgtggtctatgccaattaccaaatttaactaaacttgccgatgcaccattatggcaactcaataaattagaacaaatcggtgacgatataaaattaacttacacgccgaaaggaatctaa

SEQ ID NO: 117 - protein, 372 aa, Haemophilus influenzae R2866
MLEFSSQDCVFMQRALDLAAKGQYTTTPNPSVGCVLVKNGEIVGEGFHFKAGQPHAERVALAQAGENAKGATAYVTLEPCSHYGRTPPCALGLIEAGVVKVIAAMQDPNPQVAGKGLKMLSDAGIESAANLLNDQAEKINKGFLKRMRQGMPFVQLKLAMSLDGRTAMASGESKWITGSDARSDVQKMRAKSSALLSTSATVLTDDPSLNVRWDEFPENLKTEYKKEDLRQPVRVILDSQHRIQPTHKLFLTHSPVWLVSNEPRDLTGFPDFCEQIILPKENLLKELMQELGRRQINTLWVEAGANLAGSLIDAKLVDELIIYVAPKLLGDNARGLCQLPNLTKLADAPLWQLNKLEQIGDDIKLTYTPKGI

SEQ ID NO: 118 - DNA, 1095 bp, Xylella fastidiosa Dixon
  CDS (1)..(1095): transl_table=11
atgagcgcattttccgcggatgatcactgtcacatggaacgggccttgtgtttggctgagcgtggcgcttacacgacgcgtcctaacccaatggtgggttgtgtgattgtgcatgatggtgaagtagtgggagagggttggcaccagcgtgctggcgatccgcatgctgaggtatttgcattgcgtgcggctggagactgcgcacgaggtgcaacagcttacgttacgttggagccgtgtgcgcactcggggcgcactccgccgtgtgcgatggcgttgattgatgccggagtgagacgggtggtggcggcgatggtcgatccatttccgttagtcaatggtgggggagtcactctgttacgtgcggctggggtgacggttgagcatggtttgatggaggcgcaggcgcgcgcacttaaccgtggctttctgtcgcgggtggagcgtggtcggccatgggtgcggatcaagcttggtagcagtttggatgggcgtaccgcgttggctagtggcgaatccaagtggattaccggggaggcggcacgtgctgatgtgcagcgttggcgcgcgcgcgctagcgcgattttgacgggggctgggacggtgcttgccgatgatccggcgttaacggtgcgcctgggtggggaggagggagcgtttttgccgccgttgcgggtggtgcttgattctaggttgcgttcacttagttgcgtgaaggtgcgtgacggtactgcaccaacgttgtatctgcatggttttggggtcacgtccccggtgttgcaacacgtcgatttttccgaggttcagcaacgtgatgctgggcttgatctgggggctgtgttacgcctgttgggtgagcgtggcatcaatgaggttcaggttgaggctggggcgacgttatgcggggcgttgctgcacgccgggttggtggatgagttactgatttatattgcaccgttgttgctgggtgatacggcacggccattactggctggattggatatcgggcgcatggatcagtgcattggtttgaaggtgctggaggtcgctcaggtcggcaacgatctgcgattgttattacgtccgtgtggttga

SEQ ID NO: 119 - protein, 364 aa, Xylella fastidiosa Dixon
MSAFSADDHCHMERALCLAERGAYTTRPNPMVGCVIVHDGEVVGEGWHQRAGDPHAEVFALRAAGDCARGATAYVTLEPCAHSGRTPPCAMALIDAGVRRVVAAMVDPFPLVNGGGVTLLRAAGVTVEHGLMEAQARALNRGFLSRVERGRPWVRIKLGSSLDGRTALASGESKWITGEAARADVQRWRARASAILTGAGTVLADDPALTVRLGGEEGAFLPPLRVVLDSRLRSLSCVKVRDGTAPTLYLHGFGVTSPVLQHVDFSEVQQRDAGLDLGAVLRLLGERGINEVQVEAGATLCGALLHAGLVDELLIYIAPLLLGDTARPLLAGLDIGRMDQCIGLKVLEVAQVGNDLRLLLRPCG

SEQ ID NO: 120 - DNA, 1095 bp, Xylella fastidiosa Ann-1
  CDS (1)..(1095): transl_table=11
atgggcgcattttccgcggatgatcaccgtcacatggaacgggccttgtgtttggctgagcgtggtgcttacacgacgcgtcctaacccaatggtgggttgtgtgattgtgcgtgatggtgaagtagtgggagagggttggcaccagcgtgctggcgatccgcatgctgaggtatttgcattgtgtgcggctggagacctcgcacgaggtgcaacggcttacgtcacgttggagccgtgtgcgcactcggggcgtactccgccgtgtgcgatggcgttgattgatgccggagtgagacgagtggtggcggcgatggtcgatccatttccgttagtcaatggtgggggagtcactctgttacgtgcggctggggtgacggttgagcatggtttgatggaggcgcaggcgcgtgcactcaaccgtggctttctgtcgcgggtggagcgtggtcggccatgggtgcggatcaagcttggtagcagtttggatgggcgtaccgcgttggctagtggcgaatccaagtggattaccggggaggcggcacgtgttgatgtgcagcgttggcgcgcgcgcgctagcgcgattttgacgggggctgggacggtgcttgccgatgatccggcgttaacggtgcgcctgggtggggaggagggagcgtttttgccgccgttgcgggtggtgcttgattctagcttgcgttcacttagttgcgtgaaggtgcgtgacggtactgcaccaacgttgtatctgcatggttttggggtcacgtccccggtgttgcaacacgtcgatttttccgaggttcagcaacgtgatgctgggcttgatctggaggctgtgttacgcctgttgggtgagcgtggcatcaatgaggtgcaggttgaggctggggcgacgttatgcggggcgttgctgcacgctgggttggtggatgagttactgatttatattgcaccgttgttgctgggtgatacggcacggccattactggctggattggatatcgggcgcatggatcagtgcattggtttgaaggtgctggaggtcgctcaggtcggcaacgatctgcgattgttattacgtccgtgtggttga

SEQ ID NO: 121 - protein, 364 aa, Xylella fastidiosa Ann-1
MGAFSADDHRHMERALCLAERGAYTTRPNPMVGCVIVRDGEVVGEGWHQRAGDPHAEVFALCAAGDLARGATAYVTLEPCAHSGRTPPCAMALIDAGVRRVVAAMVDPFPLVNGGGVTLLRAAGVTVEHGLMEAQARALNRGFLSRVERGRPWVRIKLGSSLDGRTALASGESKWITGEAARVDVQRWRARASAILTGAGTVLADDPALTVRLGGEEGAFLPPLRVVLDSSLRSLSCVKVRDGTAPTLYLHGFGVTSPVLQHVDFSEVQQRDAGLDLEAVLRLLGERGINEVQVEAGATLCGALLHAGLVDELLIYIAPLLLGDTARPLLAGLDIGRMDQCIGLKVLEVAQVGNDLRLLLRPCG

SEQ ID NO: 122 - DNA, 1122 bp, Pseudoalteromonas tunicata D2
  CDS (1)..(1122): transl_table=11
atgagttttacagcacttgattatcaatatatggcccttgccattgagttagcaaaaaaaggtcgttataccacgtcgcccaatcccaatgttggttgtgtattggttaaagatggccaaatagtgggtcaaggctatcatcaaaaagcgggcgaaggtcatgctgaagtgcatgcattagcgcaagcaaaagagcaggcgctaggtgccactgcttatgtcacccttgagccatgtagccataccgggcgcacgggtccttgtgctttggcactggttaatgccggtgttattaaggtcattgctgctatggttgatccaaatcctgctgtcagtggccgtggtttagcaatattagaaaaagcaggaattcaaactgcacatggcttaatgcaagtggaggccgaagcgctcaatgttggttttttaaagcgcatgcgaaacgctatgccttttgttcagtgtaaattagcagcgagccttgatggtaaaaccgcgcttgctaatggactaagcaaatggataaccggccctcttgctcgtgctcaagtgcaagattatcgagcgcaaagttgtgcagttctgactggtgctgataccgtgctggttgataatgccaaaatgaatgtacgttatgatgaattgattaacccaccattttctttagcgcagttgcgccagccgattcgtgtagtgattgactctaagcatcgattaacacccgaccttgctttttttcaaatcgagagcccggtgattatcttgactaccaagcttgatatttcagagcgatggcctcatttcgtatctcatctgctagtacctgagttaaatggccaagttgatttatcacaagcaatgcaattgcttggtgcacgtggaattaatcatatttggcttgaagccggccatactttagctgggcaaatggcgcagcaaggtttggttgatcagtttattttttacctggcaccaaaattaatcggccacagcgggaaaagccttttacaattacccgtgttagaatctatggctgaagtaactgaattatcgatagatgatgtctcgatggtcggcgtcgacttaaagattacggcatcttataaaaagagtgatcattaa

SEQ ID NO: 123 - protein, 373 aa, Pseudoalteromonas tunicata D2
MSFTALDYQYMALAIELAKKGRYTTSPNPNVGCVLVKDGQIVGQGYHQKAGEGHAEVHALAQAKEQALGATAYVTLEPCSHTGRTGPCALALVNAGVIKVIAAMVDPNPAVSGRGLAILEKAGIQTAHGLMQVEAEALNVGFLKRMRNAMPFVQCKLAASLDGKTALANGLSKWITGPLARAQVQDYRAQSCAVLTGADTVLVDNAKMNVRYDELINPPFSLAQLRQPIRVVIDSKHRLTPDLAFFQIESPVIILTTKLDISERWPHFVSHLLVPELNGQVDLSQAMQLLGARGINHIWLEAGHTLAGQMAQQGLVDQFIFYLAPKLIGHSGKSLLQLPVLESMAEVTELSIDDVSMVGVDLKITASYKKSDH

SEQ ID NO: 124 - DNA, 1125 bp, Photobacterium sp. SKA34
  CDS (1)..(1125): transl_table=11
atgtttactaaccttgatacacgattaatgctacgcgctattcagttagctaaacgtggttgttttacgacagcaccaaacccgaatgtggggtgtgttattgctattggcgatgaaatccttggtgaaggctttcattatcgtgcgggtgaaccccatgcggaggtgtttgcattaaaacaagcaggtacgcgcgcgaaaggtgcaacagcctatgttacgttagagccttgctctcattacggacgcacgccaccttgtgctgaagcattaattaaatcaggcataagtagagttatttgcgccatggttgatcctaacccgttagtggctggacgtggcgttgaaatgttgcaaaaagcgggtgtagatgtgcaagtagggcttcttaaagaagaggctcaagccattaataaagcgttcattaaacaaatgacaaccaagatgccgtatgttgaattaaaactggcatcaagtcttgatggtaaaacagcgttagcgaatggtgaaagtaaatggatcactgggccttatgctcgcgctgatgttcaacgtcatcgtgcgcaagctggtgcaatattatcaaccagtgccactgttatcgctgatgatccatcactgaatgtacgttggagtgagttgggtacactgattcaagatgaatatgcgcaagcagatgttcgtcaacctattcgcgttatcattgacagtcaaaaccgattaacaccggcatatcaggtatttcaccttccgggaaaaacgattttggcacgtactatgagcggcaatgaagactggcctgactccgtgtctcagtggataattcctacccgagaaaataaccaacaactcgatctcacattactcatgcgcaagttagcagaaaatggcataaaccatatttgggttgaagccggtgctgggcttgcgggtgggctacttgaagcacaattagttgattgtttgattttatatcaggctccaaaattaatgggagcagatagtcgcagtttaatgaatttatcgccattaaccgcgatgaatcaaactatcgatctgaatattacagatatacgtatggttgattgtgatgtgaaaattacagccaccgttaaacgctgttaa

SEQ ID NO: 125 - protein, 374 aa, Photobacterium sp. SKA34
MFTNLDTRLMLRAIQLAKRGCFTTAPNPNVGCVIAIGDEILGEGFHYRAGEPHAEVFALKQAGTRAKGATAYVTLEPCSHYGRTPPCAEALIKSGISRVICAMVDPNPLVAGRGVEMLQKAGVDVQVGLLKEEAQAINKAFIKQMTTKMPYVELKLASSLDGKTALANGESKWITGPYARADVQRHRAQAGAILSTSATVIADDPSLNVRWSELGTLIQDEYAQADVRQPIRVIIDSQNRLTPAYQVFHLPGKTILARTMSGNEDWPDSVSQWIIPTRENNQQLDLTLLMRKLAENGINHIWVEAGAGLAGGLLEAQLVDCLILYQAPKLMGADSRSLMNLSPLTAMNQTIDLNITDIRMVDCDVKITATVKRC

SEQ ID NO: 126 - DNA, 1140 bp, Oceanospirillum sp. MED92
  CDS (1)..(1140): transl_table=11
gtggcaggcgcctggtcaattgcagatcatcgctacatggcacgtgccatagtattagcgaagcagggtttatatacgacaaaccctaatccccgtgttggatgtgttctggtcaaggatgaggtaattgtcggagaaggttttcactttcgtgccggtgaaggccatgctgaagtgaatgcaatggcgcaagctggagatctggctaaaggtgcgacagcctatgtgacgctggaaccttgtagtcattatggacgaacacctccttgtgcagaaggcttgattaaagccggggtgaaccgtgttgtctgtgccatggttgatccaaacccgcaggttgcagggcggggtatccagatgctcgaaagtgcgggaatttctgctgaatctgggttgttagaagctgaagccagggcgctcaatcccggatttataaagcgcatggaaacagggctcccatttgtgagcctgaaaattgcaacgagtcttgatggccgaacggcaatggcatctggtgagtcaaaatggattaccggcgccgccgctcgaagtgatgtgcagaagcttcgagcaaggagctctgcgatcttgacgggtgttgagtctattctaaccgataactcggcactgacggtcagggctgaacagcttgggttggcgcaggcagaagagatcgtcaaacagcagcctttgagggtggttctcgattctaatctcagaacgccgattgatgcgagtatcctgagccagcctggacgaacgttgattgcgacgatatccaaagatgctgttgtcattgaaaaattacaggcagccggcgctgaggttatccagatgcctgctaatcaggggcgcgtagatttagtggcgctgttaaagcacctggcaggtgaagagcagtgtaacgaactactcgtggaaaccggggcgaccctggccggtgcatttatagacgcaaagcttgttgatcaattgcatctgtatatggcgatgacattaatgggtagcagtgcgcgtccagcatttcagctacctttagctaaaatgtcagagcaggttagattaaaaagaatggatatgcgcatgctgggggacgatatgaaactgatacttaagcccctgtatggagaaaacagttag

SEQ ID NO: 127 - protein, 379 aa, Oceanospirillum sp. MED92
MAGAWSIADHRYMARAIVLAKQGLYTTNPNPRVGCVLVKDEVIVGEGFHFRAGEGHAEVNAMAQAGDLAKGATAYVTLEPCSHYGRTPPCAEGLIKAGVNRVVCAMVDPNPQVAGRGIQMLESAGISAESGLLEAEARALNPGFIKRMETGLPFVSLKIATSLDGRTAMASGESKWITGAAARSDVQKLRARSSAILTGVESILTDNSALTVRAEQLGLAQAEEIVKQQPLRVVLDSNLRTPIDASILSQPGRTLIATISKDAVVIEKLQAAGAEVIQMPANQGRVDLVALLKHLAGEEQCNELLVETGATLAGAFIDAKLVDQLHLYMAMTLMGSSARPAFQLPLAKMSEQVRLKRMDMRMLGDDMKLILKPLYGENS

SEQ ID NO: 128 - DNA, 1152 bp, Alteromonadales bacterium TW-7
  CDS (1)..(1152): transl_table=11
atgagcagccaatcagcatttaccgagcacgataagctatatatggcgcgtgctattgagcttgctaaaaaaggtcgatttaccacaacgcctaatcctaatgttggctgtgtacttgtaaaagataatcaaataataggtgaagggtttcatcaattggcagggcaaggacatgcagaggtaaatgcacttgctgtagccggcgaaaaagcacagggtgcaactgcctatgtaacacttgaaccttgtagccattacgggcgcacgcccccctgtgctgaaggacttaaggctgctggtattaaaaaggtgattgcagccatggttgataccaacccgcaagtggcaggtaaaggccttaaaatactgagtgacgccggaatagaagttgctcatgggttgcttgaacaagaggctcgcgcattaaactttggtttttttaagcgtatggagcaggggcttccttacgtaacttgtaaattagcagccagtatagacggcaaaacagcgctaaaaaacggaaaaagtaagtggatcacaggccctgatgcacgaaaagatgtgcagctataccgcgctcaaagctgtgccattttaacgggggccgatacggttcttgttgataatgcaaaactcaatgttcgaccaagtgagttaccgtattcattaccaaccaacttaccgctacgtcagccggtgcgtgttataatagactcgcaaaacagattaacacctgaccttgcgctatttaaaatagcgcacccggtaattatatttactaccaaggttgataattcaatgcagtggccgcattttgttaagcacatagcggtgcgcgagcaacagggtaaggttgatttaaccgatgtattacaaacactagcaaagcatcagtttaataatatatggctggaagctggggcaacccttgcagggaaaatgaccgagcttgatttaattgacgagtatgttttttatatcgcaccaaaactgatgggttatgatgctaaaagtttagtaaacttccctgaattgacgagtatgcaagatactatcgatttatcttttaatgagtgtgttcgtattggtgacgatttacgtatcaacgcgttaaaaacgcacgcattaaaatcatttaacaaagaagagtag

SEQ ID NO: 129 - protein, 383 aa, Alteromonadales bacterium TW-7
MSSQSAFTEHDKLYMARAIELAKKGRFTTTPNPNVGCVLVKDNQIIGEGFHQLAGQGHAEVNALAVAGEKAQGATAYVTLEPCSHYGRTPPCAEGLKAAGIKKVIAAMVDTNPQVAGKGLKILSDAGIEVAHGLLEQEARALNFGFFKRMEQGLPYVTCKLAASIDGKTALKNGKSKWITGPDARKDVQLYRAQSCAILTGADTVLVDNAKLNVRPSELPYSLPTNLPLRQPVRVIIDSQNRLTPDLALFKIAHPVIIFTTKVDNSMQWPHFVKHIAVREQQGKVDLTDVLQTLAKHQFNNIWLEAGATLAGKMTELDLIDEYVFYIAPKLMGYDAKSLVNFPELTSMQDTIDLSFNECVRIGDDLRINALKTHALKSFNKEE

SEQ ID NO: 130 - DNA, 1119 bp, Vibrio fischeri
  CDS (1)..(1119): transl_table=11
atgacatttactacccaagatcatctgatgatgcaaaaagctattttattagctaagcaaggcatttataccacagcacccaaccctaatgtgggatgtgtattggttaaagatgggaagattgttggggaaggggcgcacttaaaagcgggtgagcctcatgctgaagttcatgcattaagacaagcaggaaaagaagcgcaaggggcaacggcttatgttacgcttgaaccttgctctcattatggacgcacacctccttgcgctgaaggacttataaaagcgggcgtaaaaaaagtaatttgtgccatggttgatccaaatcctcaagttgctggtcgtggtcttgctatgttaaacgaagctggaattgaaactgcatcaggtctgcttgaagccgatgctagagccttaaaccctcattttttaactcgaatggaaactggaaaaccatttgtacagttaaaaatggcagcgagtcttgatgggaaaaccgcattaaaaaatggagtgagtcaatggatcacttcaaaagaagcaagacaagatgttcaacgttatcgtgcacaatctggtgcaatattctcaacagcgaaaacggtgattgacgataatgcctcattaaatgtgcgttggagcgatcttcctccttcaattcaagaaagctaccaacaagcggctattcgacagccaatgcgttttattttagatcgtcagcatgcattaacatccgatttaaaactgtttcaagcctctggtgaagtggttacgatctcatctcaaaacacacacccaatcgtgacttctgaaaatcatatacaatgttgtgttgatgatgatcaattgaaccttaaagaagtcgtaaataaaatttctcgtgattttaatgtaaatcatatttgggttgaggctggtgctacattagcagcaagtatgattaaagaaaatttagttgatgaattgattatttatctcgctcctaaattgatgggagcggatgggcgtagcatcattaatttaattggattagaaacgatgtctgagacaattgacttggatataaaagacatacgtatggtcggtaaagatattcgaattaccgcaacaatagcaaggtaa

SEQ ID NO: 131 - protein, 372 aa, Vibrio fischeri
MTFTTQDHLMMQKAILLAKQGIYTTAPNPNVGCVLVKDGKIVGEGAHLKAGEPHAEVHALRQAGKEAQGATAYVTLEPCSHYGRTPPCAEGLIKAGVKKVICAMVDPNPQVAGRGLAMLNEAGIETASGLLEADARALNPHFLTRMETGKPFVQLKMAASLDGKTALKNGVSQWITSKEARQDVQRYRAQSGAIFSTAKTVIDDNASLNVRWSDLPPSIQESYQQAAIRQPMRFILDRQHALTSDLKLFQASGEVVTISSQNTHPIVTSENHIQCCVDDDQLNLKEVVNKISRDFNVNHIWVEAGATLAASMIKENLVDELIIYLAPKLMGADGRSIINLIGLETMSETIDLDIKDIRMVGKDIRITATIAR

SEQ ID NO: 132 - DNA, 1167 bp, Photobacterium phosphoreum
  CDS (1)..(1167): transl_table=11
atgacacacactgatcaacaaatgatgtcgcgagcgatagcgcttgccaagcatggctgttataccaccgcacctaatccaaatgttgggtgtgtgattgtcaatgatggcgacattgtcggtgaaggttatcattatcaagccgggcaacctcatgctgaagtgtttgccttacgacaggcacagcagcgtgcacaaggtgcaacggtatatgtaaccttagagccttgctctcactatggacgcacgccaccttgtgctgaagccttaatcaatgccaaggtcgcacgggttgtctgtgctatggttgatcctaaccccgccgttgctggacgaggtattgccttattgcgagcagctggtattgaggttgatgtcggtgtcttagcatcgcaagcacaagcactcaatccaggctttattaagcaaatgtcacatcaaatgccgtatgtagagctcaaactagcggcgagtttagatggacgaacagcattagctaatggtgtcagtaaatggataaccggtcctaaagcgcgtgctgacgtacaacattttcgtgcgcaggctggagcgatcttatcaaccagtgcgacggttattgcagatgatccttcactgaatgtccgctggagtgaattagaagagtcagtacaacaagcttaccctcaatccgcattacgtcagcctatacgggttattattgatagtcagaatcgactcacgcctgaataccaactgtttcatcttccgggagagacgatccttgctcgaactgaaatcggtacagaagcgtggcctgattcagtacagcaatggcaaatccccacccaaactgatagtcatcagcttgatttagttgttttaatgtcgcggttggcaaattacggtattaatcatatttgggttgaagctggcgctcgtctggctggagcattattgcaacagcagctagttgatagtttgattttatatcaagcacctaagttgatgggcagtgatagccgtggtttgattgatatcactgggctgacagcaatgtcacaaacaccgctattaacgataactgatgttggtatgattgattgtgatattcgcattatagcaaccgtacacaataataaatcaagtagtgaaattaagggtttatcatgttcactggaattatag

SEQ ID NO: 133 - protein, 388 aa, Photobacterium phosphoreum
MTHTDQQMMSRAIALAKHGCYTTAPNPNVGCVIVNDGDIVGEGYHYQAGQPHAEVFALRQAQQRAQGATVYVTLEPCSHYGRTPPCAEALINAKVARVVCAMVDPNPAVAGRGIALLRAAGIEVDVGVLASQAQALNPGFIKQMSHQMPYVELKLAASLDGRTALANGVSKWITGPKARADVQHFRAQAGAILSTSATVIADDPSLNVRWSELEESVQQAYPQSALRQPIRVIIDSQNRLTPEYQLFHLPGETILARTEIGTEAWPDSVQQWQIPTQTDSHQLDLVVLMSRLANYGINHIWVEAGARLAGALLQQQLVDSLILYQAPKLMGSDSRGLIDITGLTAMSQTPLLTITDVGMIDCDIRIIATVHNNKSSSEIKGLSCSLEL

SEQ ID NO: 134 - DNA, 1119 bp, Haemophilus influenzae
  CDS (1)..(1119): transl_table=11
atgcttgaattttcctcacaagattgcgtatttatgcaacgtgccttagatttggcagccaaaggtcaatataccactacaccgaacccatcggtgggatgcgtattggttaaaaatggtgaaattgtgggggagggctttcattttaaggcaggacaacctcatgctgaacgcgttgccttagctcaagctggtgaaaatgctaaaggagcaaccgcttacgtcaccttagagccttgcgctcattatggtcgcacaccaccttgtgcattaggattaattgaggcgggcgtagtgaaagtcattgcggctatgcaagatccaaatcctcaagtcgcaggaaaaggtttgaaaatgttgtctgatgccggtatcgaaagtacggtgaatttattgaacgatcaagcggaaaaaataaataaaggttttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttccacaacagtcattgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgagccacgagatttaacaggctttcctgatttttgtgaacaaattatttttccgaaagaaaatttactaaaagaattaatgcgagaactgggaaaacgacaaatcaataccctttgggtagaagctggagcaaatttatcgggcagtttaattgatgcgaaattagtggatgaattgattatttacattgcgccaaaattacttggagacaatgctcgtggtctatgccaattaccgaatttaactaaacttgctgatgcaccattatggcaactcaatgaattagaacaaatcggtgacgatataaaattaacttacacaccgaaaggagtctaa

SEQ ID NO: 135 - protein, 372 aa, Haemophilus influenzae
MLEFSSQDCVFMQRALDLAAKGQYTTTPNPSVGCVLVKNGEIVGEGFHFKAGQPHAERVALAQAGENAKGATAYVTLEPCAHYGRTPPCALGLIEAGVVKVIAAMQDPNPQVAGKGLKMLSDAGIESTVNLLNDQAEKINKGFLKRMRQGMPFVQLKLAMSLDGRTAMASGESKWITGPDARSDVQKMRAKSSALLSTSTTVIADDPSLNVRWDEFPENLKTEYKKEWLRQPVRVILDSQHRIQPTHKLFLTHSPVWLVSSEPRDLTGFPDFCEQIIFPKENLLKELMRELGKRQINTLWVEAGANLSGSLIDAKLVDELIIYIAPKLLGDNARGLCQLPNLTKLADAPLWQLNELEQIGDDIKLTYTPKGV

SEQ ID NO: 136 - DNA, 24 bp, Artificial sequence
  primer
atgcaggacgagtattacatggcg

SEQ ID NO: 137 - DNA, 25 bp, Artificial sequence
  primer
ttatgcacccactaaatgcaggcaa

SEQ ID NO: 138 - protein, 384 aa, Artificial sequence
  consensus sequence
  Variant (2)..(4): Xaa in position 2 to 4 is any amino acid
  Variant (6)..(7): Xaa in position 6 to 7 is any amino acid
  Variant (9)..(10): Xaa in position 9 to 10 is any amino acid
  Variant (13)..(14): Xaa in position 13 to 14 is any amino acid
  Variant (16)..(17): Xaa in position 16 to 17 is any amino acid
  Variant (20)..(20): Xaa in position 20 is any amino acid
  Variant (24)..(24): Xaa in position 24 is any amino acid
  Variant (29)..(29): Xaa in position 29 is any amino acid
  Variant (31)..(35): Xaa in position 31 to 35 is any amino acid
  Variant (36)..(39): Xaa in position 36 to 39 is any or no amino acid
  Variant (44)..(44): Xaa in position 44 is any amino acid
  Variant (46)..(47): Xaa in position 46 to 47 is any amino acid
  Variant (50)..(50): Xaa in position 50 is any amino acid
  Variant (56)..(56): Xaa in position 56 is any amino acid
  Variant (59)..(60): Xaa in position 59 to 60 is any amino acid
  Variant (63)..(64): Xaa in position 63 to 64 is any amino acid
  Variant (65)..(68): Xaa in position 65 to 68 is any or no amino acid
  Variant (70)..(70): Xaa in position 70 is any amino acid
  Variant (84)..(84): Xaa in position 84 is any amino acid
  Variant (92)..(93): Xaa in position 92 to 93 is any amino acid
  Variant (95)..(96): Xaa in position 95 to 96 is any amino acid
  Variant (100)..(101): Xaa in position 100 to 101 is any amino acid
  Variant (103)..(104): Xaa in position 103 to 104 is any amino acid
  Variant (107)..(107): Xaa in position 107 is any amino acid
  Variant (112)..(112): Xaa in position 112 is any amino acid
  Variant (114)..(114): Xaa in position 114 is any amino acid
  Variant (116)..(116): Xaa in position 116 is any amino acid
  Variant (118)..(120): Xaa in position 118 to 120 is any amino acid
  Variant (122)..(123): Xaa in position 122 to 123 is any amino acid
  Variant (127)..(130): Xaa in position 127 to 130 is any amino acid
  Variant (132)..(136): Xaa in position 132 to 136 is any amino acid
  Variant (138)..(139): Xaa in position 138 to 139 is any amino acid
  Variant (142)..(142): Xaa in position 142 is any amino acid
  Variant (145)..(146): Xaa in position 145 to 146 is any amino acid
  Variant (149)..(150): Xaa in position 149 to 150 is any amino acid
  Variant (152)..(152): Xaa in position 152 is any amino acid
  Variant (154)..(157): Xaa in position 154 to 157 is any amino acid
  Variant (159)..(159): Xaa in position 159 is any amino acid
  Variant (161)..(161): Xaa in position 161 is any amino acid
  Variant (166)..(166): Xaa in position 166 is any amino acid
  Variant (169)..(171): Xaa in position 169 to 171 is any amino acid
  Variant (173)..(173): Xaa in position 173 is any amino acid
  Variant (175)..(175): Xaa in position 175 is any amino acid
  Variant (179)..(181): Xaa in position 179 to 181 is any amino acid
  Variant (184)..(185): Xaa in position 184 to 185 is any amino acid
  Variant (188)..(189): Xaa in position 188 to 189 is any amino acid
  Variant (192)..(196): Xaa in position 192 to 196 is any amino acid
  Variant (198)..(201): Xaa in position 198 to 201 is any amino acid
  Variant (205)..(205): Xaa in position 205 is any amino acid
  Variant (207)..(209): Xaa in position 207 to 209 is any amino acid
  Variant (211)..(211): Xaa in position 211 is any amino acid
  Variant (214)..(220): Xaa in position 214 to 220 is any amino acid
  Variant (221)..(232): Xaa in position 221 to 232 is any or no amino acid
  Variant (234)..(234): Xaa in position 234 is any amino acid
  Variant (236)..(238): Xaa in position 236 to 238 is any amino acid
  Variant (240)..(277): Xaa in position 240 to 277 is any amino acid
  Variant (278)..(304): Xaa in position 278 to 304 is any or no amino acid
  Variant (306)..(311): Xaa in position 306 to 311 is any amino acid
  Variant (313)..(316): Xaa in position 313 to 316 is any amino acid
  Variant (317)..(318): Xaa in position 317 to 318 is any or no amino acid
  Variant (320)..(323): Xaa in position 320 to 323 is any amino acid
  Variant (327)..(328): Xaa in position 327 to 328 is any amino acid
  Variant (330)..(330): Xaa in position 330 is any amino acid
  Variant (332)..(337): Xaa in position 332 to 337 is any amino acid
  Variant (342)..(344): Xaa in position 342 to 344 is any amino acid
  Variant (346)..(346): Xaa in position 346 is any amino acid
  Variant (348)..(351): Xaa in position 348 to 351 is any amino acid
  Variant (353)..(355): Xaa in position 353 to 355 is any amino acid
  Variant (357)..(357): Xaa in position 357 is any amino acid
  Variant (359)..(380): Xaa in position 359 to 380 is any amino acid
  Variant (381)..(381): Xaa in position 381 is any or no amino acid
  Variant (383)..(383): Xaa in position 383 is any amino acid
DXXXMXXAXXLAXXGXXTTXPNPXVGCVXVXXXXXXXXXVGEGXHXXAGXPHAEVXALXXAGXXXXXXAXGATAYVTLEPCSHXGRTPPCAXXLXXAGVXXVXXAMXDPNPXVXGXGXXXLXXAGIXXXXGXXXXXAXXLNXGFXXRMXXGXPXXXXKXAXSLDGXTAXXXGXSXWITXXXARXXVQXXRAXXXXXLXXXXTVLXDXXXLXVRXXXXXXXXXXXXXXXXXXXPXRXXXDXXXXXXXXXXXXXXXXXXXXXXXXXXXXXXXXXXXXXXXXXXXXXXXXXXXXXXXXXXXXXXXXXLXXXXXXLXXXXXXNXXXXEAGXXLXGXXXXXXLVDEXXXYXAXXXXGXXXRXLXXXXXXXXXXXXXXXXXXXXXXXGXD

SEQ ID NO: 139 - protein, 43 aa, Artificial sequence
  protein pattern
  Variant (12)..(12): Xaa in position 12 is Ala or Ser
  Variant (14)..(14): Xaa in position 14 is any amino acid
  Variant (21)..(22): Xaa in position 21 to 22 is any or no amino acid
  Variant (24)..(25): Xaa in position 24 to 25 is any or no amino acid
  Variant (27)..(30): Xaa in position 27 to 30 is any amino acid
  Variant (31)..(31): Xaa in position 31 is Ile, Leu or Val
  Variant (32)..(33): Xaa in position 32 to 33 is any amino acid
  Variant (35)..(35): Xaa in position 35 is Ile or Val
  Variant (36)..(36): Xaa in position 36 is Ala, Cys, Ser or Val
  Variant (37)..(37): Xaa in position 37 is Ala or Ser
  Variant (38)..(38): Xaa in position 38 is Met or Val
  Variant (39)..(39): Xaa in position 39 is any amino acid
  Variant (41)..(41): Xaa in position 41 is Pro or Thr
  Variant (42)..(42): Xaa in position 42 is any amino acid
GATAYVTLEPCXHXGRTPPCXXAXXLXXXXXXXVXXXXXDXXP

SEQ ID NO: 140 - protein, 57 aa, Artificial sequence
  protein pattern
  Variant (3)..(4): Xaa in position 3 to 4 is any amino acid
  Variant (6)..(6): Xaa in position 6 is Ile, Met or Val
  Variant (7)..(8): Xaa in position 7 to 8 is any amino acid
  Variant (9)..(9): Xaa in position 9 is Ala, Asp, Gly or Gln
  Variant (10)..(10): Xaa in position 10 is any amino acid
  Variant (12)..(12): Xaa in position 12 is Phe, Trp or Tyr
  Variant (13)..(13): Xaa in position 13 is Ile, Leu or Val
  Variant (14)..(15): Xaa in position 14 to 15 is any amino acid
  Variant (17)..(17): Xaa in position 17 is any amino acid
  Variant (18)..(18): Xaa in position 18 is Ala or Gly
  Variant (19)..(19): Xaa in position 19 is any amino acid
  Variant (21)..(21): Xaa in position 21 is Phe, Ile, Leu or Val
  Variant (24)..(24): Xaa in position 24 is any amino acid
  Variant (26)..(26): Xaa in position 26 is Ala or Gly
  Variant (27)..(27): Xaa in position 27 is Leu or Met
  Variant (28)..(28): Xaa in position 28 is any amino acid
  Variant (29)..(29): Xaa in position 29 is Asn, Ser or Thr
  Variant (31)..(31): Xaa in position 31 is any amino acid
  Variant (33)..(33): Xaa in position 33 is any amino acid
  Variant (36)..(36): Xaa in position 36 is Ser or Thr
  Variant (37)..(37): Xaa in position 37 is Gly or Ser
  Variant (38)..(39): Xaa in position 38 to 39 is any amino acid
  Variant (40)..(40): Xaa in position 40 is Ala or Ser
  Variant (42)..(43): Xaa in position 42 to 43 is any amino acid
  Variant (44)..(44): Xaa in position 44 is Gly or Val
  Variant (45)..(47): Xaa in position 45 to 47 is any amino acid
  Variant (49)..(49): Xaa in position 49 is Ala, Ile or Leu
  Variant (50)..(50): Xaa in position 50 is any amino acid
  Variant (51)..(51): Xaa in position 51 is Ala, Cys, Ser or Val
  Variant (52)..(52): Xaa in position 52 is any amino acid
  Variant (53)..(53): Xaa in position 53 is Ala or Val
  Variant (54)..(54): Xaa in position 54 is Ile, Leu, Met or Val
  Variant (55)..(55): Xaa in position 55 is Ile, Leu or Val
  Variant (56)..(56): Xaa in position 56 is Ser or Thr
  Variant (57)..(57): Xaa in position 57 is Gly, Ser or Thr
GFXXRXXXXXPXXXXKXXXSXDGXTXXXXGXSXWIXXXXXRXXXXXXRXXXXXXXXX

SEQ ID NO: 141 - protein, 28 aa, Artificial sequence
  protein pattern
  Variant (2)..(2): Xaa in position 2 is Ala, Glu, Gln or Ser
  Variant (3)..(3): Xaa in position 3 is any amino acid
  Variant (5)..(6): Xaa in position 5 to 6 is any or no amino acid
  Variant (8)..(9): Xaa in position 8 to 9 is any or no amino acid
  Variant (11)..(12): Xaa in position 11 to 12 is any amino acid
  Variant (14)..(14): Xaa in position 14 is any amino acid
  Variant (15)..(15): Xaa in position 15 is Phe or Tyr
  Variant (16)..(16): Xaa in position 16 is Ser or Thr
  Variant (18)..(18): Xaa in position 18 is any amino acid
  Variant (22)..(22): Xaa in position 22 is any amino acid
  Variant (27)..(27): Xaa in position 27 is Ile or Leu
MXXAXXLXXAXXGXXXTXPNPXVGCVXV

SEQ ID NO: 142 - protein, 41 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is any or no amino acid
  Variant (9)..(9): Xaa in position 9 is Ala, Cys or Thr
  Variant (11)..(12): Xaa in position 11 to 12 is any amino acid
  Variant (14)..(14): Xaa in position 14 is Ala, Cys, Gly, Asn or Ser
  Variant (15)..(15): Xaa in position 15 is Ala, Gly, Gln or Ser
  Variant (16)..(16): Xaa in position 16 is Ala, Gly or Ser
  Variant (17)..(17): Xaa in position 17 is Phe, Leu or Met
  Variant (18)..(21): Xaa in position 18 to 21 is any amino acid
  Variant (22)..(22): Xaa in position 22 is Leu or Val
  Variant (23)..(23): Xaa in position 23 is Ala or Val
  Variant (25)..(28): Xaa in position 25 to 28 is any amino acid
  Variant (29)..(29): Xaa in position 29 is Phe or Tyr
  Variant (30)..(30): Xaa in position 30 is any amino acid
  Variant (32)..(34): Xaa in position 32 to 34 is any amino acid
  Variant (35)..(35): Xaa in position 35 is Ile, Leu, Met or Val
  Variant (37)..(37): Xaa in position 37 is any amino acid
  Variant (38)..(38): Xaa in position 38 is Ala, Asp, Glu, Gly, Asn, Gln, Ser or Thr
  Variant (39)..(39): Xaa in position 39 is Ala, Gly or Ser
  Variant (40)..(40): Xaa in position 40 is any amino acid
  Variant (41)..(41): Xaa in position 41 is Ala, Asp, Gly, Asn, Pro or Ser
NXXXVXXEXGXXLXXXXXXXXXXDXXXXXXAXXXXGXXXXX

SEQ ID NO: 143 - protein, 23 aa, Artificial sequence
  protein pattern
  Variant (2)..(2): Xaa in position 2 is any amino acid
  Variant (4)..(4): Xaa in position 4 is any amino acid
  Variant (6)..(6): Xaa in position 6 is any amino acid
  Variant (7)..(7): Xaa in position 7 is Lys or Arg
  Variant (10)..(10): Xaa in position 10 is Asp, Glu, Gly, Gln or Thr
  Variant (15)..(16): Xaa in position 15 to 16 is any amino acid
  Variant (18)..(18): Xaa in position 18 is Leu or Met
  Variant (19)..(20): Xaa in position 19 to 20 is any amino acid
  Variant (22)..(22): Xaa in position 22 is any or no amino acid
GXGXHXXAGXPHAEXXAXXXAXG

SEQ ID NO: 144 - protein, 14 aa, Artificial sequence
  protein pattern
  Variant (2)..(2): Xaa in position 2 is Ile or Leu
  Variant (3)..(3): Xaa in position 3 is Ala, Asp, Thr or Val
  Variant (5)..(5): Xaa in position 5 is any amino acid
  Variant (6)..(6): Xaa in position 6 is Ala or Pro
  Variant (7)..(7): Xaa in position 7 is any amino acid
  Variant (8)..(8): Xaa in position 8 is Leu or Met
  Variant (9)..(9): Xaa in position 9 is Ala, Asp, Asn or Thr
  Variant (10)..(10): Xaa in position 10 is Leu or Val
  Variant (12)..(13): Xaa in position 12 to 13 is any amino acid
  Variant (14)..(14): Xaa in position 14 is Asp, Glu, Gly, Gln or Thr
VXXDXXXXXXRXXX

SEQ ID NO: 145 - protein, 20 aa, Artificial sequence
  protein pattern
  Variant (2)..(2): Xaa in position 2 is any or no amino acid
  Variant (4)..(4): Xaa in position 4 is any or no amino acid
  Variant (6)..(6): Xaa in position 6 is Ile, Leu or Val
  Variant (7)..(8): Xaa in position 7 to 8 is any amino acid
  Variant (10)..(11): Xaa in position 10 to 11 is any amino acid
  Variant (14)..(14): Xaa in position 14 is Ile or Val
  Variant (15)..(15): Xaa in position 15 is Ala, Asp, Glu, Gly, Gln or Thr
  Variant (16)..(16): Xaa in position 16 is Ala, Ser, Thr or Val
  Variant (17)..(18): Xaa in position 17 to 18 is any amino acid
  Variant (19)..(19): Xaa in position 19 is Gly or Asn
  Variant (20)..(20): Xaa in position 20 is Leu or Val
VXGXGXXXLXXAGXXXXXXX

SEQ ID NO: 146 - protein, 11 aa, Artificial sequence
  protein pattern
  Variant (2)..(2): Xaa in position 2 is any amino acid
  Variant (4)..(4): Xaa in position 4 is Ile or Val
  Variant (5)..(6): Xaa in position 5 to 6 is Ile, Leu or Val
  Variant (8)..(8): Xaa in position 8 is Ala, Gly or Ser
  Variant (9)..(10): Xaa in position 9 to 10 is any amino acid
  Variant (11)..(11): Xaa in position 11 is Glu, Gln or Arg
PXRXXXDXXXX

SEQ ID NO: 147 - DNA, 990 bp, Escherichia coli
  CDS (1)..(990): transl_table=11
atggggttaccaagcggatattcagcgggctacagctacgaatattttggcggcaatgccacttatatgattattcccgaaatcgccattaatttgggctgcgtattaccgtatcacggctcttattttgctgcggcgtcgctggcagagcctatgtgctgcattattggtgcttatcatgccaattatcacaccacgcaatatgtttatgagcatcgcatgggcgtcaaacctggcggcaatattgcactgctggcgtgtgcaggtccgatgggcattggcgctatcgattacgccattaacggcggcatacaaccgtcgcgggtggtggtggtcgatatcgacgacaaacgtctggcgcaggtacagaagctgctgccggtggaactggcggccagtaaaggcattgagctggtgtatgtgaataccaaagggatgagcgatcctgtccagatgctgcgggcgctgacaggagatgccgggttcgatgacatttttgtttatgcggcggtgcctgctgtcgttgagatggctgatgaattactggcggaagatggctgtctgaacttctttgccgggccgacggataaaaacttcaaagtgccgtttaatttctacaacgtccattacaacagcacgcacgtcgtcggtacatctggcggttcaacggacgacatgaaagaggcgattgcccttagcgccactgggcagttacagccgtcgtttatggtgacccatatcggtggcctggatgcggtgccagaaaccgtgctcaatctgccggatatccctggcggtaaaaaactcatttataacggcgtgaccatgccgctcactgccattgccgattttgccgaaaaaggcaaaaccgatccgctgtttaaagagttggcgcggctggttgaggaaacgcacggcatctggaatgaacaggccgagaaatatctgctggcacaatttggcgttgatatcggggaggccgcgcaataa

SEQ ID NO: 148 - protein, 329 aa, Escherichia coli
MGLPSGYSAGYSYEYFGGNATYMIIPEIAINLGCVLPYHGSYFAAASLAEPMCCIIGAYHANYHTTQYVYEHRMGVKPGGNIALLACAGPMGIGAIDYAINGGIQPSRVVVVDIDDKRLAQVQKLLPVELAASKGIELVYVNTKGMSDPVQMLRALTGDAGFDDIFVYAAVPAVVEMADELLAEDGCLNFFAGPTDKNFKVPFNFYNVHYNSTHVVGTSGGSTDDMKEAIALSATGQLQPSFMVTHIGGLDAVPETVLNLPDIPGGKKLIYNGVTMPLTAIADFAEKGKTDPLFKELARLVEETHGIWNEQAEKYLLAQFGVDIGEAAQ

SEQ ID NO: 149 - DNA, 1242 bp, Escherichia coli O157:H7 EDL933
  CDS (1)..(1242): transl_table=11
atgaggtggtttatgaaaacaacagctctgcgtctttatggtaaacgtgatttacgcctggaaacctttgaccttcctgaaatgcaggaggatgaaatcctcgcgacggtggtcactgacagcctgtgcctctcttcctggaaagaggccaatctgggtgaaaaccataaaaaagtacccgacgatgtggcgaccaacccaatcatcatcggccacgagttttgcggcgatattctggccgtgggtaaaaagtggcagcacaaattccagccgggtcagcgttatgtgattcaggccaacctgcaactccccgaccgcccggactgccccggctactccttcccgtgggtaggcggcgaggccacgcatgtggttattcccaacgaggtcatggaacaagattgcctgctggcatacgacggcgaaacctattttgaaggctcgctggttgaaccgctttcctgcgtgattggcgcgttcaacgccaactatcatcttcaggaaggtagttataaccacacgatggggattcgcccgcaagggcgcatgctgatcctcggcggcaccggaccaatgggactgttggcgattgattatgcgctacatggacccgttaacccgtcgctgctcgtcattaccgataccgacaacgataaattgagttatgcgcgcaagcactatccatcagaaccgcaaacactgattcattatctcaatgccgccgatgcagcatttgatacgctaatggcgctgagtggcggtcacggcttcgatgatattttcgtctttgtgcctaatgaaggactggtgactctcgcctcttccttgctggcgacagatggttgcctgaatttcttcgccggaccgcaggataaacatttcagcgcgccaattaatttctacgatgtgcattatgcatttacccactacgtgggcacgtcaggcggcaataccgacgacatgcgcgcagcggtcaaattgattgaagagaaaaaagtgcaggccgcaaaagtggtaacacatattcttgggctgaatgccgcgggcgaaaccacgcttgaattgcctgccgtcggcggcggcaaaaagctggtgtataccgggaaatacctgccgctgacgtcactcacgcagattcaggatcaagcactggcggcgattctggcgcgtcatcaggggatctggtccggtgaggcggagcaatatctgctcactcatgcagaggcaatttcccatgattaa

SEQ ID NO: 150 - protein, 413 aa, Escherichia coli O157:H7 EDL933
MRWFMKTTALRLYGKRDLRLETFDLPEMQEDEILATVVTDSLCLSSWKEANLGENHKKVPDDVATNPIIIGHEFCGDILAVGKKWQHKFQPGQRYVIQANLQLPDRPDCPGYSFPWVGGEATHVVIPNEVMEQDCLLAYDGETYFEGSLVEPLSCVIGAFNANYHLQEGSYNHTMGIRPQGRMLILGGTGPMGLLAIDYALHGPVNPSLLVITDTDNDKLSYARKHYPSEPQTLIHYLNAADAAFDTLMALSGGHGFDDIFVFVPNEGLVTLASSLLATDGCLNFFAGPQDKHFSAPINFYDVHYAFTHYVGTSGGNTDDMRAAVKLIEEKKVQAAKVVTHILGLNAAGETTLELPAVGGGKKLVYTGKYLPLTSLTQIQDQALAAILARHQGIWSGEAEQYLLTHAEAISHD

SEQ ID NO: 151 - DNA, 1230 bp, Shigella flexneri 2a str. 301
  CDS (1)..(1230): transl_table=11
atgaaaacaacagctctgcgtctttatggtaaacgtgatttacgcctggaaacctttgaccttcctgaaatgcaggaggatgaaatcctcgcaacggtggtcactgacagcctgtgcctctcttcctggaaagaggccaatctgggtgaaaaccataaaaaagtacccgacgatgtgacgaccaacccaatcatcatcggccacgaattttgcggcgatattctggccgtgggtaaaaagtggcagcacaaattccagccgggtcagcgttatgtgattcaggccaacctgcaactccccgaccgcccggattgccccggctactccttcccgtgggtagacggcgaagcgacgcatgtggttattcccaacgaggtcatggaacaatattgcctgctggcatacgacggcgaaacctattttgaaggctcactggttgaaccgctttcctgcgtgattggcgcgttcaacgccaactatcatcttcaggaaggtagttataaccacacgatggggattcgcccgcaagggcacacgctgatcctcggcggcaccggaccaatgggactgttggcgattgattatgcgctgcatggaccagttaacccgtcgctgctcgtcattaccgataccgacaacgacaaattgagttatgcgcgcaagcactatccatcagaaccgcaaacactgattcattatctcaatgccaccgatgcagcatttgatacgttaatggcgctgagtggcggtcacggcttcgatgatattttcgtctttgtgcctaatgaaggactggtgactctcgcctcttccttgctggcgacagatggttgcctgaatttcttcgccggaccgcaggataaacatttcagcgcgccaattaatttctacgatgtgcattatgcatttacccactacgtgggcacgtcaggcggcaataccgacgacatgcgcgcggcggtcaaactgatcgaagagaaaaaagtgcaggccgcaaaagtggtaacacatattcttgggctgaatgccgcgggcgaaaccacgcttgaattgcctgccgtcggcggcggcaaaaagctggtgtataccgggaaatacctgccgctgacgtcactcacgcagattcaggatcaagcactgtcggcgattctggcgcgtcatcaggggatctggtccggtgaggtggagcaatacctgctcgcccatgcagaggcaatttcccatgattaa

SEQ ID NO: 152 - protein, 409 aa, Shigella flexneri 2a str. 301
MKTTALRLYGKRDLRLETFDLPEMQEDEILATVVTDSLCLSSWKEANLGENHKKVPDDVTTNPIIIGHEFCGDILAVGKKWQHKFQPGQRYVIQANLQLPDRPDCPGYSFPWVDGEATHVVIPNEVMEQYCLLAYDGETYFEGSLVEPLSCVIGAFNANYHLQEGSYNHTMGIRPQGHTLILGGTGPMGLLAIDYALHGPVNPSLLVITDTDNDKLSYARKHYPSEPQTLIHYLNATDAAFDTLMALSGGHGFDDIFVFVPNEGLVTLASSLLATDGCLNFFAGPQDKHFSAPINFYDVHYAFTHYVGTSGGNTDDMRAAVKLIEEKKVQAAKVVTHILGLNAAGETTLELPAVGGGKKLVYTGKYLPLTSLTQIQDQALSAILARHQGIWSGEVEQYLLAHAEAISHD

SEQ ID NO: 153 - DNA, 1230 bp, Escherichia coli CFT073
  CDS (1)..(1230): transl_table=11
atgaaaacaacagctctgcgtctttatggcaaacgtgacctgcgtctggaaacctttgaccttcctgaaatgcaggaggatgaaatcctcgcaacggtggtcactgacagcctgtgcctctcttcctggaaagaggccaatctgggtgaaaaccataaaaaagtacccgacgatgtggcgaccaatcccatcatcatcggccacgaattttgcggcgatattctggccgtgggtaaaaagtggcagcacaaattccagccgggtcagcgttatgtgattcaggccaacctgcaactccccgaccgcccggattgccccggctactccttcccgtgggtaggcggcgaagcgacgcatgtggttattcccaacgaggtcatggaacaagattgcctgctggcatacgacggcgaaacctattttgaaggctcgctggttgaaccgctttcctgcgtgattggcgcgttcaacgccaactatcatcttcaggaaggtagttataaccacacgatggggattcgcccgcaagggcgcacgctgatcctcggcggcaccggcccgatggggctgctggcgattgattatgcgttgcatggaccggttaacccgtcgctgctcgtcattaccgataccgacaacgacaaattgagttatgcacgcaagcactatccatcagaaccgcaaacactgattcattatctcaatgccgccgatgcagcatttgatacgttaatggcactgagtggcggtcacggcttcgatgatattttcgtctttgtgcctaatgaaggactggtgactctcgcctcttccttgctggcaacagatggttgtctgaatttcttcgccggaccgcaggataagcacttcagcgcgccaattaatttctacgatgtgcattatgcatttacccactacgtgggcacgtcaggcggcaatatcgacgacatgcgcgcagcggtcaaattgattgaagagaaaaaagtgcaggccgcaaaagtggtaacacatattcttgggctgaatgccgcgggcgaaaccacgcttgaattgcctgccgtcggcggcggcaaaaagctggtgtataccgggaaattcctgccgctgacgtcactcacgcagattcaggatcaagcactggcggcgattctggcgcgtcatcaggggatctggtccggtgaggcggagcaatacctgctcgcccatgcagaggcaatttcccatgattaa

SEQ ID NO: 154 - protein, 409 aa, Escherichia coli CFT073
MKTTALRLYGKRDLRLETFDLPEMQEDEILATVVTDSLCLSSWKEANLGENHKKVPDDVATNPIIIGHEFCGDILAVGKKWQHKFQPGQRYVIQANLQLPDRPDCPGYSFPWVGGEATHVVIPNEVMEQDCLLAYDGETYFEGSLVEPLSCVIGAFNANYHLQEGSYNHTMGIRPQGRTLILGGTGPMGLLAIDYALHGPVNPSLLVITDTDNDKLSYARKHYPSEPQTLIHYLNAADAAFDTLMALSGGHGFDDIFVFVPNEGLVTLASSLLATDGCLNFFAGPQDKHFSAPINFYDVHYAFTHYVGTSGGNIDDMRAAVKLIEEKKVQAAKVVTHILGLNAAGETTLELPAVGGGKKLVYTGKFLPLTSLTQIQDQALAAILARHQGIWSGEAEQYLLAHAEAISHD

SEQ ID NO: 155 - DNA, 1272 bp, Vibrio parahaemolyticus RIMD 2210633
  CDS (1)..(1272): transl_table=11
atggtaaaaacaacggcagcggttatctgtggtgagaaaaacgttcaattaagaacctttgatttaccaaacatttcagccgacgaacttctggttaaaaacatttcaaacagcatttgtctatccacttacaaagcagcattgttaggtagcaaacacaaacgcgttcctgaaaacattgacgaagtgccagtgatgacaggtcatgaatacgcaggtgtgattgttgaagtcggtgagaatctaaaagatcaattcaaagctggtgactactttgttttgcaacctgccatgggcttgccaacaggctactcagcaggctacagctatgagacatttggtggcaacgcgacgtattccgttattcctaaaatcgctatcgacctaggttgcgtactgccttaccacggcgattactttgctgatgcgtctctggctgagccaatgtcttgcattattggtgcgtaccacgcgagctaccacaccacgcaatacgtgtacgagcacgatatgggcattaaagaaggtggtgcgttagcgcttttggcgtgtgctggcccaatggggattggtgcaattgactacgcgatcaacggccctgtaaagccaaaactgatcgtggtgacggacatcgacgctgcgcgtttagaccgagctgaaagtctcattcccgttgcaaaagctaaagagcagggcgtagaactgcactacgtgaataccgctcaaatagacgatccggtcgcgtatctcaaagcactcaacggtggcaaaggctacgacgatgtaatggtctacgcggcggttgctcaagtgctagaacaagccgatgagctacttggcaatgatggctgcctcaacttctttgctggcccaacggataagaatttcaaagtgccgtttaacttctacaacgtgcattacgaatcaacccatattgtagggacgtccggtggttcaaagggtgacatggtggaatctatagagctttcctcgcaaggcaagatcaatccgtctttcatgatcacacatgttggtggcttacaagctgcgccacatacgattctgaatcaattggatattccgggcggtaagaagttgatttacccacatattgacctgccattgacggcgattgatgactttttatcgttggcagaccaagacccgttcttttcggaactcgatgcgattttgtgcgcgaacaactatgtgtggaacgcgcatgcagaaaaagcgttacttgagttttatgacgtgagcttaacggtttag

SEQ ID NO: 156 - protein, 423 aa, Vibrio parahaemolyticus RIMD 2210633
MVKTTAAVICGEKNVQLRTFDLPNISADELLVKNISNSICLSTYKAALLGSKHKRVPENIDEVPVMTGHEYAGVIVEVGENLKDQFKAGDYFVLQPAMGLPTGYSAGYSYETFGGNATYSVIPKIAIDLGCVLPYHGDYFADASLAEPMSCIIGAYHASYHTTQYVYEHDMGIKEGGALALLACAGPMGIGAIDYAINGPVKPKLIVVTDIDAARLDRAESLIPVAKAKEQGVELHYVNTAQIDDPVAYLKALNGGKGYDDVMVYAAVAQVLEQADELLGNDGCLNFFAGPTDKNFKVPFNFYNVHYESTHIVGTSGGSKGDMVESIELSSQGKINPSFMITHVGGLQAAPHTILNQLDIPGGKKLIYPHIDLPLTAIDDFLSLADQDPFFSELDAILCANNYVWNAHAEKALLEFYDVSLTV

SEQ ID NO: 157 - DNA, 1230 bp, Shigella flexneri 2a str. 2457T
  CDS (1)..(1230): transl_table=11
atgaaaacaacagctctgcgtctttatggtaaacgtgatttacgcctggaaacctttgaccttcctgaaatgcaggaggatgaaatcctcgcaacggtggtcactgacagcctgtgcctctcttcctggaaagaggccaatctgggtgaaaaccataaaaaagtacccgacgatgtgacgaccaacccaatcatcatcggccacgaattttgcggcgatattctggccgtgggtaaaaagtggcagcacaaattccagccgggtcagcgttatgtgattcaggccaacctgcaactccccgaccgcccggattgccccggctactccttcccgtgggtagacggcgaagcgacgcatgtggttattcccaacgaggtcatggaacaatattgcctgctggcatacgacggcgaaacctattttgaaggctcactggttgaaccgctttcctgcgtgattggcgcgttcaacgccaactatcatcttcaggaaggtagttataaccacacgatggggattcgcccgcaagggcacacgctgatcctcggcggcaccggaccaatgggactgttggcgattgattatgcgctgcatggaccagttaacccgtcgctgctcgtcattaccgataccgacaacgacaaattgagttatgcgcgcaagcactatccatcagaaccgcaaacactgattcattatctcaatgccaccgatgcagcatttgatacgttaatggcgctgagtggcggtcacggcttcgatgatattttcgtctttgtgcctaatgaaggactggtgactctcgcctcttccttgctggcgacagatggttgcctgaatttcttcgccggaccgcaggataaacatttcagcgcgccaattaatttctacgatgtgcattatgcatttacccactacgtgggcacgtcaggcggcaataccgacgacatgcgcgcggcggtcaaactgatcgaagagaaaaaagtgcaggccgcaaaagtggtaacacatattcttgggctgaatgccgcgggcgaaaccacgcttgaattgcctgccgtcggcggcggcaaaaagctggtgtataccgggaaatacctgccgctgacgtcactcacgcagattcaggatcaagcactggcggcgattctggcgcgtcatcaggggatctggtccggtgaggtggagcaatacctgctcgcccatgcagaggcaatttcccatgattaa

SEQ ID NO: 158 - protein, 409 aa, Shigella flexneri 2a str. 2457T
MKTTALRLYGKRDLRLETFDLPEMQEDEILATVVTDSLCLSSWKEANLGENHKKVPDDVTTNPIIIGHEFCGDILAVGKKWQHKFQPGQRYVIQANLQLPDRPDCPGYSFPWVDGEATHVVIPNEVMEQYCLLAYDGETYFEGSLVEPLSCVIGAFNANYHLQEGSYNHTMGIRPQGHTLILGGTGPMGLLAIDYALHGPVNPSLLVITDTDNDKLSYARKHYPSEPQTLIHYLNATDAAFDTLMALSGGHGFDDIFVFVPNEGLVTLASSLLATDGCLNFFAGPQDKHFSAPINFYDVHYAFTHYVGTSGGNTDDMRAAVKLIEEKKVQAAKVVTHILGLNAAGETTLELPAVGGGKKLVYTGKYLPLTSLTQIQDQALAAILARHQGIWSGEVEQYLLAHAEAISHD

SEQ ID NO: 159 - DNA, 1272 bp, Vibrio sp. Ex25
  CDS (1)..(1272): transl_table=11
atggtacaaacaacggcagcggttatctgtggtgagaaaaacgttcaattaagaacctttgatttaccaaacatttcagccgacgaacttctggttaaaaacatttcaaacagcatttgtctatccacttacaaagcagcattgttaggtagcaaacacaaacgcgttcctgaaaacattgacgaagtgccagtaatgacaggtcatgaatacgcaggtgtgattgttgaagtcggtgagaatctaaaagatcaattcaaagctggtgactactttgttttgcaacctgccatgggcttgccaacaggctactcggcgggctacagctatgagacatttggcggtaacgcgacgtattccattattcctaaaatcgctatcgacctaggctgcgtgctgccttaccacggcgattactttgctgatgcgtcgctggctgagccaatgtcttgcattatcggtgcgtaccatgcgagctaccacaccacgcaatacgtgtacgagcacgatatgggcattaaagaaggtggtgcgttagcgcttttggcgtgtgctggaccaatggggattggcgcgattgattacgcgattaacggacctgtgaagccaaaactgattgtggtgacagacatcgacgctgcacgtttagaccgagcagagtgcttaattccggttgagaaagcaaaagagcagggcgttgaactgcattacgtgaacaccgctcaagtcgatgaccctgtgacttatctgaaagcgctgaacgatggcaaaggttacgacgatgtgatggtgtatgcagcggtatcgcaagtgctagaacaagccgatgagctgttgggtaacgatggctgtctaaacttcttcgcaggccctaccgataagaaattcaaagtaccgtttaacttctacaacgtgcattacgaatcaacgcacattgtgggcacgtctggcggctcgaccggtgacatggtggaatctatcgagttgtcttcacaaggtaagatcaatccatcgttcatgatcacgcacgttggtggtctgcaagctgcgccacatacgattctgaatcagctggatattccgggtgggaagaagttgatttacccacatatcgacctgccattgaccgcgattgatgatttcctatcgttggcagaccaagacccgttcttcgccgaattagacgcaattttgaacgcgaataactatgtgtggaacgcacaggcagaaaaagcgttacttgagttttatgacgtgagcttaacggtttag

SEQ ID NO: 160 - protein, 423 aa, Vibrio sp. Ex25
MVQTTAAVICGEKNVQLRTFDLPNISADELLVKNISNSICLSTYKAALLGSKHKRVPENIDEVPVMTGHEYAGVIVEVGENLKDQFKAGDYFVLQPAMGLPTGYSAGYSYETFGGNATYSIIPKIAIDLGCVLPYHGDYFADASLAEPMSCIIGAYHASYHTTQYVYEHDMGIKEGGALALLACAGPMGIGAIDYAINGPVKPKLIVVTDIDAARLDRAECLIPVEKAKEQGVELHYVNTAQVDDPVTYLKALNDGKGYDDVMVYAAVSQVLEQADELLGNDGCLNFFAGPTDKKFKVPFNFYNVHYESTHIVGTSGGSTGDMVESIELSSQGKINPSFMITHVGGLQAAPHTILNQLDIPGGKKLIYPHIDLPLTAIDDFLSLADQDPFFAELDAILNANNYVWNAQAEKALLEFYDVSLTV

SEQ ID NO: 161 - DNA, 1239 bp, Lactobacillus casei
  CDS (1)..(1239): transl_table=11
atgcaaagcacagcattacgaatttacggtaagaaggatcttcgaattgacacctttgaccttcctgagatgaaggacgatgaaattcttgcaactgttgtgagcgacacgatgtgtatgtcatcatggaaacttgcaatggagggtgaagatcataagaagacaccagatgacttggcccataatccagcagtacttggccatgagttttctgggaagattttaaaagtgggtaaaaagtggcaatcaaagtttcatgccggccaaaactacgtgattcaaccaaatttggctcgtcaagatacgccgtttgttcctggatactcatacccatatattggcggggatgccacaaagattatcatccctgatgaagtaatgacgatgggctgcctaattccatttgaaggcgatgcttattatgagggctccttatgcgaaccagtaagttgcgtcatcgcagcatttagagcacagtaccatgttaacttccactcttatcaaccaaccacagggattaaagagggtggcaatatgttaatcatgggcggcacaggcccgatggggttgctggctattgattatgcattacatggtccaaagaagccatctacgcttgttgtgacggacgtcaatcaggacaaactggatcgcgcaaagaaactgtacccatctgattgggtagacatcaaatttgtcaacgtcaacggcttgtcaattgatgaacagaaagaagctcttctagatgcagtggatggcactgggtatgatgacgcgtttttgatgatcagcgttgcgccgttagcaactttagcagactccctgctcaatcctgacgggtgcttaaatcagttcgcaggcccaatgaagaaagacttctcagcttctgtaaatttctataacattcactataatttcactcattttgttggtacatcaggtggcgatgctaataatgaagctgaagcagcacagctaattgccgagaagaaactcgatgtctccaaagtcattacccatgttatgggtttgaatgacgcaggtgaaacgacgatgaatcaacctgaaattggcggtggaaaaaagttggtttacagtggcaaaaaattcgatcgtattgaattggcgaaagtagatcctgccacagacctaggtaaaattcttgccaagcatgacggtctgtggtcaaaagaagccgaagattggattcttgcaaatgaacctgactacgatgcttag

SEQ ID NO: 162 - protein, 412 aa, Lactobacillus casei
MQSTALRIYGKKDLRIDTFDLPEMKDDEILATVVSDTMCMSSWKLAMEGEDHKKTPDDLAHNPAVLGHEFSGKILKVGKKWQSKFHAGQNYVIQPNLARQDTPFVPGYSYPYIGGDATKIIIPDEVMTMGCLIPFEGDAYYEGSLCEPVSCVIAAFRAQYHVNFHSYQPTTGIKEGGNMLIMGGTGPMGLLAIDYALHGPKKPSTLVVTDVNQDKLDRAKKLYPSDWVDIKFVNVNGLSIDEQKEALLDAVDGTGYDDAFLMISVAPLATLADSLLNPDGCLNQFAGPMKKDFSASVNFYNIHYNFTHFVGTSGGDANNEAEAAQLIAEKKLDVSKVITHVMGLNDAGETTMNQPEIGGGKKLVYSGKKFDRIELAKVDPATDLGKILAKHDGLWSKEAEDWILANEPDYDA

SEQ ID NO: 163 - DNA, 1233 bp, Klebsiella pneumoniae
  CDS (1)..(1233): transl_table=11
atgcaaacaacaacggccctgcgcctgtatggcaaacgagacctgcgcctggaaacctttaccctcccggcgatgcaggacgatgagatcctcgcccgggtggtcacggacagcctgtgtctttcctcatggaaagaggccaatcagggtgccgatcataaaaaggtgccagatgatgtggccaccaggcccattattatcggtcatgaattctgcggcgaaatccttgccgtcggtaaaaagtggcagcataagtttcagccagggcagcgctacgtgatccaggccaacctgcagttgcccgaccgacccgactgccccggctactcattcccatggatcggtggcgaagccacccatgtggtgatccccaatgaggtgatggcgcaggattgcctgctcacctgggagggggatacctggtttgaaggatcgctggtggagccgctctcctgcgtcattggcgctttcaacgccaattatcatctgcaggaggggagttacaaccacgtgatggggatccgtccgcagggacacactctgatcctgggcgggacggggccgatggggctgctggctatcgactatgcgctgcacggccccatcaatccttcactactggtagtgaccgataccaataagccgaagctcagctacgcccgccgtcattacccctctgagccgcagacgctgatccactacctcgacggccatgaggccagtcgcgatacgctgctggcgctcagcggcggccatggcttcgacgatatcttcgtgtttgtgccaaacgaacagctgatcaccctggcctcctcgttgctggctccggacggctgcctgaatttctttgctggcccccaggataagcaattcagcgccccgatcaacttctacgacgtgcactacgccttcacccactacgtcggcacctccggcggtaatactgacgatatgcgcgccgcggtggcgctgatgcaggcgaaaaaggtccagacggcgaaagtggtcacccatattctcggcctgaacgccgcgggcgaaaccaccctcgatctgcctgccgtcggcgggggaaaaaagctggtgtataccggaaaagccttcccgctcacgccgctgggcgagatcgccgatcccgaactggcagcgattgtggcgcgtcaccatgggatctggtcccaggaggctgaagcgtatctgctggcccacgcggaggatattacgcatgattaa

SEQ ID NO: 164 - protein, 410 aa, Klebsiella pneumoniae
MQTTTALRLYGKRDLRLETFTLPAMQDDEILARVVTDSLCLSSWKEANQGADHKKVPDDVATRPIIIGHEFCGEILAVGKKWQHKFQPGQRYVIQANLQLPDRPDCPGYSFPWIGGEATHVVIPNEVMAQDCLLTWEGDTWFEGSLVEPLSCVIGAFNANYHLQEGSYNHVMGIRPQGHTLILGGTGPMGLLAIDYALHGPINPSLLVVTDTNKPKLSYARRHYPSEPQTLIHYLDGHEASRDTLLALSGGHGFDDIFVFVPNEQLITLASSLLAPDGCLNFFAGPQDKQFSAPINFYDVHYAFTHYVGTSGGNTDDMRAAVALMQAKKVQTAKVVTHILGLNAAGETTLDLPAVGGGKKLVYTGKAFPLTPLGEIADPELAAIVARHHGIWSQEAEAYLLAHAEDITHD

SEQ ID NO: 165 - DNA, 23 bp, Artificial sequence
  primer
atggggttaccaagcggatattc

SEQ ID NO: 166 - DNA, 23 bp, Artificial sequence
  primer
ttattgcgcggcctccccgatat

SEQ ID NO: 167 - protein, 413 aa, Artificial sequence
  consensus sequence
  Variant (3)..(6): Xaa in position 3 to 6 is any amino acid
  Variant (8)..(14): Xaa in position 8 to 14 is any amino acid
  Variant (17)..(17): Xaa in position 17 is any amino acid
  Variant (20)..(23): Xaa in position 20 to 23 is any amino acid
  Variant (26)..(26): Xaa in position 26 is any amino acid
  Variant (28)..(35): Xaa in position 28 to 35 is any amino acid
  Variant (37)..(37): Xaa in position 37 is any amino acid
  Variant (39)..(40): Xaa in position 39 to 40 is any amino acid
  Variant (42)..(42): Xaa in position 42 is any amino acid
  Variant (44)..(45): Xaa in position 44 to 45 is any amino acid
  Variant (47)..(48): Xaa in position 47 to 48 is any amino acid
  Variant (51)..(52): Xaa in position 51 to 52 is any amino acid
  Variant (54)..(59): Xaa in position 54 to 59 is any amino acid
  Variant (61)..(63): Xaa in position 61 to 63 is any amino acid
  Variant (67)..(68): Xaa in position 67 to 68 is any amino acid
  Variant (70)..(70): Xaa in position 70 is any amino acid
  Variant (72)..(73): Xaa in position 72 to 73 is any amino acid
  Variant (76)..(81): Xaa in position 76 to 81 is any amino acid
  Variant (83)..(84): Xaa in position 83 to 84 is any amino acid
  Variant (86)..(88): Xaa in position 86 to 88 is any amino acid
  Variant (90)..(90): Xaa in position 90 is any amino acid
  Variant (92)..(93): Xaa in position 92 to 93 is any amino acid
  Variant (94)..(95): Xaa in position 94 to 95 is any or no amino acid
  Variant (98)..(102): Xaa in position 98 to 102 is any amino acid
  Variant (103)..(103): Xaa in position 103 is any or no amino acid
  Variant (107)..(111): Xaa in position 107 to 111 is any amino acid
  Variant (113)..(113): Xaa in position 113 is any amino acid
  Variant (116)..(118): Xaa in position 116 to 118 is any amino acid
  Variant (121)..(127): Xaa in position 121 to 127 is any amino acid
  Variant (129)..(129): Xaa in position 129 is any amino acid
  Variant (131)..(133): Xaa in position 131 to 133 is any amino acid
  Variant (135)..(140): Xaa in position 135 to 140 is any amino acid
  Variant (143)..(143): Xaa in position 143 is any amino acid
  Variant (146)..(146): Xaa in position 146 is any amino acid
  Variant (149)..(149): Xaa in position 149 is any amino acid
  Variant (153)..(154): Xaa in position 153 to 154 is any amino acid
  Variant (156)..(156): Xaa in position 156 is any amino acid
  Variant (159)..(163): Xaa in position 159 to 163 is any amino acid
  Variant (165)..(165): Xaa in position 165 is any amino acid
  Variant (167)..(167): Xaa in position 167 is any amino acid
  Variant (171)..(173): Xaa in position 171 to 173 is any amino acid
  Variant (175)..(178): Xaa in position 175 to 178 is any amino acid
  Variant (180)..(182): Xaa in position 180 to 182 is any amino acid
  Variant (187)..(188): Xaa in position 187 to 188 is any amino acid
  Variant (194)..(195): Xaa in position 194 to 195 is any amino acid
  Variant (198)..(199): Xaa in position 198 to 199 is any amino acid
  Variant (201)..(203): Xaa in position 201 to 203 is any amino acid
  Variant (205)..(205): Xaa in position 205 is any amino acid
  Variant (208)..(212): Xaa in position 208 to 212 is any amino acid
  Variant (214)..(215): Xaa in position 214 to 215 is any amino acid
  Variant (217)..(220): Xaa in position 217 to 220 is any amino acid
  Variant (222)..(228): Xaa in position 222 to 228 is any amino acid
  Variant (229)..(233): Xaa in position 229 to 233 is any or no amino acid
  Variant (235)..(235): Xaa in position 235 is any amino acid
  Variant (237)..(244): Xaa in position 237 to 244 is any amino acid
  Variant (245)..(248): Xaa in position 245 to 248 is any or no amino acid
  Variant (250)..(250): Xaa in position 250 is any amino acid
  Variant (253)..(254): Xaa in position 253 to 254 is any amino acid
  Variant (256)..(256): Xaa in position 256 is any amino acid
  Variant (258)..(258): Xaa in position 258 is any amino acid
  Variant (261)..(262): Xaa in position 261 to 262 is any amino acid
  Variant (264)..(273): Xaa in position 264 to 273 is any amino acid
  Variant (275)..(276): Xaa in position 275 to 276 is any amino acid
  Variant (279)..(280): Xaa in position 279 to 280 is any amino acid
  Variant (291)..(291): Xaa in position 291 is any amino acid
  Variant (294)..(294): Xaa in position 294 is any amino acid
  Variant (296)..(297): Xaa in position 296 to 297 is any amino acid
  Variant (299)..(299): Xaa in position 299 is any amino acid
  Variant (303)..(303): Xaa in position 303 is any amino acid
  Variant (307)..(308): Xaa in position 307 to 308 is any amino acid
  Variant (311)..(311): Xaa in position 311 is any amino acid
  Variant (318)..(320): Xaa in position 318 to 320 is any amino acid
  Variant (323)..(327): Xaa in position 323 to 327 is any amino acid
  Variant (329)..(332): Xaa in position 329 to 332 is any amino acid
  Variant (334)..(340): Xaa in position 334 to 340 is any amino acid
  Variant (343)..(344): Xaa in position 343 to 344 is any amino acid
  Variant (347)..(347): Xaa in position 347 is any amino acid
  Variant (350)..(351): Xaa in position 350 to 351 is any amino acid
  Variant (353)..(353): Xaa in position 353 is any amino acid
  Variant (355)..(360): Xaa in position 355 to 360 is any amino acid
  Variant (366)..(366): Xaa in position 366 is any amino acid
  Variant (368)..(372): Xaa in position 368 to 372 is any amino acid
  Variant (376)..(384): Xaa in position 376 to 384 is any amino acid
  Variant (385)..(392): Xaa in position 385 to 392 is any or no amino acid
  Variant (394)..(395): Xaa in position 394 to 395 is any amino acid
  Variant (397)..(403): Xaa in position 397 to 403 is any amino acid
  Variant (405)..(408): Xaa in position 405 to 408 is any amino acid
  Variant (410)..(411): Xaa in position 410 to 411 is any amino acid
TAXXXXGXXXXXXXTFXLPXXXXDEXLXXXXXXXXCXSXXKXAXXGXXHKXXPXXXXXXPXXXGHEXXGXIXXVGXXXXXXFXXGXXXVXQXXXXLPXXXXXXGYSXXXXXGXATXXXIPXXXXXXXCXLXXXGXXXXXXSLXEPXSCXIGAXXAXYHXXXXXYXHXMGIXXXGXXXXLXXXGPMGXXAIDYAXXGPXXPXXXVXTDXXXXXLXXAXXXXPXXXXXXXXXXXXYXNXXXXXXXXXXXXLXALXXGXGXDDXXVXXXXXXXXXXAXXLLXXDGCLNFFAGPXDKXFXXPXNFYXVHYXXTHXVGTSGGXXXDMXXXXXLXXXXKXXXXXXXTHXXGLXAAXXTXLXXXXXXGGKKLXYXXXXXPLTXXXXXXXXXXXXXXXXXLXXIXXXXXXXWXXXXEXXLL

SEQ ID NO: 168 - protein, 61 aa, Artificial sequence
  protein pattern
  Variant (9)..(9): Xaa in position 9 is Gln or Thr
  Variant (12)..(12): Xaa in position 12 is any amino acid
  Variant (14)..(14): Xaa in position 14 is any amino acid
  Variant (15)..(15): Xaa in position 15 is Ala or Val
  Variant (17)..(17): Xaa in position 17 is Phe or Ile
  Variant (21)..(21): Xaa in position 21 is Asp or Asn
  Variant (25)..(25): Xaa in position 25 is Ala, Glu or Asn
  Variant (26)..(26): Xaa in position 26 is any amino acid
  Variant (29)..(29): Xaa in position 29 is any amino acid
  Variant (36)..(37): Xaa in position 36 to 37 is any amino acid
  Variant (38)..(38): Xaa in position 38 is any or no amino acid
  Variant (40)..(40): Xaa in position 40 is any or no amino acid
  Variant (42)..(42): Xaa in position 42 is any amino acid
  Variant (43)..(43): Xaa in position 43 is Ala or Glu
  Variant (44)..(44): Xaa in position 44 is Ala or Ser
  Variant (45)..(45): Xaa in position 45 is Ile or Val
  Variant (46)..(46): Xaa in position 46 is any amino acid
  Variant (48)..(48): Xaa in position 48 is any amino acid
  Variant (49)..(49): Xaa in position 49 is Ala, Glu, Gln or Ser
  Variant (50)..(50): Xaa in position 50 is Ala, Glu, Gln or Thr
  Variant (51)..(52): Xaa in position 51 to 52 is any amino acid
  Variant (53)..(53): Xaa in position 53 is Ile, Leu or Val
  Variant (54)..(54): Xaa in position 54 is Asn or Gln
  Variant (55)..(55): Xaa in position 55 is Ala, Pro or Thr
  Variant (56)..(56): Xaa in position 56 is Ala or Ser
  Variant (57)..(57): Xaa in position 57 is any amino acid
  Variant (58)..(58): Xaa in position 58 is Met or Val
  Variant (59)..(59): Xaa in position 59 is Ile or Val
CLNFFAGPXDKXFXXPXNFYXVHYXXTHXVGTSGGXXXDXMXXXXXLXXXXXXXXXXXXTH

SEQ ID NO: 169 - protein, 58 aa, Artificial sequence
  protein pattern
  Variant (3)..(3): Xaa in position 3 is Leu or Met
  Variant (4)..(4): Xaa in position 4 is Cys or Ser
  Variant (6)..(6): Xaa in position 6 is Ile or Val
  Variant (10)..(10): Xaa in position 10 is Phe or Tyr
  Variant (11)..(11): Xaa in position 11 is any amino acid
  Variant (13)..(13): Xaa in position 13 is Asn or Ser
  Variant (16)..(16): Xaa in position 16 is any amino acid
  Variant (17)..(17): Xaa in position 17 is Gln or Thr
  Variant (18)..(18): Xaa in position 18 is Glu or Gln
  Variant (19)..(19): Xaa in position 19 is any amino acid
  Variant (20)..(20): Xaa in position 20 is Ser or Val
  Variant (22)..(22): Xaa in position 22 is Glu or Asn
  Variant (24)..(24): Xaa in position 24 is any amino acid
  Variant (27)..(27): Xaa in position 27 is Ile or Val
  Variant (28)..(28): Xaa in position 28 is Lys or Arg
  Variant (29)..(29): Xaa in position 29 is Glu or Pro
  Variant (30)..(30): Xaa in position 30 is Gly or Gln
  Variant (32)..(33): Xaa in position 32 to 33 is any amino acid
  Variant (34)..(34): Xaa in position 34 is any or no amino acid
  Variant (36)..(36): Xaa in position 36 is any or no amino acid
  Variant (38)..(38): Xaa in position 38 is Ala or Gly
  Variant (39)..(39): Xaa in position 39 is Cys or Gly
  Variant (40)..(40): Xaa in position 40 is Ala or Thr
  Variant (45)..(45): Xaa in position 45 is Ile or Leu
  Variant (46)..(46): Xaa in position 46 is Gly or Leu
  Variant (52)..(52): Xaa in position 52 is Ile or Leu
  Variant (53)..(53): Xaa in position 53 is any amino acid
  Variant (55)..(55): Xaa in position 55 is Gly or Pro
  Variant (56)..(56): Xaa in position 56 is Ile or Val
  Variant (57)..(57): Xaa in position 57 is any amino acid
EPXXCXIGAXXAXYHXXXXXYXHXMGXXXXGXXXLXLXXXGPMGXXAIDYAXXGXXXP

SEQ ID NO: 170 - protein, 40 aa, Artificial sequence
  protein pattern
  Variant (2)..(2): Xaa in position 2 is Gly, Ser or Thr
  Variant (3)..(5): Xaa in position 3 to 5 is any amino acid
  Variant (6)..(6): Xaa in position 6 is Ala or Pro
  Variant (7)..(8): Xaa in position 7 to 8 is any amino acid
  Variant (9)..(9): Xaa in position 9 is Asp, Gly or Ser
  Variant (10)..(10): Xaa in position 10 is any amino acid
  Variant (12)..(16): Xaa in position 12 to 16 is any or no amino acid
  Variant (19)..(19): Xaa in position 19 is His or Tyr
  Variant (20)..(20): Xaa in position 20 is any amino acid
  Variant (21)..(21): Xaa in position 21 is Ile or Val
  Variant (24)..(25): Xaa in position 24 to 25 is any amino acid
  Variant (26)..(26): Xaa in position 26 is Ala or Val
  Variant (27)..(27): Xaa in position 27 is Ile or Met
  Variant (28)..(28): Xaa in position 28 is Ala, Asp, Glu or Asn
  Variant (29)..(30): Xaa in position 29 to 30 is any amino acid
  Variant (32)..(32): Xaa in position 32 is Leu or Val
  Variant (34)..(34): Xaa in position 34 is Ala, Pro or Thr
  Variant (35)..(35): Xaa in position 35 is Trp or Tyr
  Variant (36)..(36): Xaa in position 36 is Asp, Glu or His
  Variant (38)..(38): Xaa in position 38 is Asp, Glu or Ser
  Variant (39)..(39): Xaa in position 39 is any amino acid
  Variant (40)..(40): Xaa in position 40 is Phe, Trp or Tyr
PXXXXXXXXXEXXXXXATXXXIPXXXXXXXCXLXXXGXXX

SEQ ID NO: 171 - protein, 37 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Ala or Val
  Variant (7)..(7): Xaa in position 7 is Gly or Pro
  Variant (8)..(8): Xaa in position 8 is Glu or His
  Variant (10)..(10): Xaa in position 10 is any amino acid
  Variant (12)..(12): Xaa in position 12 is Asp, Glu or Asn
  Variant (13)..(13): Xaa in position 13 is any amino acid
  Variant (14)..(14): Xaa in position 14 is Leu or Pro
  Variant (15)..(15): Xaa in position 15 is Ala or Asp
  Variant (16)..(16): Xaa in position 16 is Ile or Val
  Variant (17)..(17): Xaa in position 17 is Gly or Pro
  Variant (23)..(23): Xaa in position 23 is Ile or Val
  Variant (25)..(25): Xaa in position 25 is Asn, Pro or Thr
  Variant (26)..(28): Xaa in position 26 to 28 is any amino acid
  Variant (29)..(29): Xaa in position 29 is Phe, Leu or Met
  Variant (33)..(33): Xaa in position 33 is Ala, Pro or Ser
  Variant (34)..(34): Xaa in position 34 is Ile or Leu
  Variant (35)..(35): Xaa in position 35 is Ala, Asp, Gly or Thr
  Variant (36)..(36): Xaa in position 36 is Asp, Glu or Gln
  Variant (37)..(37): Xaa in position 37 is Phe or Ile
GXXXAXXXTXLXXXXXXGGKKLXYXXXXXPLTXXXXX

SEQ ID NO: 172 - DNA, 1143 bp, Escherichia coli
  CDS (1)..(1143): transl_table=11
atgccgcatttggcactactcatctctaaaggagcaattatggaccgcattattcaatcaccgggtaaatacatccagggcgctgatgtgattaatcgtctgggcgaatacctgaagccgctggcagaacgctggttagtggtgggtgacaaatttgttttaggttttgctcaatccactgtcgagaaaagctttaaagatgctggactggtagtagaaattgcgccgtttggcggtgaatgttcgcaaaatgagatcgaccgtctgcgtggcatcgcggagactgcgcagtgtggcgcaattctcggtatcggtggcggaaaaaccctcgatactgccaaagcactggcacatttcatgggtgttccggtagcgatcgcaccgactatcgcctctaccgatgcaccgtgcagcgcattgtctgttatctacaccgatgagggtgagtttgaccgctatctgctgttgccaaataacccgaatatggtcattgtcgacaccaaaatcgtcgctggcgcacctgcacgtctgttagcggcgggtatcggcgatgcgctggcaacctggtttgaagcgcgtgcctgctctcgtagcggcgcgaccaccatggcgggcggcaagtgcacccaggctgcgctggcactggctgaactgtgctacaacaccctgctggaagaaggcgaaaaagcgatgcttgctgccgaacagcatgtagtgactccggcgctggagcgcgtgattgaagcgaacacctatttgagcggtgttggttttgaaagtggtggtctggctgcggcgcacgcagtgcataacggcctgaccgctatcccggacgcgcatcactattatcacggtgaaaaagtggcattcggtacgctgacgcagctggttctggaaaatgcgccggtggaggaaatcgaaaccgtagctgcccttagccatgcggtaggtttgccaataactctcgctcaactggatattaaagaagatgtcccggcgaaaatgcgaattgtggcagaagcggcatgtgcagaaggtgaaaccattcacaacatgcctggcggcgcgacgccagatcaggtttacgccgctctgctggtagccgaccagtacggtcagcgtttcctgcaagagtgggaataa

SEQ ID NO: 173 - protein, 380 aa, Escherichia coli
MPHLALLISKGAIMDRIIQSPGKYIQGADVINRLGEYLKPLAERWLVVGDKFVLGFAQSTVEKSFKDAGLVVEIAPFGGECSQNEIDRLRGIAETAQCGAILGIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENAPVEEIETVAALSHAVGLPITLAQLDIKEDVPAKMRIVAEAACAEGETIHNMPGGATPDQVYAALLVADQYGQRFLQEWE

SEQ ID NO: 174 - DNA, 1080 bp, Synechococcus sp. WH 7803
  CDS (1)..(1080): transl_table=11
atggcgccggtccgcgtgattcgcggctccggtgcctggcaagacgcccttccccagatccgtgcgctctgctccagcccgctctttctgggtcgaagttcagccacgcagcctctgcgcaacacgctgatctccagcctcacgtcggctggaatgaaggtcgcgccagcgctcctgaggcatgactgctgcaacgaagacttaagtcgtcttcaatcggaatggtcggttcaccgcagtgatggggtgatcgccgctggtggaggaaaagttttggatgccggcaagctccttgccgaccgtctcgatctgccctgcatcaccgttccactgagtgcctcaacctgtgctggctggaccgcactctccaatctctacagcccagacggtgcatttttcggcgatcaggccttgaaatactgtccggacctgctggtgttcgaccacgatctcctgcgtcaggcacctccccgcacccttgccagtggcatcgctgatgcgctggccaagtggtacgaagcctccgtgagcagtggtgccagccaggatggactcatcctgcaagcggttcagatggcgcgcgttctgcgcgatcagcttctgatcgacagcgtggatgccatgcagaatccaggcggtgacgcttggattcgcgtgattgaagcctgtgggctcacagcaggcgtgattggaggcctgggtggggcacgctgccgcacggttgctgcccatgctgtgcacaacgggctcacccaacttcaggcctgccacggatccctgcacggcgaaaaagtgggcttcggagtgctggttcaacttcgcctcgaggaacgcttgggcggcaatcgcctggcagaacaggcccaccgtcagttgctgcctctgctcaagcaactcggactcccggtcagcctcgacgatctcggactctccaaggccagcttgagtgaccttcaacaggtttgcgatttcgcctgccgtgaaggctccgaccttcaccatctccccttctctgtgacaccgggagctcttctggaagcgctggtcggagcctcagaacccagcgttcgacgcccttga

SEQ ID NO: 175 - protein, 359 aa, Synechococcus sp. WH 7803
MAPVRVIRGSGAWQDALPQIRALCSSPLFLGRSSATQPLRNTLISSLTSAGMKVAPALLRHDCCNEDLSRLQSEWSVHRSDGVIAAGGGKVLDAGKLLADRLDLPCITVPLSASTCAGWTALSNLYSPDGAFFGDQALKYCPDLLVFDHDLLRQAPPRTLASGIADALAKWYEASVSSGASQDGLILQAVQMARVLRDQLLIDSVDAMQNPGGDAWIRVIEACGLTAGVIGGLGGARCRTVAAHAVHNGLTQLQACHGSLHGEKVGFGVLVQLRLEERLGGNRLAEQAHRQLLPLLKQLGLPVSLDDLGLSKASLSDLQQVCDFACREGSDLHHLPFSVTPGALLEALVGASEPSVRRP

SEQ ID NO: 176 - DNA, 1095 bp, Thermotoga maritima MSB8
  CDS (1)..(1095): transl_table=11
atgataacaaccaccatatttccaggtagatatgttcagggggcaggtgctatcaacattctagaagaagaactttctcgttttggagaaagggcatttgtggtgatcgatgattttgtggacaaaaacgtgctaggagaaaatttcttcagctctttcacaaaagtcagggtaaacaaacagatctttggtggagagtgttcagacgaagagatagagcgactttcaggtcttgttgaagaagaaacagacgtggtggtgggcataggtggcggaaaaacactcgataccgctaaagcggtcgcctataagttgaaaaagcctgttgtgattgttccaactattgcctctacagatgctccatgcagcgccctttccgtgatttacacaccaaacggggaattcaaaagatacctgtttttgccaaggaatccagatgtcgttctggtagacacggagattgtggcgaaagcccccgcgaggtttcttgttgccggaatgggagatgcccttgccacgtggtttgaggcagaatcttgtaaacagaaatacgctccaaatatgacgggaagacttggttcgatgacagcctacgcgctcgcaagactttgctatgagacacttctagaatacggtgtacttgcgaaaaggtcggtggaggaaaagtctgtcacacctgcccttgaaaaaatcgttgaggcgaacacccttttaagtggtctgggattcgaaagtggaggactggcagctgcacatgctattcacaacggtctcaccgttctggaaaatacccacaagtatttacacggggaaaaagtggccataggagttctcgcatcactgtttttgactgacaaacccagaaagatgatcgaagaggtctactccttctgtgaagaagtgggattacccactactctggcagagataggacttgatggtgtttcggacgaggatctgatgaaagtggctgagaaagcctgtgacaagaatgaaacaatacacaacgaaccccaacctgtgacatcaaaggatgtgtttttcgccctaaaagcagcagacaggtacggaaggatgagaaaaaacctcacttga

SEQ ID NO: 177 - protein, 364 aa, Thermotoga maritima MSB8
MITTTIFPGRYVQGAGAINILEEELSRFGERAFVVIDDFVDKNVLGENFFSSFTKVRVNKQIFGGECSDEEIERLSGLVEEETDVVVGIGGGKTLDTAKAVAYKLKKPVVIVPTIASTDAPCSALSVIYTPNGEFKRYLFLPRNPDVVLVDTEIVAKAPARFLVAGMGDALATWFEAESCKQKYAPNMTGRLGSMTAYALARLCYETLLEYGVLAKRSVEEKSVTPALEKIVEANTLLSGLGFESGGLAAAHAIHNGLTVLENTHKYLHGEKVAIGVLASLFLTDKPRKMIEEVYSFCEEVGLPTTLAEIGLDGVSDEDLMKVAEKACDKNETIHNEPQPVTSKDVFFALKAADRYGRMRKNLT

SEQ ID NO: 178 - DNA, 1077 bp, Lactococcus lactis subsp. lactis Il1403
  CDS (1)..(1077): transl_table=11
atgaatatctcagaagaagtacgtcccggagccaatagatatgtgagtggtcaaggaattttgcaagatttagaaagctatcttgcgtcttttaataaacttgcgataattactggggaaaaatcttttcaggtttttcaagatttttatcctaaagacttaagttatcctgtttttcattatgatggctcggcctctatcgaaaatgggaaaaaactggccaaagaaattggtcaatccgatggccttcttgcaattggcggagggcgtttgattgatacttgtaaagttgtagcccaggagctaaactgtgagttaattattattccgaccttggtttctaattgtgctccttacacaccggttgcagctctttatcaccctgaccatacttttgataaagtgggttatttaaataaagtgagctatttaactttagttgattatgattttttattggcaacacctcatgattattttgttgctggaatcggggatacactcgccaaatggtatgaaatggaaggaatcgttcgtcaggtttcacaggaagaactttcagcctcagttcgtttgggatttgcgagtgcaaaggaaatttttaaaatattatttgctgattctaaagcagcacttaatgatttggctgaacagaaagtgacgccagcttttgggcgaattgttgatacaatcattgaactttcaggaacagttggaggttttgctgggacttatggacggatgtcaggagctcatgcgcttcataatggtctatcactttgctcagagacacatcctattttacatggctcaaaagtcgcttacggagtcttggtacaattggcttatacgggagatacttcagaaattgaaaaacttttgccattttataaggaaaatcatttacctgcttctctagcagaaattaatttaccatttgatttagaaaaattgcaagcagtagcaaaatttgcagccagtcctgtagaatcttatcgtttgattgattcaaaagttactgacgaaaaaatcataagtgccatcaaagccttagaagctcttgtcagcaaaaaataa

SEQ ID NO: 179 - protein, 358 aa, Lactococcus lactis subsp. lactis Il1403
MNISEEVRPGANRYVSGQGILQDLESYLASFNKLAIITGEKSFQVFQDFYPKDLSYPVFHYDGSASIENGKKLAKEIGQSDGLLAIGGGRLIDTCKVVAQELNCELIIIPTLVSNCAPYTPVAALYHPDHTFDKVGYLNKVSYLTLVDYDFLLATPHDYFVAGIGDTLAKWYEMEGIVRQVSQEELSASVRLGFASAKEIFKILFADSKAALNDLAEQKVTPAFGRIVDTIIELSGTVGGFAGTYGRMSGAHALHNGLSLCSETHPILHGSKVAYGVLVQLAYTGDTSEIEKLLPFYKENHLPASLAEINLPFDLEKLQAVAKFAASPVESYRLIDSKVTDEKIISAIKALEALVSKK

SEQ ID NO: 180 - DNA, 1089 bp, Streptococcus pyogenes M1 GAS
  CDS (1)..(1089): transl_table=11
atgaaagtatttgcaagtccatctcgttacattcaaggtaaaaatgccttgtttaccaatgttaaaaccctaaaacaactaggggatagccccattttactgtgtgatgacgtggtgtatggcatcgtcggagaaagatttgaaagctatttgatagataatggcatgactcctgttcacgtagcctttaatggcgaagcctcagataatgaaatcagccgcgtggttgccattgccaaggaaaatggcaatgatgttattattggacttggtggtggaaaaaccattgacagtgctaaggctatcgctgacttacttgctgttccggtgattattgccccaaccattgcttcaacagatgccccaacctcagccttatcggttatttacaccgatgaaggagcctttgaaaaatacattttctattcaaagaatccagatcttgtattggttgacacacaagtgatctgtcaggcaccaaaacgcttattggcgtcagggattgcagatgggttagcaacatgggtagaggcgcgtgctgttatgcaaaaaaatggagacaccatggcaggtggcaatcaaaccttggcaggagttgccattgccaaagcctgtgagcagaccttgtttgcagatggcctaaaagcgatggctagctgtgacagacaagtcgtgaccccggccttggaaaatgtcattgaagccaatacacttcttagtgggcttggttttgaaagtgcgggtctggctgctgcacatgccattcacaatggctttacagcgctgacaggtgctattcatcaccttacccatggtgaaaaagtcgcctatggcacgttgacccaactcttcttggaaaatcgttcgcgtgaagaaattgaccgctacatcgacttttaccaagctattggcatgccaacaaccctcaaagaaatgcatttagacacggctactcaagaggatttcttaaaaattggccgtcaagcaaccatggcaggcgaaaccatccatcaaatgccatttgttatcagtccagaagatgtagcagcggctttggttgctgttgatgcctatgttacgagtcgatag

SEQ ID NO: 181 - protein, 362 aa, Streptococcus pyogenes M1 GAS
MKVFASPSRYIQGKNALFTNVKTLKQLGDSPILLCDDVVYGIVGERFESYLIDNGMTPVHVAFNGEASDNEISRVVAIAKENGNDVIIGLGGGKTIDSAKAIADLLAVPVIIAPTIASTDAPTSALSVIYTDEGAFEKYIFYSKNPDLVLVDTQVICQAPKRLLASGIADGLATWVEARAVMQKNGDTMAGGNQTLAGVAIAKACEQTLFADGLKAMASCDRQVVTPALENVIEANTLLSGLGFESAGLAAAHAIHNGFTALTGAIHHLTHGEKVAYGTLTQLFLENRSREEIDRYIDFYQAIGMPTTLKEMHLDTATQEDFLKIGRQATMAGETIHQMPFVISPEDVAAALVAVDAYVTSR

SEQ ID NO: 182 - DNA, 1089 bp, Escherichia coli O157:H7 EDL933
  CDS (1)..(1089): transl_table=11
  misc_feature (1008)..(1008): r is g or a
atgcctcacaatcctatccgcgtggtcgtcggcccggctaactacttttcacatccaggaagtttcaatcacctgcacgattttttcactgatgaacaactttctcgcgcggtgtggatctacggcgtacgcgccattgctgcggcgcaaaccaaacttccgccagcgtttggacttccaggggcaaagcatattttgtttcgtggtcattgcagcgaaagcgatgtacagcaactggcggctgagtccggtgacgatcgcagcgtggtgattggcgtcggcggcggcgcactactcgacaccgcgaaagccctcgcccgccgtctcggtctgccatttgttgccgctccaacgatcgccgccacctgcgccgcctggacaccgctctccgtctggtataacgatgccggacaggcgctgcattatgagattttcgacgacgccaattttatggtgctggtggaaccggagattatcctcaatgcgccgcaacaatatctgctggcggggatcggtgatacgctggcgaaatggtatgaagcggtggtgctggctccgcaaccagaaacgttgccgctaaccgtgcgactggggatcaataatgctcaggccattcgcgacgtcttgttaaacagtagcgaacaggcgcttgccgatcagcaaaatcagcagttaacgcaatcattttgcgatgtggtggatgccattattgctggtggtgggatggtcggtggtctgggcgatcgttttacgcgtgtagcggcggcccatgccgtacataacggtctgactgtcctgccacaaaccgagaagtttctccacggcaccaaagtcgcctacggaattctggtgcaaagcgccttgctgggtcaggatgatgtgctggcgcaattaaccggggcgtatcagcgttttcatctgccgactacgctggcggagctggaagtggatatcaataatcaggcggagatcgataaagtgattgcccacaccttgcgcccggtggartccattcattacctgccagtcacgctgacaccagatacgttgcgtgcagcgttcgaaaaagtggaatcgtttaaagcctga

SEQ ID NO: 183 - protein, 362 aa, Escherichia coli O157:H7 EDL933
MPHNPIRVVVGPANYFSHPGSFNHLHDFFTDEQLSRAVWIYGVRAIAAAQTKLPPAFGLPGAKHILFRGHCSESDVQQLAAESGDDRSVVIGVGGGALLDTAKALARRLGLPFVAAPTIAATCAAWTPLSVWYNDAGQALHYEIFDDANFMVLVEPEIILNAPQQYLLAGIGDTLAKWYEAVVLAPQPETLPLTVRLGINNAQAIRDVLLNSSEQALADQQNQQLTQSFCDVVDAIIAGGGMVGGLGDRFTRVAAAHAVHNGLTVLPQTEKFLHGTKVAYGILVQSALLGQDDVLAQLTGAYQRFHLPTTLAELEVDINNQAEIDKVIAHTLRPVESIHYLPVTLTPDTLRAAFEKVESFKA

SEQ ID NO: 184 - DNA, 1143 bp, Escherichia coli O157:H7 EDL933
  CDS (1)..(1143): transl_table=11
atgccgcatttggcactactcatctctaaaggagcaattatggaccgcattattcaatcaccgggtaaatacatccagggcgctgatgtgattaatcgtctgggcgaatacctgaagccgctggcagaacgctggttagtggtgggtgacaaatttgttttaggttttgctcaatccactgtcgagaaaagctttaaagatgctggactggtagtagagattgcgccgtttggcggtgaatgttcgcaaaatgagatcgaccgtctgcgtggcatcgcggagactgcgcagtgtggcgcaattctcggtatcggtggcggaaaaaccctcgatacagccaaagcactggcacatttcatgggtgttccggtcgccattgccccgaccattgcttcaaccgacgcaccttgtagcgctctttccgttatctacactgacgaaggtgaatttgaccgctatctgctgctgccaaataacccgaatatggtgattgtcgatactaaaatcgtcgcgggcgcacctgcgcgtctgttagcggcgggtatcggcgatgcgctggcgacctggtttgaagcgcgtgcctgctctcgtagcggtgcgaccaccatggcgggcggcaagtgcactcaggcggcgctggcgctggctgaactgtgctacaacaccttgctggaagaaggcgaaaaagcgatgctcgccgccgaacagcatgtagtgactccggcactggaacgcgtgattgaagcgaacacttatttaagcggtgttggctttgaaagcggtggtctggcggcagcgcacgcggtgcataatggcctgactgccattcctgatgcccatcactattatcacggtgaaaaagtggcatttggtacactgacgcagctggtactggaaaactcgccggttgaggaaatcgaaaccgtagctgcgcttagccatgcggtaggtttgccaataactctcgctcaactggatattaaagaagatgtcccggcgaaaatgcgaattgtggcagaagcggcatgtgcagaaggtgaaaccatccacaacatgcctggcggcgcgacgccagatcaggtttacgccgctctgctggtagccgaccagtacggtcagcgtttcctgcaagagtgggaataa

SEQ ID NO: 185 - protein, 380 aa, Escherichia coli O157:H7 EDL933
MPHLALLISKGAIMDRIIQSPGKYIQGADVINRLGEYLKPLAERWLVVGDKFVLGFAQSTVEKSFKDAGLVVEIAPFGGECSQNEIDRLRGIAETAQCGAILGIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENSPVEEIETVAALSHAVGLPITLAQLDIKEDVPAKMRIVAEAACAEGETIHNMPGGATPDQVYAALLVADQYGQRFLQEWE

SEQ ID NO: 186 - DNA, 1089 bp, Streptococcus pneumoniae TIGR4
  CDS (1)..(1089): transl_table=11
atgagaatttttgctagtccttctagatatattcagggggaaaatgccttgtttgaaaatgccaaatcaattttggatttgggaaattgccctattctattatgcgatcagttggtttatgatattgttggaaaacgatttgaagattacctacataggtatggtttccatattgttctggcgctatttaatggtgaagcttctgacaatgaaatcaatcgagttgttgccttggctgagaaagaaaattgtgatagtattatcggtcttggtgggggaaagacgattgatagcgcaaaagctattgcagatttgattgaaaagcctgttattattgctccaacaattgcatcgaccgacgcacctgtatctgctttatctgttatttatacagatgaaggtgcatttgatcattatctattttattctaaaaatccagatttagttttggttgatacaaaagttatttcacaagcccctaagcgtttattagcgtctggtattgcagatggtttagcaacttgggttgaggcgcgtgcggttatgcaggcaaatggaaaaactatgttgggacaacagcaaacattggctggagttgcaattgcgaagaaatgtgaagaaacgctgtttgcagatggtttacaggctatggcagcttgtgaagctaaagtggtgacaccagcattagaaaatattgttgaagctaatactttattgagtggtctaggttttgaaagtggaggattagctgcggcgcatgcaattcataatggttttactgcattgacaggtgacattcatcatttaacacatggtgaaaaagtagcttatggaactttagtacaactattattggaaaatagacctaaagaagaacttgataagtatattgagttttacaaaaaaattggtatgccaacaactctaaaagaaatgcatttggatcaagttggatatgatgatttaataaaagttggtaaacaagcaactatggagggtgagacaattcatcagatgccgtttaagatttcgccttcagatgttgctcaagctattatcgctgtagatgcctatgtaaattcaaaataa

SEQ ID NO: 187 - protein, 362 aa, Streptococcus pneumoniae TIGR4
MRIFASPSRYIQGENALFENAKSILDLGNCPILLCDQLVYDIVGKRFEDYLHRYGFHIVLALFNGEASDNEINRVVALAEKENCDSIIGLGGGKTIDSAKAIADLIEKPVIIAPTIASTDAPVSALSVIYTDEGAFDHYLFYSKNPDLVLVDTKVISQAPKRLLASGIADGLATWVEARAVMQANGKTMLGQQQTLAGVAIAKKCEETLFADGLQAMAACEAKVVTPALENIVEANTLLSGLGFESGGLAAAHAIHNGFTALTGDIHHLTHGEKVAYGTLVQLLLENRPKEELDKYIEFYKKIGMPTTLKEMHLDQVGYDDLIKVGKQATMEGETIHQMPFKISPSDVAQAIIAVDAYVNSK

SEQ ID NO: 188 - DNA, 1089 bp, Streptococcus pneumoniae R6
  CDS (1)..(1089): transl_table=11
atgagaatttttgctagtccttctagatatattcagggggaaaatgccttgtttgaaaatgccaaatcaattttggatttgggaaattaccctattctattatgcgatcagttggtttatgatattgttggaaaacgatttgaagattatctacataggtatggtttccatattgttctggcgctatttaatggtgaagcttctgacaatgaaatcaatcgagttgttgccttggctgagaaagaaaattgtgatagtattatcggtcttggtgggggaaagacgattgatagcgcaaaagctattgcagatttgattgaaaagcctgttattattgctccaacaattgcatcgaccgacgcacctgtatctgctttatctgttatttatacagatgaaggtgcatttgatcattatctattttattctaaaaatccagatttagttttggttgatacaaaagttatttcacaagcccctaagcgtttattagcgtctggtattgcagatggtttagcaacttgggttgaggcgcgtgcggttatgcaggcaaatggaaaaactatgttgggacaacagcaaacattggctggagttgcaattgcgaagaaatgtgaagaaacgctgtttgcagatggtttacaggctatggcagcttgtgaagctaaagtggtgacaccagcattagaaaatattgttgaagctaatactttattgagtggtctaggttttgaaagtggaggattagctgcggcgcatgcaattcataatggttttactgcattgacaggtgacattcatcatttaacacatggtgaaaaagtagcttatggaactttagtacaactattattggaaaatagacctaaagaagaacttgataagtatattgagttttacaaaaaaattggtatgccaacaactctaaaagaaatgcatttggatcaagttggatatgatgatttaataaaagttggtaaacaagcaactatggagggtgagacaattcatcagatgccgtttaagatttcgccttcagatgttgctcaagctattatcgctgtagatgcctatgtaaattcaaaataa

SEQ ID NO: 189 - protein, 362 aa, Streptococcus pneumoniae R6
MRIFASPSRYIQGENALFENAKSILDLGNYPILLCDQLVYDIVGKRFEDYLHRYGFHIVLALFNGEASDNEINRVVALAEKENCDSIIGLGGGKTIDSAKAIADLIEKPVIIAPTIASTDAPVSALSVIYTDEGAFDHYLFYSKNPDLVLVDTKVISQAPKRLLASGIADGLATWVEARAVMQANGKTMLGQQQTLAGVAIAKKCEETLFADGLQAMAACEAKVVTPALENIVEANTLLSGLGFESGGLAAAHAIHNGFTALTGDIHHLTHGEKVAYGTLVQLLLENRPKEELDKYIEFYKKIGMPTTLKEMHLDQVGYDDLIKVGKQATMEGETIHQMPFKISPSDVAQAIIAVDAYVNSK

SEQ ID NO: 190 - DNA, 1095 bp, Sinorhizobium meliloti 1021
  CDS (1)..(1095): transl_table=11
atggcacgggcattcggcggtccgaacaaatacatccagcgtgcgggcgagatcgacaagctggcggcctatctggcgccgctcggcaaacgcgcgctcgtcctgatcgaccgcgtgctgttcgacgcactcagcgaacgcatcggcaaaagctgcggcgactcgctcgatatccgcttcgagcggttcggcggagagtgctgcacctcggagatcgagcgcgtacgcaaggtcgcaatcgagcacggcagcgatattctcgtgggcgtgggtgggggcaagacggccgacaccgccaagatcgtcgcaatcgacactggcgcgcgcatcgtcatcgcaccgacgatcgcctcgaccgacgcgccctgcagcgcgattgccgtgcgctacaccgaacatggggtttacgaggaggcgctccgcctgccccgcaacccggacgccgtcgtcgtcgattccgcgctggtggcagccgcgccggcacgcttcctcgtcgcggggatcggcgatgcgctttcgacctggttcgaggcccgctccaatatcgagtcgcgcaccgacaattatgtggccggcggctttcccgctaccgaagccgggatggcgatcgcccggcattgccaggatgtgctgacacgcgatgccgtcaaggcgaagatcgccgtcgaggccggcctgctgaccccagcggtcgaaaacatcatcgaggcgaacacgctgctgtcgggcctcggtttcgagaattgcggctgctcggccgcccatggcatccatgacggcctgacagtgctggaggaggtgcatgggtatttccacggcgagaaggtcgccttcggcacgctttgcctgctgatgctggagaaccgcgaccgagccgagatcgaggcgatgatacgcttctgccgcagcgtcggactgccgaccaaactggcggacctcggcatcgtcgatgacgtccccgccaagatcggccgcgtggcggaagccgcctgccggcccggcaacatcatctatgccacgccggtcaccattaccgtaccggccgtgcgcgacgcgatcctggcgctcgacgccttttcacgcagcatccactga

SEQ ID NO: 191 - protein, 364 aa, Sinorhizobium meliloti 1021
MARAFGGPNKYIQRAGEIDKLAAYLAPLGKRALVLIDRVLFDALSERIGKSCGDSLDIRFERFGGECCTSEIERVRKVAIEHGSDILVGVGGGKTADTAKIVAIDTGARIVIAPTIASTDAPCSAIAVRYTEHGVYEEALRLPRNPDAVVVDSALVAAAPARFLVAGIGDALSTWFEARSNIESRTDNYVAGGFPATEAGMAIARHCQDVLTRDAVKAKIAVEAGLLTPAVENIIEANTLLSGLGFENCGCSAAHGIHDGLTVLEEVHGYFHGEKVAFGTLCLLMLENRDRAEIEAMIRFCRSVGLPTKLADLGIVDDVPAKIGRVAEAACRPGNIIYATPVTITVPAVRDAILALDAFSRSIH

SEQ ID NO: 192 - DNA, 1098 bp, Halobacterium sp. NRC-1
  CDS (1)..(1098): transl_table=11
atgacgagcgtattcaaatcgccatcgacgtacgtacagggacgcaacgtgacgaccgacatcggcacgcacgcggaatcactcggtgacacagcattgctagtcgccgacgagatcgtgatggacatgatcgagagcgacgtgcacgaaagcctcgcggaagccggactcgacggctcatcggtcgtgttcaacggggagtcctcggaggacgagatcgagcggatcgcgtccgttgctgtcgacgagggtgccgacatcgttatcggggccggaggcggcaaggccctggacaccgcgaaagcagtccgcgaggaggtcggcggcgcaatggtgtcgatgccgacgatcgcatcgatggacgcgccgacgagttcgctgtcagtgatctacagcgagcacggcgagttcgaggattactggtactacgagcagcacccggacttggtgatcgttgacaccgaagtggtcgctgcagcgccggctcggttcctgcgctcggggatcgcagacgggcttgcaacgtggttcgaggcggacgcagtcgcacagtccggcggcgacaacgaggtcggtgggaaaccaacccgcgcgggacacaagctcgccgagctgtgctatgagacgctccgtgagcacggtgccggcgcgctggacgccgtcgagcacgatgccgtgaccgagagcgtcgacgccgtgatcgaggcgaacacgctgctcagcgggctggggttcgaaagcggcgggctggcggctgcccactccgtgcacaacggcctcacgcagctcgcggaaacgcacgacgcgacccacggtgaaaaggtgaacatcggtacgatcacgcagctcgtgctggaggggcattccgacgcgaggatcgaggagttcatcgagttctcggtcgaactcgggttgcctgtcaccctcggtgagatcgggatcacgaaccctgaacaggtagacctggacgtggtcgcggaggcggcctgtgacgaagccgagacgatccacgacgagccgtttgacgttacaccagcaatggtgcgtgatgcgttgctgaccgccgacgagatggggcggcgggttcgggatcgatag

SEQ ID NO: 193 - protein, 365 aa, Halobacterium sp. NRC-1
MTSVFKSPSTYVQGRNVTTDIGTHAESLGDTALLVADEIVMDMIESDVHESLAEAGLDGSSVVFNGESSEDEIERIASVAVDEGADIVIGAGGGKALDTAKAVREEVGGAMVSMPTIASMDAPTSSLSVIYSEHGEFEDYWYYEQHPDLVIVDTEVVAAAPARFLRSGIADGLATWFEADAVAQSGGDNEVGGKPTRAGHKLAELCYETLREHGAGALDAVEHDAVTESVDAVIEANTLLSGLGFESGGLAAAHSVHNGLTQLAETHDATHGEKVNIGTITQLVLEGHSDARIEEFIEFSVELGLPVTLGEIGITNPEQVDLDVVAEAACDEAETIHDEPFDVTPAMVRDALLTADEMGRRVRDR

SEQ ID NO: 194 - DNA, 1092 bp, Yersinia pestis CO92
  CDS (1)..(1092): transl_table=11
atgagcgcgaacgcaattcgggtgcaggtggggcctgccaactatttttcttttccgggcgctatcgacaaactgagcgagttttatcctcaggcggcactggataaggctttgtggatttatggtgagcgtgcattggccgccgcccaggattacctgcccaaggcgtttcacgggccacaggccgtgcgtgctaaattctcaacgcattgtagtcagtctacggtcgctgatttggtcagcgcggcgggcggtgatcggcaggtcgtaattggtatcgggggcggtgcagtcctggataccgccaaagttgtggcccgtcagttgggggtaccgctggtggctatcccgactatcgctgctacctgtgccgcctggaccccgctttcggtctggtataacgaagccgggcaagcgttgaattttgaaattttcaacgatgccaaccatttggtactggtcgagccacgtatcatgttacacgcgccagtggaatatctgctggcggggatcggcgacacactggcgaaatggtatgaggcagtggtccttagcccgcagccagaaaccctatcgctgaccgtccgcttaggcttacaggccgctctggagattcgcaatgtgttgctcaagcagagcgaagcggcattgcaggcggttgctcagggtgaattgacacaagatttccttgatgtggttgatgccattattgccggcggagggatggtcggcgggttaggggagcgctatacccgagttgctgctgcgcatgcggtacacaatggcctgacgttgctgccacaaacggagcacttcttgcatggcaccaaagtggcatacggcatcttggtacaaacggcattgctgggacaagatgaggtgctgcggtcactgattgttgcttttaatcaattaggtttgccaacccatttggcggcgttagatgttgatattaatgaccgggaggcaatagaccgggttattggccggatcctgaaacccggagagtcaatacattacctgccaatcgccctgaattcagaaaaagtatgggcagcgattgagcaagtggaaatcgcggctcagcactga

SEQ ID NO: 195 - protein, 363 aa, Yersinia pestis CO92
MSANAIRVQVGPANYFSFPGAIDKLSEFYPQAALDKALWIYGERALAAAQDYLPKAFHGPQAVRAKFSTHCSQSTVADLVSAAGGDRQVVIGIGGGAVLDTAKVVARQLGVPLVAIPTIAATCAAWTPLSVWYNEAGQALNFEIFNDANHLVLVEPRIMLHAPVEYLLAGIGDTLAKWYEAVVLSPQPETLSLTVRLGLQAALEIRNVLLKQSEAALQAVAQGELTQDFLDVVDAIIAGGGMVGGLGERYTRVAAAHAVHNGLTLLPQTEHFLHGTKVAYGILVQTALLGQDEVLRSLIVAFNQLGLPTHLAALDVDINDREAIDRVIGRILKPGESIHYLPIALNSEKVWAAIEQVEIAAQH

SEQ ID NO: 196 - DNA, 1089 bp, Salmonella typhimurium LT2
  CDS (1)..(1089): transl_table=11
atgaaccacactgagatccgcgtcgttaccggcccggcgaattatttttcccatgcaggaagcctcgaaagactgaccgactttttcacgccggaacagctttcccacgccgtttgggtgtacggcgaacgcgcgattgccgccgcccggccttacctgccggaagcgtttgaacgtgctggcgcaaagcatctgccgtttaccggccattgtagcgaacgccatgttgcccaactggcgcacgcctgcaacgacgatcgtcaggtggtgataggcgtcggcggcggcgcgctgctcgataccgccaaagcgctcgcccgccgtctggcgctgccgtttgtcgctatcccgacaatcgcggcaacctgcgccgcctggacaccgctttccgtctggtataacgacgcgggacaggcgttacagttcgaaatttttgatgatgccaattttctggtgctggtcgaaccgcgcattattctgcaggcgcccgatgactatctgttagctggcattggcgatacgctggcgaaatggtatgaagccgttgtgcttgcgccgcagcctgaaacattgccattgaccgtaaggctgggcattaacagcgcgtgcgctattcgcgatctcctgctggacagcagcgaacaagcattagcggataaacagcagcgtcggctgacccaggcattttgcgacgtggtggatgcgattattgctggcggcggtatggtcggcggcctcggggaacgctatacccgtgtcgccgccgcccatgcggtacacaacggtctgaccgtcctgccgcaaacggaaaaattcctgcacggaacgaaagtggcttatggcattctggtgcaaagcgcgctactgggacaagatgacgtgctggcgcaattgattacagcgtaccggcgatttcatctgccggcccggcttagcgaactggacgtggatattcataacaccgccgagatcgatagggtcatcgcgcataccctgcgcccggtcgaatccatccactatttaccggtgacgttaacgccagacaccctgcgtgcggcgtttgaaaaagttgaatttttcagaatatag

SEQ ID NO: 197 - protein, 362 aa, Salmonella typhimurium LT2
MNHTEIRVVTGPANYFSHAGSLERLTDFFTPEQLSHAVWVYGERAIAAARPYLPEAFERAGAKHLPFTGHCSERHVAQLAHACNDDRQVVIGVGGGALLDTAKALARRLALPFVAIPTIAATCAAWTPLSVWYNDAGQALQFEIFDDANFLVLVEPRIILQAPDDYLLAGIGDTLAKWYEAVVLAPQPETLPLTVRLGINSACAIRDLLLDSSEQALADKQQRRLTQAFCDVVDAIIAGGGMVGGLGERYTRVAAAHAVHNGLTVLPQTEKFLHGTKVAYGILVQSALLGQDDVLAQLITAYRRFHLPARLSELDVDIHNTAEIDRVIAHTLRPVESIHYLPVTLTPDTLRAAFEKVEFFRI

SEQ ID NO: 198 - DNA, 1110 bp, Salmonella typhimurium LT2
  CDS (1)..(1110): transl_table=11
atggttactaccgcgatctttccgtcacgatatgttcagggtaaaggagcgttgacaacgcatctcccgcaggaattggccgcactcggtcataaggcgctgattttgcaggatcctgttgttcacaacacctaccgggatacagttgcaacagcactgcacggggtgattgaatttgatatcgaagtgttcagtagcgagtgctgtgatgaggaaattgctcgcatctccgcacgcgcgcaggaaattggcgccgatgtgattgttggtatggggggcgggaaaaccctggatacggcaaaagcaaccggcgccagcctgcggctgcctattgccgtggttcctactctggcctcaacggatgcgccgtgcagttcactggttgttatctatacgccagaagggaaattcaaacgctacctgatgattccacgtaacccgacgcttgtgctggtggacagcagtattattgctgccgcgccggtacgctttttggtttccgggataggcgatgcgctggcaacctggtttgaagcggaagattgccgcatcaaaggggccggcaatatgaccaccaggccaggaccgatgaccgcatttgagctggcgcgcttttgctacaccaccttaatgcgctatggacgcctggcgaaacttgcctgtgaacaacatcaggttactccggcgctcgaacatgttatcgaagcgaatacgctattatccgggcttggttttgaaagcggtgggctggcggcggcgcacgccattcataacggtctgacagtactgcccgccacgcacaaatactggcatggggaaaaggttgcgtttggcacgctggcaatgcttatgctcaccgatagagcgcctgagcttatcgaggaggtttatcaattttgtgaagatataggcttgcccaccacgctggcggatattggtctggctggcgttagcgatgatgaactgctggccgttgccagggcgtcttgtcaaactggggaaacgatacacaacgagccgtttaccattacgccggaggctgtgcaggcggcattgcgggccgccgatgctgttgggcaggcgcggaaaaagatcgatcttgcaggttaa

SEQ ID NO: 199 - protein, 369 aa, Salmonella typhimurium LT2
MVTTAIFPSRYVQGKGALTTHLPQELAALGHKALILQDPVVHNTYRDTVATALHGVIEFDIEVFSSECCDEEIARISARAQEIGADVIVGMGGGKTLDTAKATGASLRLPIAVVPTLASTDAPCSSLVVIYTPEGKFKRYLMIPRNPTLVLVDSSIIAAAPVRFLVSGIGDALATWFEAEDCRIKGAGNMTTRPGPMTAFELARFCYTTLMRYGRLAKLACEQHQVTPALEHVIEANTLLSGLGFESGGLAAAHAIHNGLTVLPATHKYWHGEKVAFGTLAMLMLTDRAPELIEEVYQFCEDIGLPTTLADIGLAGVSDDELLAVARASCQTGETIHNEPFTITPEAVQAALRAADAVGQARKKIDLAG

SEQ ID NO: 200 - DNA, 1104 bp, Salmonella typhimurium LT2
  CDS (1)..(1104): transl_table=11
atggatcgcattattcagtcaccaggtaagtatattcagggtgcaaacgtcatcgcgcgtcttggcgattatttaaaaccaatggcgaacaactggctggttgtgggcgataaattcgtgctgggatttgccgaagagacgctgcgcaaaagcctgacggatgccggtttgtcagtagaaatcgccccgtttggcggcgaatgttcgcaaaatgagatcgacaggctgcgcgccgtcgccgaaaaaagtcagtgtggcgccgtactgggtatcggcggcggtaaaacgctggataccgccaaagcgctggcgcactttatgaacgtcccggtcgctatcgcgccgaccatcgcctctaccgacgcaccgtgcagcgcactctcggttatttataccgatgccggtgagtttgaccgttatctgctgctgccgcataacccgaatatggttattgtcgatacgcagatagtggcgggcgcgccggcgcgtctgctggcagccggtatcggcgatgcactggcgacctggtttgaagcgcgcgcctgctcacgcagcggcgccaccacaatggcgggcggcaagtgtacacaggccgcgctggcgctggcggagctatgctataacacgctgatcgaagaaggcgaaaaagccatgttggccgccgaacagcacgtcgtcacgccagcgctggaacgcgtcatcgaagccaacacctacctgagcggggtcggttttgaaagcggcggtctggccgcagcgcacgcgattcataacggtttaacggcgattccggatgcgcaccactattatcacggtgagaaggtcgctttcggtacgctgacgcaactggtgctggaaaacgcgccggtcgaagaaatcgaaaccgttgcggcgctgtgccattccgttggcctgccgattacgctggcgcaactggatattaaacaggatattccggccaagatgcgcaccgtcgcggaagcctcctgcgcagaaggtgaaactattcataacatgcctggcggcgcaacgccggatgaagtgtacgccgcgctgctggtcgccgaccagtacggtcaacgcttcttgcaggaatgggaataa

SEQ ID NO: 201 - protein, 367 aa, Salmonella typhimurium LT2
MDRIIQSPGKYIQGANVIARLGDYLKPMANNWLVVGDKFVLGFAEETLRKSLTDAGLSVEIAPFGGECSQNEIDRLRAVAEKSQCGAVLGIGGGKTLDTAKALAHFMNVPVAIAPTIASTDAPCSALSVIYTDAGEFDRYLLLPHNPNMVIVDTQIVAGAPARLLAAGIGDALATWFEARACSRSGATTMAGGKCTQAALALAELCYNTLIEEGEKAMLAAEQHVVTPALERVIEANTYLSGVGFESGGLAAAHAIHNGLTAIPDAHHYYHGEKVAFGTLTQLVLENAPVEEIETVAALCHSVGLPITLAQLDIKQDIPAKMRTVAEASCAEGETIHNMPGGATPDEVYAALLVADQYGQRFLQEWE

SEQ ID NO: 202 - DNA, 1107 bp, Listeria monocytogenes EGD-e
  CDS (1)..(1107): transl_table=11
ttgttgaataaagaattgattgttcgcggagctccgcaagaatatttatgccaagtaggcgcgtgggatacattacctactcacctagaacgccgcggtttgaaaaatgtattagtagttcgtggaaatgcttcttgggaagtcgctaaaaagaaattccctgttttatcaactgttacatctacttttgaagtatataatggtggttctacctacgaggagcgcgatcgtctggtggcaatcatggaaacaaataagatggatgcgattatcgcagtaggtggcgggaaaatagctgacgtatgtaaagcggcagcagcagttttacgtttgccagttattatcttaccgacgcttgcatcaacttgtgccgcttatacaccacttagtgtgatgtacgacgaagagggcgctatgattcgttacgatgtgtttgcgagtagtaatgcgcttttattaattgatccggaaatgattttagactcaccaaaagagttactaattgcaggaatcggtgatacgctagctaaatggtatgaagcagatgtgattataaattctttaccgaccaaatctgtcgaaattgaaatcgcgcactttgcagctaaaatgtgtcgtgataatttgctgcaatatagtggagaagctcttgctgccatggataaacaagtgttaaatgaagcgtttgttaaaattatcgagacgaatattttagttggtggaatggtcggtggttttggcgatgattatggacgttgtgcaggagcgcattcgattcatgacgcgctaacgatggttccagaaacacatcacttattgcatggtaataaggtagcttatggtattttagttcaattagtaatagaaaatagatgggatgaaatcgagcgtttgttgccattttattctgagcttggacttccgatgagtttgtatgatatggggcttgcgacacttgcagaagaaacgcttgtggacgtatctagacgtgcaacggaaccgcatgaaacaatccatatgatgccaggtgaaatgacagctgatgtggtgttaaatgcgatgaaacagttagaagatagtatggcaatgaaacgagtgactaagtaa

SEQ ID NO: 203 - protein, 368 aa, Listeria monocytogenes EGD-e
MLNKELIVRGAPQEYLCQVGAWDTLPTHLERRGLKNVLVVRGNASWEVAKKKFPVLSTVTSTFEVYNGGSTYEERDRLVAIMETNKMDAIIAVGGGKIADVCKAAAAVLRLPVIILPTLASTCAAYTPLSVMYDEEGAMIRYDVFASSNALLLIDPEMILDSPKELLIAGIGDTLAKWYEADVIINSLPTKSVEIEIAHFAAKMCRDNLLQYSGEALAAMDKQVLNEAFVKIIETNILVGGMVGGFGDDYGRCAGAHSIHDALTMVPETHHLLHGNKVAYGILVQLVIENRWDEIERLLPFYSELGLPMSLYDMGLATLAEETLVDVSRRATEPHETIHMMPGEMTADVVLNAMKQLEDSMAMKRVTK

SEQ ID NO: 204 - DNA, 1107 bp, Listeria innocua Clip11262
  CDS (1)..(1107): transl_table=11
ttgttgaataaggaattgattgtacgcggagctccacaagagtatttttgccaagtaggcgcatgggatactttacctacccacttagaacgccgcggtttgaaaaatgttttagtagttcgtggaaatgcttcttgggaagtcgctaaaaagaaattcccggtattatctaatgttacatctacttttgaagtatataatggcggttcaacgtatgaggaacgcgatcgtctggtagcgataatgaaaacaaataatatggatgcgattatagcagtcggtggcggaaaaattgctgatgtatgtaaagcagcggcagcagttttacggttaccagtgattattttaccaacacttgcttccacttgtgcggcttatacaccgcttagtgtgatgtatgacgttgaaggcgcaatgattcgttatgacgtattcgctagcagcaacgccttattattaattgatccggaaatgattttagattcaccaaaagaattgcttgttgcaggtattggcgatacgctcgctaaatggtatgaagcagatgtgattattaaatcattaccaactaaatctgtcgaaatcgaaattgctcatattgctgctaaaatgtgccgagacaatttactgcaatttagcgaagaagcacttaacgcaatggataagcaagaattaaatgaagcattcgtgaaaattatcgaaacaaatattttagttggcggaatggttggcggttttggtgatgattatggacgttgtgcgggagcgcattcgattcatgatgcattaactatggtgccagaaacgcatcatttgttacatggtaataaagtggcgtacggaattttagttcaactagttattgaaaatcgatggaatgaaattgaccaattactaccgttttatgccaaactgggtcttccaacgagtttgtatgatatggggctggcgacacttactgaagaaacaatcgttgctgtatctaaacgagcaactgagccacatgagacgatccatatgatgccaggtgaaatgacagctgaagtagtattaaatgcgataaaacagctggaagatagcatggcaatgaagcgtgtggctaagtaa

SEQ ID NO: 205 - protein, 368 aa, Listeria innocua Clip11262
MLNKELIVRGAPQEYFCQVGAWDTLPTHLERRGLKNVLVVRGNASWEVAKKKFPVLSNVTSTFEVYNGGSTYEERDRLVAIMKTNNMDAIIAVGGGKIADVCKAAAAVLRLPVIILPTLASTCAAYTPLSVMYDVEGAMIRYDVFASSNALLLIDPEMILDSPKELLVAGIGDTLAKWYEADVIIKSLPTKSVEIEIAHIAAKMCRDNLLQFSEEALNAMDKQELNEAFVKIIETNILVGGMVGGFGDDYGRCAGAHSIHDALTMVPETHHLLHGNKVAYGILVQLVIENRWNEIDQLLPFYAKLGLPTSLYDMGLATLTEETIVAVSKRATEPHETIHMMPGEMTAEVVLNAIKQLEDSMAMKRVAK

SEQ ID NO: 206 - DNA, 1191 bp, Nostoc sp. PCC 7120
  CDS (1)..(1191): transl_table=11
atgcctaatcaattatctaatcaaaccttgtctaatcaaactgctagttcattaatcaccctcgcggttgccccggcaaaagttatccgtggctgtaatatattgcaggtagccgccacagaaattgccaaattgggcagtcgtcctttaattgtggcaggtaatagcaccgttgctatcagccaagagaaactacagccaattttagaagcccagaatctgcacgttgcccaagcctcttatggtgcagattgtgcggaagttagcttaaaagccttgaggaaagcagccaaagaacataaagccgatacgattatcgggattggtgggggcaaagctttagatacagcaaagttagttgcccatcagttagatatacctatagtcacaattcccacatcggcagctacctgtgccgcttggacggcgctatcaaatgtatattctgaggacggggcgtttctttacgatgtggctttatctcgctgtcccgacttgctgatacttgactacgacttgatccaaactgcaccacaacatacactagtggcagggattggggatgcgatcgctaaatggtatgaagcttctgttagtagtgggcatttagaacaaactttaattatctccgcagtccaacaagcgcgagttttacgcgatattttattccaaaagtcggcaattgccttacaacaaccaggtagtgaagcttggcgggaagttgttgatgccacagttttactagctggtgtcatcggtggactcggtggggcgcagtgccgtacagtagccgcccatgcagtccataatggtttaacccacattgccggacacagtagtatccacggtgaaaaagttgcctacggtattttggtacagctgcgtctggaagaaatggtacaaggtaatcaattagcagccgcctcacgacaacaactattaaagttttatgcagagattggactgccacaaaaattaggagacttggggttgggtaatattaccttaggcgagttacaaacagccgccgaaatcgctttaacacctcaatctgacattcatcgtctaccattcaaagttgtgttggaacagttaatggcagcgatggtttctaccactgcaccaacagatagtagagactcagttcatcgtgtctccaccaggggaataagtgacgaggttgaggaatga

SEQ ID NO: 207 - protein, 396 aa, Nostoc sp. PCC 7120
MPNQLSNQTLSNQTASSLITLAVAPAKVIRGCNILQVAATEIAKLGSRPLIVAGNSTVAISQEKLQPILEAQNLHVAQASYGADCAEVSLKALRKAAKEHKADTIIGIGGGKALDTAKLVAHQLDIPIVTIPTSAATCAAWTALSNVYSEDGAFLYDVALSRCPDLLILDYDLIQTAPQHTLVAGIGDAIAKWYEASVSSGHLEQTLIISAVQQARVLRDILFQKSAIALQQPGSEAWREVVDATVLLAGVIGGLGGAQCRTVAAHAVHNGLTHIAGHSSIHGEKVAYGILVQLRLEEMVQGNQLAAASRQQLLKFYAEIGLPQKLGDLGLGNITLGELQTAAEIALTPQSDIHRLPFKVVLEQLMAAMVSTTAPTDSRDSVHRVSTRGISDEVEE

SEQ ID NO: 208 - DNA, 1131 bp, Clostridium perfringens str. 13
  CDS (1)..(1131): transl_table=11
atgagaaaggcttttatatgcccaacaaaatatgttcaaggagaaaatgaattacttaatttaggttactttgtagagacttacggaaagtcagcacttttaatagctcacccagaagatataaagagagttaaagataaattagatgcaacagcaaagaaatttaacattgaatttgtagaaggtggatttaaaggtgaatgttcacgtcaagaagttaaaagacttcaagatcttgcaaaggaaatgaaatgtgattgtacagtaggacttggtggaggaaaagctttagacacagctaaatgtgttgctgaaggtgaaaaacttatagtagtaccaacaatagcagctacagatgctccaactagtcactcagcagttttatatacagaagatggatcatttgatgattatgcatactttaaagcaagcccaagtgttgttttagtagacacagaggtaatagcaaaagctccaactcgtttcttagtagcaggtatgggagatgctttatcaacttactttgaagcaagagcaacatcaagttcatttactaaagtcaatgcgggattaccatgtggggtaagagaagaaaaatgtagaccagcaatcggaacaaatgcttcattagcacttgctaagctttgctatgaaacattattagaagacggaaagaaagctaaagatgcttgtgattgtaactgtgttactaaatctttagaaaatatagtagaaacaaacatattattatcaggtttaggatttgagagtggtggattagctgcagctcacgctatacatgatggtttaacaatattagaaggaacacatggatacttccatggagaaaaggttgcttttggaataatagctcaattagttcttgaaaatgcaccaaaagaagaattatatgaagttttagatttctgtttagaaataggtcttccagtatgtcttgaagatataggtgtaacagaagtttcagatgaagaattatttgaagttgcagaaaaagcttgtataccagaagagtcaatttactcaatgccatttggaatagaagtttcagaagtagtatcagcaattaaattagcagataagataggtaaagactacaaaaatagaaaataa

SEQ ID NO: 209 - protein, 376 aa, Clostridium perfringens str. 13
MRKAFICPTKYVQGENELLNLGYFVETYGKSALLIAHPEDIKRVKDKLDATAKKFNIEFVEGGFKGECSRQEVKRLQDLAKEMKCDCTVGLGGGKALDTAKCVAEGEKLIVVPTIAATDAPTSHSAVLYTEDGSFDDYAYFKASPSVVLVDTEVIAKAPTRFLVAGMGDALSTYFEARATSSSFTKVNAGLPCGVREEKCRPAIGTNASLALAKLCYETLLEDGKKAKDACDCNCVTKSLENIVETNILLSGLGFESGGLAAAHAIHDGLTILEGTHGYFHGEKVAFGIIAQLVLENAPKEELYEVLDFCLEIGLPVCLEDIGVTEVSDEELFEVAEKACIPEESIYSMPFGIEVSEVVSAIKLADKIGKDYKNRK

SEQ ID NO: 210 - DNA, 1353 bp, Schizosaccharomyces pombe 972h-
  CDS (1)..(1353)
atgattggtcctcgtctttgcgctgcaacccctcgcttccctctcgtttccctcgcccacaggaactctaaagtatttgcgctcgcctcttccaatgccgttgcacaacgttggggcaaacgcttttatgctcctattgaaacggagacgcctcacaaagttggtgtagagtttgaagaatccaaagatcgcattttcacctctcctcaaaagtatgttcagggtcgtcatgccttcactagatcctatatgtatgtcaaaaaatgggccactaaatcagctgtcgtgcttgccgaccagaacgtatggaacatttgtgccaataaaattgtcgattctctttctcaaaacggaatgactgtcaccaaactggtctttggcggcgaggcaagcttggtggaactggataaacttcgcaaacagtgccctgatgatactcaagtcatcattggagttggtggtggtaaaaccatggattccgcaaagtatattgctcattccatgaatcttccatccatcatttgtcctactactgcctcctctgatgccgctacttcctctctttccgtcatttacactcctgacggtcaattccaaaaatacagcttttacccccttaatcccaacctcattttcatcgataccgatgtgattgttcgcgctcccgtccgcttccttattagtggcattggtgatgctttgtccacctgggtggaaactgaatccgttattcgctcaaattccacttcctttgccggaggtgtggcctccattgctggccgttacattgcccgtgcttgcaaagacactcttgaaaagtatgccctgagcgctattctttccaacactcgcggtgtttgtaccgaggcatttgagaacgtggtcgaggccaacacattgatgtctggtctaggctttgaaaacggtggtcttgctgctgctcatgccatccataacggtatgaccgccatccacggtcccgttcatcgtttaatgcatggtgaaaaggttgcttacggtaccttagttcaagttgttttggaggattggccgttggaagacttcaataatcttgcttcttttatggcaaaatgtcatcttcccattacccttgaggaacttggtattcccaacgtaaccgatgaagagttattgatggtaggtagagctactttgcgacctgatgagagtattcacaacatgtcaaagaagttcaatccatctcaaattgctgacgctattaaagccgttgactcctattcacaaaaatggcaagaacaaactggatggaccgagcgttttagattacccccttctcgtcatagtcctcacttgaccgacattcatccatag

SEQ ID NO: 211 - protein, 450 aa, Schizosaccharomyces pombe 972h-
MIGPRLCAATPRFPLVSLAHRNSKVFALASSNAVAQRWGKRFYAPIETETPHKVGVEFEESKDRIFTSPQKYVQGRHAFTRSYMYVKKWATKSAVVLADQNVWNICANKIVDSLSQNGMTVTKLVFGGEASLVELDKLRKQCPDDTQVIIGVGGGKTMDSAKYIAHSMNLPSIICPTTASSDAATSSLSVIYTPDGQFQKYSFYPLNPNLIFIDTDVIVRAPVRFLISGIGDALSTWVETESVIRSNSTSFAGGVASIAGRYIARACKDTLEKYALSAILSNTRGVCTEAFENVVEANTLMSGLGFENGGLAAAHAIHNGMTAIHGPVHRLMHGEKVAYGTLVQVVLEDWPLEDFNNLASFMAKCHLPITLEELGIPNVTDEELLMVGRATLRPDESIHNMSKKFNPSQIADAIKAVDSYSQKWQEQTGWTERFRLPPSRHSPHLTDIHP

SEQ ID NO: 212 - DNA, 1089 bp, Streptococcus pyogenes MGAS8232
  CDS (1)..(1089): transl_table=11
atgaaagtatttgcaagtccatctcgttacattcaaggtaaaaatgccttgtttaccaatgctaaaaccctaaaacaactaggggatagccccattttactgtgtgatgacgtggtgtatggcatcgtcggagaaagatttgaaagctatttgatagataatggcatgactcctgttcacgtagcctttaatggcgaagcctcagataatgaaatcagccgcgtggttgccattgccaaggaaaatagcaatgatgttattattggacttggtggtggaaaaaccattgacagtgctaaggctatcgctgacttacttgctgttccagtgattattgccccaaccattgcttcaacagatgccccaacctcagccttatcggttatttacaccgatgaaggagcctttgaaaaatacattttctattcaaaaaatccagatcttgttttggttgacacacaagtgatctgtcaggcaccaaaacgattactggcctctgggattgcagatgggttagcaacatgggtagaggcgcgtgctgttatgcaaaaaaatggagacaccatggcaggtggcaatcaaaccttggcaggagttgccattgccaaagcctgtgagcagaccttgtttgcagatggcctaaaagcgatggctagttgtgacagacaagtcgtgaccccggccttggaaaatgtcattgaagccaatacacttcttagtggacttggttttgaaagtgcgggtctggctgctgcacatgccattcacaatggctttacagcgctgacaggtgctattcatcaccttacccatggtgaaaaagtcgcctatggcacgttgacccaactcttcttggaaaatcgttcgcgtgaagaaattgaccgctacatcgacttttaccaagccattggcatgccaacaaccctcaaagaaatgcatttagacacggctactcaagaggatttcttaaaaattggccgtcaagcaaccatggcaggcgaaaccatccatcaaatgccgtttgttatcagtccagaagatgtagcagcggctttggttgctgtcgatgcttatgttacgagtcgatag

SEQ ID NO: 213 - protein, 362 aa, Streptococcus pyogenes MGAS8232
MKVFASPSRYIQGKNALFTNAKTLKQLGDSPILLCDDVVYGIVGERFESYLIDNGMTPVHVAFNGEASDNEISRVVAIAKENSNDVIIGLGGGKTIDSAKAIADLLAVPVIIAPTIASTDAPTSALSVIYTDEGAFEKYIFYSKNPDLVLVDTQVICQAPKRLLASGIADGLATWVEARAVMQKNGDTMAGGNQTLAGVAIAKACEQTLFADGLKAMASCDRQVVTPALENVIEANTLLSGLGFESAGLAAAHAIHNGFTALTGAIHHLTHGEKVAYGTLTQLFLENRSREEIDRYIDFYQAIGMPTTLKEMHLDTATQEDFLKIGRQATMAGETIHQMPFVISPEDVAAALVAVDAYVTSR

SEQ ID NO: 214 - DNA, 1155 bp, Yersinia pestis KIM
  CDS (1)..(1155): transl_table=11
atggggaaaaacggggtcacatcgcaagctgtgaagcacactgatttggaaggaataaagggcatgagcgcgaacgcaattcgggtgcaggtggggcctgccaactatttttcttttccgggcgctatcgacaaactgagcgagttttatcctcaggcggcactggataaggctttgtggatttatggtgagcgtgcattggccgccgcccaggattacctgcccaaggcgtttcacgggccacaggccgtgcgtgctaaattctcaacgcattgtagtcagtctacggtcgctgatttggtcagcgcggcgggcggtgatcggcaggtcgtaattggtatcgggggcggtgcagtcctggataccgccaaagttgtggcccgtcagttgggggtaccgctggtggctatcccgactatcgctgctacctgtgccgcctggaccccgctttcggtctggtataacgaagccgggcaagcgttgaattttgaaattttcaacgatgccaaccatttggtactggtcgagccacgtatcatgttacacgcgccagtggaatatctgctggcggggatcggcgacacactggcgaaatggtatgaggcagtggtccttagcccgcagccagaaaccctatcgctgaccgtccgcttaggcttacaggccgctctggagattcgcaatgtgttgctcaagcagagcgaagcggcattgcaggcggttgctcagggtgaattgacacaagatttccttgatgtggttgatgccattattgccggcggagggatggtcggcgggttaggggagcgctatacccgagttgctgctgcgcatgcggtacacaatggcctgacgttgctgccacaaacggagcacttcttgcatggcaccaaagtggcatacggcatcttggtacaaacggcattgctgggacaagatgaggtgctgcggtcactgattgttgcttttaatcaattaggtttgccaacccatttggcggcgttagatgttgatattaatgaccgggaggcaatagaccgggttattggccggatcctgaaacccggagagtcaatacattacctgccaatcgccctgaattcagaaaaagtatgggcagcgattgagcaagtggaaatcgcggctcagcactga

SEQ ID NO: 215 - protein, 384 aa, Yersinia pestis KIM
MGKNGVTSQAVKHTDLEGIKGMSANAIRVQVGPANYFSFPGAIDKLSEFYPQAALDKALWIYGERALAAAQDYLPKAFHGPQAVRAKFSTHCSQSTVADLVSAAGGDRQVVIGIGGGAVLDTAKVVARQLGVPLVAIPTIAATCAAWTPLSVWYNEAGQALNFEIFNDANHLVLVEPRIMLHAPVEYLLAGIGDTLAKWYEAVVLSPQPETLSLTVRLGLQAALEIRNVLLKQSEAALQAVAQGELTQDFLDVVDAIIAGGGMVGGLGERYTRVAAAHAVHNGLTLLPQTEHFLHGTKVAYGILVQTALLGQDEVLRSLIVAFNQLGLPTHLAALDVDINDREAIDRVIGRILKPGESIHYLPIALNSEKVWAAIEQVEIAAQH

SEQ ID NO: 216 - DNA, 1149 bp, Thermosynechococcus elongatus BP-1
  CDS (1)..(1149): transl_table=11
gtgagaacttccttcagtttgtttgtacctgtgactgctgctttttcatccctttgcatcgcccctgcccacgtctatcgcggttggtcaattctctcccaagcaggggaagccattgcgcaattggggcatcatccccttttagtggtttcaccacagcggtatcagcagcttgagcaggagtggcaggcgatcgcccgctcccatgaccttagcttcaccgtagggacattccatggtgagtgcagtgagtccacccttgcccaactccgccaagaggcccaaggcagcgatctcatcatcggcattggcggtggcaaagcgctagataccgctaagctcttggggcaccagcttcacttgcccgtggtgaccatccccacctcagcagccacctgtgccgcttggaccgccctcgccaatatctatacagaggccggtgcttttgcctatgatgtggcactccgccagtgtccgaatctgctgttgttggactacgccctgattcaaacagcgccgaagcgaaccctgcttgccggcattggggatgccctggccaagtggtatgaggcgtcggtcagtagtggccaccgccaagaaaccctgattgtcgctgctgtacagcaagctcgtgtattgcgcgatattctcctacagcagtctgccgaagccttagccaatgtgggcagtcccgcctgggaaaatgtggttgatgccagtgtgctgatggcaggaatcatcggtggattggggggggcccaatgccgcacggtagcagcccatgctattcacaacggtctgacccaactgccccaaagtaagggcacactccacggtgaaaaagtggcctacggtattcttgttcaactccgtttggaagagatggtccaaggcagtcaactggccacgagtgctcgccatcagctttgccagttttatgaacaggtgggtctgcccctgagtttagaggatttgggcttgcaagaggctagcttggcgcaactccaacacgctgctacggttgcctgtgggcccaactccgatattcactatctgccctttccggtcacacccgatctggtgctcgaggcaatggtgtccaccgtggtcggctacagggacaaagtcttggatgggagtgctcgctag

SEQ ID NO: 217 - protein, 382 aa, Thermosynechococcus elongatus BP-1
MRTSFSLFVPVTAAFSSLCIAPAHVYRGWSILSQAGEAIAQLGHHPLLVVSPQRYQQLEQEWQAIARSHDLSFTVGTFHGECSESTLAQLRQEAQGSDLIIGIGGGKALDTAKLLGHQLHLPVVTIPTSAATCAAWTALANIYTEAGAFAYDVALRQCPNLLLLDYALIQTAPKRTLLAGIGDALAKWYEASVSSGHRQETLIVAAVQQARVLRDILLQQSAEALANVGSPAWENVVDASVLMAGIIGGLGGAQCRTVAAHAIHNGLTQLPQSKGTLHGEKVAYGILVQLRLEEMVQGSQLATSARHQLCQFYEQVGLPLSLEDLGLQEASLAQLQHAATVACGPNSDIHYLPFPVTPDLVLEAMVSTVVGYRDKVLDGSAR

SEQ ID NO: 218 - DNA, 1110 bp, Oceanobacillus iheyensis HTE831
  CDS (1)..(1110): transl_table=11
ttgagtgaacgaatttttataagtccagcaaaatatgtacaaggaaagaatgcaatccaacgaattggcgaatacgttaaagatattggtaatcaagcaattgttattgcagatgaaaatgtatgggaaatagcagcgaatgacgttgtaaagaatttaaaagaagagagtattgaagtagaagaagtagtatttaacggagaagcttccaaagctgagatggagcgaatttctaagattgcagatgaatctaattctactgtagttgtaggggttggtggtggtaaaacactagataccgcaaaagctgtttctgatgaagtaaaaggtcagacggtgattgtaccaacaacagcttcaacagatgctccaactagtgcgctttctgtagtttattccgatgatggtgtgtttgaagggtatcgtttttatgataaaaacccagacttagtaattgtagatacaaaaattgttgcaggagctcctaaacgtttcttagcatcaggaattgctgatgcattagccacttgggtagaagcacggagtgtgattgaaaataaaggtaaaacaatggctggtggaataaccacgatagcaggacaagctattgcagaaaaatgtgaagaaacgctatttaactatgcggaattggcatatgaatcagtgaaagcaaaagcagtaacacctgctctagagaatgttgttgaagcaaatacattattaagtggacttggatttgaaagtggtggactaggtgcagcacatgcgatccataatggttttactgccttagaaggtgaaattcatcacttaactcatggtgagaaagttgcttttggtaccttagttcaattggcattagaggagcgctcaaaagaagaaatcgaacgatatattaaattatatatcgcattagaccttccagtaacattagaagatatcaagctgaaagatgcaactcgtgaagatattatgaaagttgcagaagcagcgactgttgatgaagaaacaattcatgaagcatttaatgttactgcggatgatgttgcagatgctatctatgctgcagatcaatactctagatcgtataaagaaaaacatcagaagtaa

SEQ ID NO: 219 - protein, 369 aa, Oceanobacillus iheyensis HTE831
MSERIFISPAKYVQGKNAIQRIGEYVKDIGNQAIVIADENVWEIAANDVVKNLKEESIEVEEVVFNGEASKAEMERISKIADESNSTVVVGVGGGKTLDTAKAVSDEVKGQTVIVPTTASTDAPTSALSVVYSDDGVFEGYRFYDKNPDLVIVDTKIVAGAPKRFLASGIADALATWVEARSVIENKGKTMAGGITTIAGQAIAEKCEETLFNYAELAYESVKAKAVTPALENVVEANTLLSGLGFESGGLGAAHAIHNGFTALEGEIHHLTHGEKVAFGTLVQLALEERSKEEIERYIKLYIALDLPVTLEDIKLKDATREDIMKVAEAATVDEETIHEAFNVTADDVADAIYAADQYSRSYKEKHQK

SEQ ID NO: 220 - DNA, 1134 bp, Oceanobacillus iheyensis HTE831
  CDS (1)..(1134): transl_table=11
atgtccacatcgattgtaaaaggagctccgggtcattatcggattggcgcggatgtcttggaggaaattcctgtactgcttgaagaactgtcagttaatcgtatacaagttatcgcagggaagagatcatggcaggcggcaaagccgtatttgccttttgtattagtgaagcaagtagaagcgaatatcatctttattgacggtcataccacgctagaaaaagcggataaaatagcggatcagcttcaccaacatgcgattgatgccgtaattggtataggtggcgggactgcactggatataacgaaagccgcagctgctaaagcagaggttaaatcggttttaattccgacaattgctgcgacctgtgctgcatggacaccgcttagtgtcttttacgacagtaatggagcatttacacactatacgtattttccattagcgacgacacttgtattagtagagccggcgattattgcgcatgctcctatcgaatacttacgagcggggattggtgatacgctggcaaaattttatgaagccgacgcattaatcgagagtttttacccgaatgaagaagtgcctgttcccgtgaaagtttcccaattctccgctagtatttgtcgagatgtattgctggaagacggaaaagcagcactcgatgccgtccgggataaacaagtgacaccggcattaatccgtgttatcgaggcgattattataacaggcggaatggtaggcggatttggcgataaggcagggcgaattgccggggcacattcactacataatggattaacggaagccagcgaggctcaacacttcttgcacggggagcttgtggcatacggcatccttggtcaattggcattcgaacaaaaagaagaagagcttttgcgattactcgatttttatgatcaatggcagttgccatctagtttacaggagatcggtattgatataactaatactgatctcgtcgaaaggattattcagaaagcaattctgccgcaagagtcgatacattttatgaaccgggaagtgacggcggaatctttagcaagtgcgttacagcaagtagagaaaaataatcaaatctattacaaggaaaaaagaggagagaaaacatcatga

SEQ ID NO: 221 - protein, 377 aa, Oceanobacillus iheyensis HTE831
MSTSIVKGAPGHYRIGADVLEEIPVLLEELSVNRIQVIAGKRSWQAAKPYLPFVLVKQVEANIIFIDGHTTLEKADKIADQLHQHAIDAVIGIGGGTALDITKAAAAKAEVKSVLIPTIAATCAAWTPLSVFYDSNGAFTHYTYFPLATTLVLVEPAIIAHAPIEYLRAGIGDTLAKFYEADALIESFYPNEEVPVPVKVSQFSASICRDVLLEDGKAALDAVRDKQVTPALIRVIEAIIITGGMVGGFGDKAGRIAGAHSLHNGLTEASEAQHFLHGELVAYGILGQLAFEQKEEELLRLLDFYDQWQLPSSLQEIGIDITNTDLVERIIQKAILPQESIHFMNREVTAESLASALQQVEKNNQIYYKEKRGEKTS

SEQ ID NO: 222 - DNA, 1089 bp, Shigella flexneri 2a str. 301
  CDS (1)..(1089): transl_table=11
atgcctcacaatcctatccgcgtggtcgtcggcccggctaactacttttcacatccaggaagtttcaatcacctgcacaattttttcactgatgaacaactttctcgcgcggtgtggatctacggcaaacgcgccattgctgcggcgcaaaccaaacttccgccagcgtttggacttccaggggcaaagcatattttgtttcgtggtcattgcagcgaaagcgatgtacagcaactggcggctgagtccggtgacgatcgcagcgtggtgattggcgtcggcggcggcgcactgctcgacaccgcgaaagccctcgcccgccgtctcggtctgccatttgttgccgctccgacgatcgccgccacctgcgcagcctggacaccgctctccgtctggtataacgatgccggacaggcgctgcattatgagattttcgacgacgccaattttatggtgctggtggaaccggagattatcctcaatgcaccgcaacaatatctgctggcggggatcggtgacacgctggcgaaatggtatgaagcggtggtgctggctccgcaaccagaaacgttgccgctaaccgtgcggctggggatcaataatgcgcaggccattcgcgacgtcttgttaaacagtagcgaacaggcacttgccgatcagcaaaatcagcagttaacgcaatcattttgcgatgtggtggatgctattattgctggtggtgggatggtcggtggtctgggcgatcgttttacgcgtgtggcggcggctcatgccgtgcataacggtctgactgtcctgccgcaaaccgagaagtttcttcacggcaccaaagtcgcttacggaattctggtgcaaagcgccttgctgggtcaggatgatgtgctggcgcaattaaccggggcgtatcagcgttttcatctgccgactacgctggcggagctggaggtggatatcaataatcaggcggagatcgacaaagtgattgcccacaccttgcgcccggtggagtccattcattacctgccagtcacgctgacaccagatacgttgcgtgcagcgttcgaaaaagtggaatcgtttaaagcctga

SEQ ID NO: 223 - protein, 362 aa, Shigella flexneri 2a str. 301
MPHNPIRVVVGPANYFSHPGSFNHLHNFFTDEQLSRAVWIYGKRAIAAAQTKLPPAFGLPGAKHILFRGHCSESDVQQLAAESGDDRSVVIGVGGGALLDTAKALARRLGLPFVAAPTIAATCAAWTPLSVWYNDAGQALHYEIFDDANFMVLVEPEIILNAPQQYLLAGIGDTLAKWYEAVVLAPQPETLPLTVRLGINNAQAIRDVLLNSSEQALADQQNQQLTQSFCDVVDAIIAGGGMVGGLGDRFTRVAAAHAVHNGLTVLPQTEKFLHGTKVAYGILVQSALLGQDDVLAQLTGAYQRFHLPTTLAELEVDINNQAEIDKVIAHTLRPVESIHYLPVTLTPDTLRAAFEKVESFKA

SEQ ID NO: 224 - DNA, 1095 bp, Streptococcus mutans UA159
  CDS (1)..(1095): transl_table=11
atgatgaaaatttttgccagcccatcacgttatattcagggtgaaaaagctttatttgaaaatgcaaaagctattattaatttgggttctcatcctatccttttaacagacaatgtcgtttatgatattgttggtaaacgtttcgaaacttatcttaaccaagaaggattgatagtagatcgtatagcctttaatggtgaagcttcaataaacgaaattgatcgcgttgttgctatagctaaagaaaagggaaatgatttaattattggtcttggtgggggaaagacgattgacagtgctaaagccattgctgatttattagagatacctgttattattgctcctacagttgcctcgacagatgctccaacatcagccttgtccgtcatttatactgaccaaggtgcttttgaaaaatacattttctattccaaaaatccagatcttgttttagtagatactgaagtcatcagtaaatctccagttattctactggcttcgggaattgcagatggacttgctacttgggtagaagcaagagctgtgcttcaaaaaaatgggcaaacaatgactggtgcagggcaaactttagctagccttgctattgcccaagcctgtgagcgtactttatttgcagatggtctacaagcgctggcagcttgtgaagcaaaagtagtgacaagagcacttgaaaatgttatagaggctaataccttattaagtggtttagggtttgaaagtgcaggtttggccgcagctcacgctattcataacggttttacagccttaacgggagatattcatcatctgacacatggtcaaaaagttacttatggaaccttaacgcaactctttcttgaaaatcgtccaaaagaagaaattgataagtatattcatttttatagagcaattggcatgccaacgactttagaagaaatgcacttgggagatgctgactattctgaacttctaaagattggccaacaagctacaattgaaggcgaaacgattcatcaaatgccatttgaaattaaggcaggtgatgttgccaatgcactcttagcagtagatcagtacactagatcattaaaataa

SEQ ID NO: 225 - protein, 364 aa, Streptococcus mutans UA159
MMKIFASPSRYIQGEKALFENAKAIINLGSHPILLTDNVVYDIVGKRFETYLNQEGLIVDRIAFNGEASINEIDRVVAIAKEKGNDLIIGLGGGKTIDSAKAIADLLEIPVIIAPTVASTDAPTSALSVIYTDQGAFEKYIFYSKNPDLVLVDTEVISKSPVILLASGIADGLATWVEARAVLQKNGQTMTGAGQTLASLAIAQACERTLFADGLQALAACEAKVVTRALENVIEANTLLSGLGFESAGLAAAHAIHNGFTALTGDIHHLTHGQKVTYGTLTQLFLENRPKEEIDKYIHFYRAIGMPTTLEEMHLGDADYSELLKIGQQATIEGETIHQMPFEIKAGDVANALLAVDQYTRSLK

SEQ ID NO: 226 - DNA, 1092 bp, Streptococcus mutans UA159
  CDS (1)..(1092): transl_table=11
atgacaactactataatggcaagctatagttatggtgaggactgctatcaagaaattcccgaagtcttaaaaccttatcatattaagcgggtggtcttaattgggggagagagagccttggccagcagtgaggatgaggttcgcagtattttggtgcaggcaggtatcgaagtgacgggcagctttgtctacggcgttgattcgacacaaacaaacattgataaactggtagctaatccagatgtacagagagcggaagctatttttggttttggaggcggaaaagcacttgatacagctaaaatggttgctaaagaattggataaacctacctttactttcccgacaatttgctctaattgttcggctgggacagcgattgcagtcgtttacaatgatgatcattctcttttaaaatatggctatcctgattcgccgcttcatatttttattaatacgcgtgttattgcacaagcacctgagaagtatttttgggcaggtattggcgatggtatttcaaaagctcctgaagttgagcatgctatcttggaagcaaagaaaaaagggacagcagagtttcctcataccgcaagattaggtgaggctgtggcactatcttcaaaagaggccttttatcgttatggtcaacaagggctggaagatgtacgaaataacaaagtatctcgggcagttgaagaaattgcacttgatattgtggtatcaactggttatgcttctaacttggtcaatcagcctgatttttactacaactcttgtcatgcccatgctttttataatggcacaactgccatcaggcgcgaaggagaataccttcatggtatggttgtttcttatggtgtgttagtcttgcatgcatattttgatgaacaagaagaactggaacgtgtggctaatttcaacaaggcattaggattgccaatcagattgcaggaactaggattgactaaggaagatattcctaaaattgttgaagttgccttaacaactaatgaataccgcaatacaccttttgaccctgaaaaatttgctcaagctatccgtacggttgattatctcggtcagcaattataa

SEQ ID NO: 227 - protein, 363 aa, Streptococcus mutans UA159
MTTTIMASYSYGEDCYQEIPEVLKPYHIKRVVLIGGERALASSEDEVRSILVQAGIEVTGSFVYGVDSTQTNIDKLVANPDVQRAEAIFGFGGGKALDTAKMVAKELDKPTFTFPTICSNCSAGTAIAVVYNDDHSLLKYGYPDSPLHIFINTRVIAQAPEKYFWAGIGDGISKAPEVEHAILEAKKKGTAEFPHTARLGEAVALSSKEAFYRYGQQGLEDVRNNKVSRAVEEIALDIVVSTGYASNLVNQPDFYYNSCHAHAFYNGTTAIRREGEYLHGMVVSYGVLVLHAYFDEQEELERVANFNKALGLPIRLQELGLTKEDIPKIVEVALTTNEYRNTPFDPEKFAQAIRTVDYLGQQL

SEQ ID NO: 228 - DNA, 1089 bp, Streptococcus agalactiae NEM316
  CDS (1)..(1089): transl_table=11
atgaaagttttcgcaagtccatcgcgctatatacaaggaaaggatgctttattccaaagtattgaacatatcaaatctttaggtcagactccacttatcctttgtgatgatgttgtttataatatcgttggagaaaggtttttatcttatctacaagacgatttgttaccacatcgtgtttcctttaacggagaagcatctgataatgaaatcaatcgtgtcgttgctgttgcgaaagaaaagaatagtgaccttattattggacttggtggtggaaaaactattgactctgcaaaggcaattgcagataaagttaatttaccagtggtcattgcaccaacagtagcttcaacagatgccccaacatcagcgttatcagtaatctatacagatgaaggagcttttgaaaaatatattttttattcaaagaatccagacttagttttagttgatactcaagtaattgcccaagcgccaaaacgtttactagcttctgggatagcagatggcttagctacttgggttgaagcgagagcagtcttacaaaaaaatgggatagcgatggctggcggtagacagactttagcgggcgtggcaattgcccaagcatgtgagcgtactttatttaatgatagtttacaagctttagcggcttgtgatgccaaagtggttacaaaagctttagaaaatgttattgaagctaataccttacttagtggtttaggttttgaaagtgcaggattagctgcagctcatgctattcataatggttttactgccttgagtggagatattcatcacttaacccatggtgaaaaagttgcctatggaacgttgacgcaacttttcctcgaaaatagaccaaaggaagaaattgatcgctacattaatctttaccaagcgattggaatgccaactacacttgcagaactccatttgggtgatgcaacatatgaagaacttttaaaagttggtcagcaagcaacaattgaaggtgaaacaatacatgaaatgccattcaaaattagtgcagaggatgtcgctgcagccctgttaacggttgaccgttatgtttcaaatcatcaataa

SEQ ID NO: 229 - protein, 362 aa, Streptococcus agalactiae NEM316
MKVFASPSRYIQGKDALFQSIEHIKSLGQTPLILCDDVVYNIVGERFLSYLQDDLLPHRVSFNGEASDNEINRVVAVAKEKNSDLIIGLGGGKTIDSAKAIADKVNLPVVIAPTVASTDAPTSALSVIYTDEGAFEKYIFYSKNPDLVLVDTQVIAQAPKRLLASGIADGLATWVEARAVLQKNGIAMAGGRQTLAGVAIAQACERTLFNDSLQALAACDAKVVTKALENVIEANTLLSGLGFESAGLAAAHAIHNGFTALSGDIHHLTHGEKVAYGTLTQLFLENRPKEEIDRYINLYQAIGMPTTLAELHLGDATYEELLKVGQQATIEGETIHEMPFKISAEDVAAALLTVDRYVSNHQ

SEQ ID NO: 230 - DNA, 1086 bp, Streptococcus agalactiae NEM316
  CDS (1)..(1086): transl_table=11
atgacaacaaatgtaatggcaaattatagctacggagaagattgcttcaaagaaattcctagcgttttggcaacttaccgtattcaaagcattgctttcgtcggtggcaaacgtgccctagacagctcagaagccgaggttcgctctattttagaggaagcaaatattaaagtcacaggaagctttgtctatggaacggattcaacacaatctaacattgacaagttagtagccaacccacaagttcaagccgctgatgctatcttaggttttggcggtggaaaagctttagacacagctaaaatggtagcaaaagagttaggtaaaaatagctttactatcccaactatttgttctaattgctccgcaggtactgccattgcagttgtatataatgatgaccattctttcttaagatacggctatcccgagtctccacttcatatttttatcaatacacggattattgcacaggcaccaagcaaatatttttgggctggtattggggacggtatttcaaaagcccctgaagtagaacgtgctaccttagaggctaagaccaataaactaccacatactgcagtgttaggacaagcagtcgctctgtcttcaaaggaagctttttatcaatttggtgaacaaggtctaaaagatgttgaagctaatttagcttcgcgtgcagttgaagaaattgcgcttgatatcttaatctcaactggctatgcttctaatttagttaatcaacctgatttctactacaattcttgtcacgcgcatgcattttactatggtacaaccgctattcaaagacaaggtgaattcttacatggcgttgtagttgcgtttggtgtgttagttttacatgcttatttcaacgaactagaagaacttgaaaaagtagctcgttttaataagtcactaggtttgccaacaactctagctgacgtctctttatcagaaaaagatattccaaaaattgttgaaattgcaatgactactaatgaatacaaaaatacccctttcgatcccaaaatgtttgctcaagctattttagcagcagacgctttcggacagacactagcctaa

SEQ ID NO: 231 - protein, 361 aa, Streptococcus agalactiae NEM316
MTTNVMANYSYGEDCFKEIPSVLATYRIQSIAFVGGKRALDSSEAEVRSILEEANIKVTGSFVYGTDSTQSNIDKLVANPQVQAADAILGFGGGKALDTAKMVAKELGKNSFTIPTICSNCSAGTAIAVVYNDDHSFLRYGYPESPLHIFINTRIIAQAPSKYFWAGIGDGISKAPEVERATLEAKTNKLPHTAVLGQAVALSSKEAFYQFGEQGLKDVEANLASRAVEEIALDILISTGYASNLVNQPDFYYNSCHAHAFYYGTTAIQRQGEFLHGVVVAFGVLVLHAYFNELEELEKVARFNKSLGLPTTLADVSLSEKDIPKIVEIAMTTNEYKNTPFDPKMFAQAILAADAFGQTLA

SEQ ID NO: 232 - DNA, 1089 bp, Escherichia coli CFT073
  CDS (1)..(1089): transl_table=11
  misc_feature (370)..(370): r is g or a
atgcctcacaatcctatccgcgtggtcgtcggcccggctaactacttttcacatcccggaagtttcaatcacctgcacgattttttcactgatgaacaactttctcgcgcggtgtggatctacggcgaacgcgccattgctgcggcacaaaccaaactgccgcctgcgtttgaactgccaggggtaaagcatattttgtttcgtggtcattgcagcgaaagcgatgtgcaacaactggcggcggagtccggtgacgatcgcagcgtggtgattggcgtcggcggcggcgcactactcgacaccgcgaaagccctcgcccgccgtctcggtctgccgtttgttaccgttccgacgatcgccgctacctgcrccgcctggacaccgctctctgtctggtataacgatgccggacaagcgctgcattatgagattttcgacgacgccaattttatggtgctggtggaaccggagattatcctcaacgcgccgcaacaatatctgctggcggggatcggtgacacgctggcgaaatggtatgaagcggtggtgctggccccgcaaccagaaacgttgccgctaaccgtgcggctagggatcaataatgcgcaggctattcgcgacgtcttgttaaacagtagcgaacaggcgctgagcgatcagcaaaatcaccagttaacgcaatcattttgcgatgtggtggatgccattattgctggtggtgggatggttggtggtctgggcgatcgttttacgcgtgtggcggcagctcatgccgtgcataacggtctgaccgtgctgccgcaaaccgagaagtttctccacggcaccaaagtcgcctacggaattctggtgcaaagcgccttgctgggtcaggatgatgtgctggcgcaattaactggagcgtatcagcgttttcatctgccgactacgctggcggagctggaagtggatatcaataatcaggcggagatcgacaaagtgattgcccacaccttgcgtccggtggaatccattcattacctgccggtcacgctgacaccagatacgttgcgtgcagcgttcgaaaaagtggaatcgtttaaagcctga

SEQ ID NO: 233 - protein, 362 aa, Escherichia coli CFT073
  misc_feature (124)..(124): The Xaa at location 124 stands for Ala, or Thr.
MPHNPIRVVVGPANYFSHPGSFNHLHDFFTDEQLSRAVWIYGERAIAAAQTKLPPAFELPGVKHILFRGHCSESDVQQLAAESGDDRSVVIGVGGGALLDTAKALARRLGLPFVTVPTIAATCXAWTPLSVWYNDAGQALHYEIFDDANFMVLVEPEIILNAPQQYLLAGIGDTLAKWYEAVVLAPQPETLPLTVRLGINNAQAIRDVLLNSSEQALSDQQNHQLTQSFCDVVDAIIAGGGMVGGLGDRFTRVAAAHAVHNGLTVLPQTEKFLHGTKVAYGILVQSALLGQDDVLAQLTGAYQRFHLPTTLAELEVDINNQAEIDKVIAHTLRPVESIHYLPVTLTPDTLRAAFEKVESFKA

SEQ ID NO: 234 - DNA, 1143 bp, Escherichia coli CFT073
  CDS (1)..(1143): transl_table=11
atgccgcatttggcactactcatctctaaaggagtaattatggaccgcattattcaatcaccaggtaaatacatccagggcgcagatgtaattaatcgtctgggcgagtacctgaagccactggcggaacgctggttagtggtgggtgacaaatttgttttaggttttgctcaatccactgtcgagaaaagctttaaagatgctggactggtagtagaaattgcgccgtttggcggtgaatgttcgcaaaatgagatcgaccgtctgcgtggcatcgcggagactgcgcagtgtggcgcaattctcggtatcggtggcggaaaaaccctcgatactgccaaagcactggcacatttcatgggtgttccggtagcgatcgcaccgactatcgcttctaccgacgcaccgtgcagcgcattgtctgttatctacaccgatgagggtgagtttgaccgctatctgctgttgccaaataacccgaatatggtcattgtcgacaccaaaatcgtcgctggtgcacctgcacgtctgttagcggcgggtatcggcgatgcgctggcaacctggtttgaagcgcgtgcctgttcccgtagcggcgcgaccaccatggcgggtggcaagtgcactcaggcagcgctggcactggctgaactgtgctacaacaccctgctggaagaaggcgaaaaagcgatgcttgccgccgaacagcatgtagtgactccagcgctggagcgcgtgattgaagcgaacacctatttgagtggcgttggttttgaaagcggcgggctggcggcggcacacgcggtacataacggcctgaccgctatcccggacgcgcatcactattatcatggtgaaaaagtggcattcggtacgctgacgcagctggttctggaaaacgcgccggtggaggaaatcgaaaccgtagctgcgcttagccatgcggtaggtttgccaataactctcgctcaactggatattaaagaagatgtcccggcgaaaatgcgaattgtggcagaagcggcatgtgcagaaggtgaaaccatccacaacatgcctggcggcgcgacgccagatcaggtttacgccgcactgctggtagccgaccagtatggtcagcgtttcctgcaagagtgggaataa

SEQ ID NO: 235 - protein, 380 aa, Escherichia coli CFT073
MPHLALLISKGVIMDRIIQSPGKYIQGADVINRLGEYLKPLAERWLVVGDKFVLGFAQSTVEKSFKDAGLVVEIAPFGGECSQNEIDRLRGIAETAQCGAILGIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENAPVEEIETVAALSHAVGLPITLAQLDIKEDVPAKMRIVAEAACAEGETIHNMPGGATPDQVYAALLVADQYGQRFLQEWE

SEQ ID NO: 236 - DNA, 1101 bp, Clostridium tetani E88
  CDS (1)..(1101): transl_table=11
atgttaaaagttatgagaacaccttctagatacgtacaaggatcagattctattttagatatttatactcatacttcatttcttggagattcatatttcataatagcagataatatagttatggaaatgacaaaaggtaaaatagaaaaagcttttgaaaacaagaattgtaacattgtatttgaaaactttaatggtcaatgtacaagaaaagaaattaatagattactggataaaataaaagaaaataattgcactataatagttggcgtaggtggtggaagaactctagatactgctaaggctataggacattttggaaacttacctattgttattattccaacagttgcggcaacagatgcaccttgtacagctctttctgttctatacacagaagaaggaaattttgaagaatatcttttttatgaaaaaaatccagacgtagttcttgttgacaccacagtaattgcaaaagcaccagtaaggtttatgatagcaggtatgggcgatgcacttgctacatattttgaagcaagagcttgtttaaattctaattcattaaaccttgtaagtggatcaatttcattggctgcatattcactttcaaaactttgttatgaaacacttttagattatggttataaagctaaattatctgtagaagacaaagttgtaactccatcagtggaaaagataattgaagctacaacttatttaagtggtgtaggagctgaaaatggtggtcttgctgcagcccattcggtatataatgcctttacacttcttgaagaatgcgaaaaatatatgcatggagaaattgttgcctttggtaccttagttcaacttgttcttgaagatagtccaatggaggaaataaatgaggttgcttcattctgcgtaactgttaatcttcctttaactttagctgaaataggaattaatgaaattaacgaagaaaaattaatgaaagttgccaaagctgcctgtgcaccaggggaaactattcataatatgcttggaggtgtaaccccggaacaactatataatgctattttggtagctaataaattagggcttcaatataaaaatttatgttaa

SEQ ID NO: 237 - protein, 366 aa, Clostridium tetani E88
MLKVMRTPSRYVQGSDSILDIYTHTSFLGDSYFIIADNIVMEMTKGKIEKAFENKNCNIVFENFNGQCTRKEINRLLDKIKENNCTIIVGVGGGRTLDTAKAIGHFGNLPIVIIPTVAATDAPCTALSVLYTEEGNFEEYLFYEKNPDVVLVDTTVIAKAPVRFMIAGMGDALATYFEARACLNSNSLNLVSGSISLAAYSLSKLCYETLLDYGYKAKLSVEDKVVTPSVEKIIEATTYLSGVGAENGGLAAAHSVYNAFTLLEECEKYMHGEIVAFGTLVQLVLEDSPMEEINEVASFCVTVNLPLTLAEIGINEINEEKLMKVAKAACAPGETIHNMLGGVTPEQLYNAILVANKLGLQYKNLC

SEQ ID NO: 238 - DNA, 1083 bp, Vibrio parahaemolyticus RIMD 2210633
  CDS (1)..(1083): transl_table=11
atggacaaaattattatcagcccaagcaaatacgtccaaggtgaacaagtacttacatctatcgctcactatgtgaaaacattgggtgaacgtccgttagtaattgccgatgagttcgtgactaacctggttggtgatgacgtcaaacaaagttttgctgacgaaaagcttccactcactatgaacatttttggtggcgaatgttcgcgcattgagattgaacgcatcacggacatttgtgccactcaaaaacacgatgtcattgtcggtattggtggcggtaaaacgttagatacagcaaaggccgttgcgttttacaccaaaattcctgtcgtggtggttcctacgattgcctcgactgatgcgccaacctctgctcttgcggtgatatacacaccagaaggtgaatttgcggaatacttgatgatccctaaaaacccagacatggtcatcatggatacatcagtcatcgccaaagcccctgttcgcctactggtatcggggatgggtgacgcgctttccacctactttgaagccagagccaacatgacctctggtaaggcaacaatggctggtggtttagcgacacgttcagcgcaagctcttgcgaaactttgctatgaaaccttgcttgaagatggtttaaaagcaaaagctgcggtagaaaatggtgtgagcaccaaagcggtagaaaatattattgaagccaatacatacctaagcggtatcggttttgaaagcagtggcctggcaggtgctcacgctattcataacggcctaactaagcttgaagagtgtcatcatctctatcatggtgagaaagtcgcgttcggcacacttgttcaattggtgctagaaaacgcagcgatggaagagattaatacggttctcgccttctgccgctctgtaggtctaccaaccaacttatttgatatgggcgttaaagagcttaatcacgctaagttgcgcgaggtcgccgaagcttcaacggccgagggagaaaccatccacaatatgccattcccagtgacggcagaaaatgtctactctgctattctaaccgctcatcaactgggccaataa

SEQ ID NO: 239 - protein, 360 aa, Vibrio parahaemolyticus RIMD 2210633
MDKIIISPSKYVQGEQVLTSIAHYVKTLGERPLVIADEFVTNLVGDDVKQSFADEKLPLTMNIFGGECSRIEIERITDICATQKHDVIVGIGGGKTLDTAKAVAFYTKIPVVVVPTIASTDAPTSALAVIYTPEGEFAEYLMIPKNPDMVIMDTSVIAKAPVRLLVSGMGDALSTYFEARANMTSGKATMAGGLATRSAQALAKLCYETLLEDGLKAKAAVENGVSTKAVENIIEANTYLSGIGFESSGLAGAHAIHNGLTKLEECHHLYHGEKVAFGTLVQLVLENAAMEEINTVLAFCRSVGLPTNLFDMGVKELNHAKLREVAEASTAEGETIHNMPFPVTAENVYSAILTAHQLGQ

SEQ ID NO: 240 - DNA, 1089 bp, Streptococcus pyogenes SSI-1
  CDS (1)..(1089): transl_table=11
atgaaagtatttgcaagtccatctcgttacattcaaggtaaaaatgccttgtttaccaatgctaaaaccctaaaacaactaggggatagccccattttactgtgtgatgacgtggtgtatggcatcgtcggagaaagatttgaaagctatttgatagataatggcatgactcctgttcacgtagcctttaatggcgaagcctcagataatgaaatcagccgcgtggttgccattgccaaggaaaatggcaatgatgttattattggacttggtggtggaaaaaccattgacagtgctaaggctatcgctgacttacttgctgttccggtgattattgccccaaccattgcttcaacagatgccccaacctcagccttatcagttatttacaccgatgaaggagcctttgaaaaatacattttctattcaaaaaatccagatcttgttttggttgacacacaagtgatctgtcaggcaccaaaacgcttattggcgtcagggattgcagatgggttagcaacatgggtagaagcgcgtgctgttatgcaaaaaaatggagacaccatggcaggtggcaatcaaaccttggcaggagttgccattgccaaagcctgtgagcagaccttgtttgcagatggcctaaaagcgatggctagctgtgacagacaagtcgtgaccccggccttggaaaatgtcattgaagccaatacacttcttagtgggcttggttttgaaagtgcgggtctggctgctgcacatgccattcacaatggttttacagcactgacaggtgctattcatcaccttactcatggtgaaaaagtcgcctatggcacgttgacccaactcttcttggaaaatcgttcgcgtgaagaaattgaccgctacatcgacttttaccaagccattggcatgccaacaaccctcaaagaaatgcatttagacacggctactcaagaggatttcttaaaaattggccgtcaagcaaccatggcaggcgaaaccatccatcaaatgccatttgttatcagtccagaagatgtagcagcggctttggttgctgttgatgcctatgttacgagtcgatag

SEQ ID NO: 241 - protein, 362 aa, Streptococcus pyogenes SSI-1
MKVFASPSRYIQGKNALFTNAKTLKQLGDSPILLCDDVVYGIVGERFESYLIDNGMTPVHVAFNGEASDNEISRVVAIAKENGNDVIIGLGGGKTIDSAKAIADLLAVPVIIAPTIASTDAPTSALSVIYTDEGAFEKYIFYSKNPDLVLVDTQVICQAPKRLLASGIADGLATWVEARAVMQKNGDTMAGGNQTLAGVAIAKACEQTLFADGLKAMASCDRQVVTPALENVIEANTLLSGLGFESAGLAAAHAIHNGFTALTGAIHHLTHGEKVAYGTLTQLFLENRSREEIDRYIDFYQAIGMPTTLKEMHLDTATQEDFLKIGRQATMAGETIHQMPFVISPEDVAAALVAVDAYVTSR

SEQ ID NO: 242 - DNA, 1089 bp, Salmonella enterica subsp. enterica serovar Typhi Ty2
  CDS (1)..(1089): transl_table=11
atgaaccacactgagatccgcgtcgttaccggcccggcgaattatttttcccatgcaggaagcctcgaaagactgaccgactttttcacgccggaacagctttcccacgctgtttgggtgtacggcgaacgcgcgattgccgccgcccggccttacctgccggaagcgtttgaacgtgctggcgcaaaacatctgcagtttaccggccattgtagcgaacgccatgttgcccaactggcgcacgcctgcaacgacgatcgtcaggtggtaataggcgtcggcggcggcgcgctgctcgataccgccaaagcgcacgcccgccgtctggcgctgccgtttgtcgctatcccgacgatcgcggcgacctgcgccgcctggacaccgctttccgtctggtataacgacgcgggacaggcgttacagttcgaaatttttgatgatgccaattttctggtgctggtcgaaccgcgcattattctgcaggcgcccgatgactatctgttagctggcattggcgatacgctggcgaaatggtatgaagccgttgtgcttgcgccgcagcctgaaacgttgccattgaccgtaaggctgggcattaacagcgcgtgcgctattcgcgatctcctactgaccagcagcgaacaagcattagcggataaacagcagcgtcggctgacccaggcattttgcgacgtggtggatgcgattattgctggcggcggtatggtcggcggcctcggggaacgctatacccgtgtcgccgccgcccatgcggtacacaacggtctgaccgtcctgccgcaaacggaaaaattcctgcacggaacgaaagtggcttatggcattctggtgcaaagcgcgctactgggacaagatgacgtgctggcgcaattgattacagcgtaccggcgatttcatctgccgacccggcttagcgaactggacgtggatattcataacaccgcagagatcgatagggtcatcgcgcataccctgcgcccggtcgaatctatccactatttaccggtgacgttaacgccagacaccctgcgtgcggcgtttgaaaaagttgaatttttcagaatatag

SEQ ID NO: 243 - protein, 362 aa, Salmonella enterica subsp. enterica serovar Typhi Ty2
MNHTEIRVVTGPANYFSHAGSLERLTDFFTPEQLSHAVWVYGERAIAAARPYLPEAFERAGAKHLQFTGHCSERHVAQLAHACNDDRQVVIGVGGGALLDTAKAHARRLALPFVAIPTIAATCAAWTPLSVWYNDAGQALQFEIFDDANFLVLVEPRIILQAPDDYLLAGIGDTLAKWYEAVVLAPQPETLPLTVRLGINSACAIRDLLLTSSEQALADKQQRRLTQAFCDVVDAIIAGGGMVGGLGERYTRVAAAHAVHNGLTVLPQTEKFLHGTKVAYGILVQSALLGQDDVLAQLITAYRRFHLPTRLSELDVDIHNTAEIDRVIAHTLRPVESIHYLPVTLTPDTLRAAFEKVEFFRI

SEQ ID NO: 244 - DNA, 1104 bp, Salmonella enterica subsp. enterica serovar Typhi Ty2
  CDS (1)..(1104): transl_table=11
atggatcgcattattcagtcaccaggtaagtatattcagggtgcaaacgtcatcgcgcgtcttggcgattatttaaaaccaatggcgaacaactggctggttgtgggcgataaattcgtgctgggatttgccgaagagacgctgcgcaaaagcctgacggatgccggtttgtcagtagaaatcgccccgtttggcggcgaatgttcgcaaaatgagatcgacaggctgcgcgccgtcgccgaaaaaagtcagtgtggcgccgtactgggtatcggcggcggtaaaacgctggataccgccaaagcgctggcgcactttatgaacgtcccggtcgctatcgcgccgaccatcgcctctaccgacgcaccgtgcagcgcactctcggttatttataccgatgccggtgagtttgaccgttatctgctgctgccgcataacccgaatatggtcattgtcgatacgcagatagtggcgggcgcgccggcgcgtctgctggcagccggtatcggcgatgcgctggcgacctggtttgaagcgcgcgcctgctcacgcagcggcgccaccacaatggcgggcggcaagtgtacacaggccgcgctggccctggcggagctatgctataacacgctgatcgaagaaggcgaaaaagccatgttggccgccgaacagcacgtcgtcacgccagcgctggaacgtgtcatcgaagccaacacctacctgagcggggtcggttttgaaagcggcggtctggccgcagcgcacgcgattcataacggtttaacggcgattccggatgcgcaccactattatcacggggagaaggtcgctttcggtacgctgacgcaactggtgctggaaaacgcgtcggtcgaagaaatcgaaaccgttgctgcgctgtgccattccgttggcctgccgattacgctggcgcaactggatattaagcaggatatcccggccaaaatgcgcatcgtcgcggaagcctcctgcgcagaaggtgaaactattcataacatgcctggcggcgcaacgccggatgaagtgtacgccgcgctgctggtcgccgaccagtacggtcaacgcttcttgcaggaatgggaataa

SEQ ID NO: 245 - protein, 367 aa, Salmonella enterica subsp. enterica serovar Typhi Ty2
MDRIIQSPGKYIQGANVIARLGDYLKPMANNWLVVGDKFVLGFAEETLRKSLTDAGLSVEIAPFGGECSQNEIDRLRAVAEKSQCGAVLGIGGGKTLDTAKALAHFMNVPVAIAPTIASTDAPCSALSVIYTDAGEFDRYLLLPHNPNMVIVDTQIVAGAPARLLAAGIGDALATWFEARACSRSGATTMAGGKCTQAALALAELCYNTLIEEGEKAMLAAEQHVVTPALERVIEANTYLSGVGFESGGLAAAHAIHNGLTAIPDAHHYYHGEKVAFGTLTQLVLENASVEEIETVAALCHSVGLPITLAQLDIKQDIPAKMRIVAEASCAEGETIHNMPGGATPDEVYAALLVADQYGQRFLQEWE

SEQ ID NO: 246 - DNA, 1089 bp, Enterococcus faecalis V583
  CDS (1)..(1089): transl_table=11
atggaacaatcattaattgtgagagggacaccacaagagtatctttgcgaaattggttcgtgggaattattagaaggacaactattatgcagaaatattcatcgtgtattcattttacacgggactgagtcatggcaagcggcaaaaccgtattttccgacgtttcaaaaagtaacagctgtttttgaaaactatggaggtgtttgtacagatcaacgtgtgcaagagttagaagcgcaagtgctggacaatcatttagaggccatcgtcgctgttggtggaggaaaagtggccgacttgggcaaagccttagcacacaaaatggcgttaccggtaattattttgcccactttagcagctacttgtgcaccgtgcacgccattgagtgtaatgtatcgagaagatggagcaatggaacgatatgacgtttttccgcaagcaaacgctttggtgttggtagaaccaagagtgttattacattcgcctcggtccttaatggtggcaggtattggggatacattagctaaatggtacgaagcagatgcgattatttcgcagttagatgtccaagtgttacctattcaagtttctcattttgccgcggaaaaatgccgcgatattttgttaaatgaaagtatcaatgctttaaaagcgatggaagagcaacaattaaatcaatcgtttattgatgtcatcgaaacaaatttaattattggtggaatggtgggtggctttggcgatgattatggtcggacagcaggtgcccattccattcatgatgcactaactttgctgccagctagccatcgacaattgcatggaaacaaagtggcgtatggtgtgtttgttcaattagccattgaagaaaaatggcaagaaatcgctgaattgattcctttctatcaccaactaggtttgcctatttctttaaaagaaatggacatggacttaactgaagccgagtatcaagaagtagcagaacgtgcttgtatagaaggcgaaacgattcattatatgaaacaaaaaattacccctgaaattgtgaaaacagcgatgcaagatttagaaaaatatacagcgacaaaataa

SEQ ID NO: 247 - protein, 362 aa, Enterococcus faecalis V583
MEQSLIVRGTPQEYLCEIGSWELLEGQLLCRNIHRVFILHGTESWQAAKPYFPTFQKVTAVFENYGGVCTDQRVQELEAQVLDNHLEAIVAVGGGKVADLGKALAHKMALPVIILPTLAATCAPCTPLSVMYREDGAMERYDVFPQANALVLVEPRVLLHSPRSLMVAGIGDTLAKWYEADAIISQLDVQVLPIQVSHFAAEKCRDILLNESINALKAMEEQQLNQSFIDVIETNLIIGGMVGGFGDDYGRTAGAHSIHDALTLLPASHRQLHGNKVAYGVFVQLAIEEKWQEIAELIPFYHQLGLPISLKEMDMDLTEAEYQEVAERACIEGETIHYMKQKITPEIVKTAMQDLEKYTATK

SEQ ID NO: 248 - DNA, 1140 bp, Enterococcus faecalis V583
  CDS (1)..(1140): transl_table=11
atgagaaaagcattgattttaccaacgaaatatgttcaaggggaagatgaattactaaacttaggttacttcgtttcaacttttggaaaaaaagcgttactaattgcaaatcctgctgacgttgatcgtgtacgtccacaattggaagaaacagcgaaaaagtttgacattaccttcgtagagggtggctttagtggagaagtaacgcgtgaagaaacaaagcgcttgcaaaacgttggacaaaaagaacaagcagactgtatcattggtttaggtggcggtaaagcaatcgatgcttcaaaagtcgtagcagaaggtgaaaacttaattattgtaccaacgattgcggctcaagatgcaccaacttcgcattcagctgtactatatcatgaagatggctcatttgatgattatgcttactttaaacaaagtccaagcgtcgttatggttgatacaaaagtggttgccaaagcgccaactagatttttagttgctggaatgggggatgccttatccacatattttgaagcacgcgcaacacacaattcatattctcgggttaatgctagtttgccaatgggttcaagagaaggcttaacgcctgctgctagcggcacatatgcagctttggccatggcaaaactttgctgggaaaacctccaggaagatgggttaaaagcgaaattagcttgtgatgcaaatgtggttactgaatcattgaataagattatcgaaacaaatatcttactttcaggcttaggttttgaaagtggcggtttagctgcagcgcatgcgattcataacggtatgacagtcttacctggtgcgcacagttatttacatggtgaaaaagtagcttttgcaacgattgcacaacttgtattagaagatgcagcaaaagacgaattagaagctgttttagactttagcgcttctgtaggtttaccattaacgctttcagacattggtgtcgatgaaatcacttatgaagaagcgttggaagtagccaaaattgcttgcattccagaagaatcaattcattcaatgccattcccaattgtcgttgaagaagtagcgaatgcaatcattgttgcagataaagtcggacaagaatataaaacaagacataaattagattaa

SEQ ID NO: 249 - protein, 379 aa, Enterococcus faecalis V583
MRKALILPTKYVQGEDELLNLGYFVSTFGKKALLIANPADVDRVRPQLEETAKKFDITFVEGGFSGEVTREETKRLQNVGQKEQADCIIGLGGGKAIDASKVVAEGENLIIVPTIAAQDAPTSHSAVLYHEDGSFDDYAYFKQSPSVVMVDTKVVAKAPTRFLVAGMGDALSTYFEARATHNSYSRVNASLPMGSREGLTPAASGTYAALAMAKLCWENLQEDGLKAKLACDANVVTESLNKIIETNILLSGLGFESGGLAAAHAIHNGMTVLPGAHSYLHGEKVAFATIAQLVLEDAAKDELEAVLDFSASVGLPLTLSDIGVDEITYEEALEVAKIACIPEESIHSMPFPIVVEEVANAIIVADKVGQEYKTRHKLD

SEQ ID NO: 250 - DNA, 1134 bp, Prochlorococcus marinus subsp. marinus str. CCMP1375
  CDS (1)..(1134): transl_table=11
atgcaaaatacaaattttttgcagaatatatctcctgagagagttattagaggtgaaagtgcttgggaagaaggcaagagtctgattcaatcaatatgtaagaagcctctcttcttaggaagaagtcattccacctctaaattaagatcaatgttggagaaagatcttatcaatattggcataaatatagttcacgctgaacttgaatatgattgttgtgatgttgacttaaatcgtatatatcaattatgtaaggattgttcttgtgatggaataattgcttctggtggagggaaagttttagatgcaggaaaattaatcgctaacaatttaaacttaccttgtataacggttccacttagtgcttcaacttgtgcaggctggactgcactagcaaatatttattcaaaaaagggggcatttattaaagatcaaactttaaataactgtcctaaattattaatatttgactattctcttgtaagaaaagcacccaatagacttcttgctagtggtattgctgacgcacttgcaaaatggtatgaggcatctcttagcaatgcaggttctaatgatgctctcgtacagcaagctgttcaaatggcaagagtgttaagagatcaattgttaatagatggctttaatgcattacaaaatccatatagttcttcatggataagagttgcagaaagttgttctcttacagccggactcattggtggagtaggtggtgcaaaatgtagaacagcagccgcgcatgctgttcacaatggtctaacacaattagactttacacaaaaggctcttcacggggaactcgttgggtttggcatattagttcaactaagaattgaggagaagttattaggtaatcagttagcattgcaagcaaagaatcaattaataacattattaaaagaattaaatcttcctactaatcttaaatctctaggaattaatttaacaactaagaaagaactagaaatggcctgtatattttcttgtagagatgactctgatattcataatttaccattcaaagtagataaagaaacacttatggaagcaattttagaaacagatagaatagagattgaaaaaatttctcctagaggaaccattttcaactgctaa

SEQ ID NO: 251 - protein, 377 aa, Prochlorococcus marinus subsp. marinus str. CCMP1375
MQNTNFLQNISPERVIRGESAWEEGKSLIQSICKKPLFLGRSHSTSKLRSMLEKDLINIGINIVHAELEYDCCDVDLNRIYQLCKDCSCDGIIASGGGKVLDAGKLIANNLNLPCITVPLSASTCAGWTALANIYSKKGAFIKDQTLNNCPKLLIFDYSLVRKAPNRLLASGIADALAKWYEASLSNAGSNDALVQQAVQMARVLRDQLLIDGFNALQNPYSSSWIRVAESCSLTAGLIGGVGGAKCRTAAAHAVHNGLTQLDFTQKALHGELVGFGILVQLRIEEKLLGNQLALQAKNQLITLLKELNLPTNLKSLGINLTTKKELEMACIFSCRDDSDIHNLPFKVDKETLMEAILETDRIEIEKISPRGTIFNC

SEQ ID NO: 252 - DNA, 1095 bp, Prochlorococcus marinus subsp. pastoris str. CCMP1986
  CDS (1)..(1095): transl_table=11
atgcaattaatatctccagaaaaaatatttaggggaaataatgcttgggaagaatctctgacacaaataaaaaaaatttctaagcgtcccttggttttaggtagaagtttatcaacgaaggaaataaggcatcaaatttataaagacttacaagatcatcatttccatataattaaatcaaacttacaatttgattgttgttatgaagatcttgaaagaatagaaagaatcatacttaaaaataattgcgattcaattattgctataggtggaggcaaagttttagacgcaggaaaatttttagcagactttctatcgattcctgctattactatccctttaagtgcatctacttgtgcaggttggactgcattatcaaatatttattcaaaagatggacaatttatcaaggatattgagttgaaatcttgtcctgaaatattagtacttgatcacggttttattaaaacagcccctaagcggacacttgctagtggaatagctgatgcattagctaaatggtacgaatcttctttgactagctcaaaagtggaagatggactcgttcagcaagcaattcaaatatcaagagtattaagagaccaattacttattaatggagaaagtgcttataagagtcagtcattccataacgttgcttggtgtaatgttgtagagggatgttcacttactgctggattgattggtggaattggtggagaaaaatgtagaactgcagctgctcatgctatacataatgctattactcagataatttcaagtcataagcctttacatggtgaaattgttggagtaggaatcttattgcaactgagattagaagaaactaaaaataacaataaattagctaatcaatctattaaacagttaatggaattaatgagaaaattagatttaccaactactattgccgacttaggaataaatgtttttgaaaataataatttacaaaaaattgctgaatttacctgcagggataaatcagagattcattttttgccttttgaaatcaatcagcaagatataataaaaactattacagaatttgaaaaacaaaaaattaaaatagcataa

SEQ ID NO: 253 - protein, 364 aa, Prochlorococcus marinus subsp. pastoris str. CCMP1986
MQLISPEKIFRGNNAWEESLTQIKKISKRPLVLGRSLSTKEIRHQIYKDLQDHHFHIIKSNLQFDCCYEDLERIERIILKNNCDSIIAIGGGKVLDAGKFLADFLSIPAITIPLSASTCAGWTALSNIYSKDGQFIKDIELKSCPEILVLDHGFIKTAPKRTLASGIADALAKWYESSLTSSKVEDGLVQQAIQISRVLRDQLLINGESAYKSQSFHNVAWCNVVEGCSLTAGLIGGIGGEKCRTAAAHAIHNAITQIISSHKPLHGEIVGVGILLQLRLEETKNNNKLANQSIKQLMELMRKLDLPTTIADLGINVFENNNLQKIAEFTCRDKSEIHFLPFEINQQDIIKTITEFEKQKIKIA

SEQ ID NO: 254 - DNA, 1161 bp, Prochlorococcus marinus str. MIT 9313
  CDS (1)..(1161): transl_table=11
atgaacaaaaacaatttgcctgaggaggtgtctcactgcgctcactccatagcccccgaaaaggttgttaggggagaaagggcgtgggaagaaagccatcaactcattgcctcgatttgccgctcacctttactgcttggacgcagcatcgccacggctgagttacgccagggattactcaacaacctcagggaccttggactcaacacagtttctgctgagctcaagcacgattgctgcgagatggatctcaagcggatcaatgctcttgccttgtacaactcctgcgacggtgtgattgccgcaggtgggggcaaggtgctagatgccgggaagcttttggcccatcggctaagcatcccatgcatcacagttccactgagtgcagccacctgtgccggttggaccgccctcgccaatatctattcaccaacaggtgcttttcaacgcgatcaagttctggctcgatgtccacatctgatgatctttgatcatggtctcgtgcgtcaggctcctcccaggactctcgcaagcggcatcgcagatgcaatcgccaaatggtacgaagcgtctgtcagcaatggctccagcaacgatggcttaattcaacaagctgtgcagatggcaagggtcttgcgcgatcagctgctgcttgatgggcctgaagcgctgaaagatcaaaacagcctggcctggatcagggttgccgaagcctgcgcactaactgcagggctgatcggagggattggcggttctcgctgccgtactgccgctgcccacgcggtacacaacgcactcacgcaattaaaagattgccatgaggtccttcatggagaaaaggtgggttacgggattctcgtacagttgcgtcttgaggagattattggaggccatcaactggccggacaagcaaggcgacagctgattccattcctcaaaggacttgatctgcctgtaaatcttgaggatctgggcctatcgaatttgagtcttcacgagctgcatgaggtctgccaattcgcctgtcaaaaaggctctgacctataccaactgccgtttcccgtcaattccaacgccctactcgaagcactcctcggcgctagcgacaatggcccggtcccagtcgaatccacagtcaccaagcgaatagcagcctcttga

SEQ ID NO: 255 - protein, 386 aa, Prochlorococcus marinus str. MIT 9313
MNKNNLPEEVSHCAHSIAPEKVVRGERAWEESHQLIASICRSPLLLGRSIATAELRQGLLNNLRDLGLNTVSAELKHDCCEMDLKRINALALYNSCDGVIAAGGGKVLDAGKLLAHRLSIPCITVPLSAATCAGWTALANIYSPTGAFQRDQVLARCPHLMIFDHGLVRQAPPRTLASGIADAIAKWYEASVSNGSSNDGLIQQAVQMARVLRDQLLLDGPEALKDQNSLAWIRVAEACALTAGLIGGIGGSRCRTAAAHAVHNALTQLKDCHEVLHGEKVGYGILVQLRLEEIIGGHQLAGQARRQLIPFLKGLDLPVNLEDLGLSNLSLHELHEVCQFACQKGSDLYQLPFPVNSNALLEALLGASDNGPVPVESTVTKRIAAS

SEQ ID NO: 256 - DNA, 1101 bp, Synechococcus sp. WH 8102
  CDS (1)..(1101): transl_table=11
atggttgtgtccatctcctcccacgccatcgccccggcggtggtgctgcggggggagggtgcctgggcagaggcgctgtccaagatcagtgccctttgttcccgccctctcctgttgggccgcagtcaggccacggtgagcctgcggtcagcccttgtttcggatctcgttcacagttgtctgacgccgcaaccagctgagctcagctacgactgttgcgaggaggatctacagcgtctggccgctgaggcagccgactgtgatgccgttctcgccgccggtggtgggaaggttcttgatgctggcaagttgctcgcccatcgccttcagctgccctgcatcacagtgccgttgagtgctgccacctgcgcgggttggacagctctctccaatctttattcgatgcatggagcctttgagggcgatgtggccctgacgcgctgccctgagctgctggtgtttgaccatggcctggttcgccaggctcctgctcgcaccctggccagcggcatcgccgatgccctggcgaagtggtacgaagcttcggtcagcagcggcgacagcagcgatgggctggtgcagcaggcggtgcagatggcccgtgtgctgcgggatcaattgatgattgatggtcccctggccctgcaggatccccacagtgcggcctgggcccgcacggccgaggcctgtgcacttactgccggtgtgatcggcggcttggggggtgcccgctgcagaaccgttgcagctcacgccgtgcacaacggtctcacccaactgcaggcctgccaagacgtgctgcatggcgagaaggtgggcttcgggatcctggtgcagctccgcctggaagaacgtctgggtggcaaccgcctggccggccaggcccaccgccagttgcttcccctgctgcggcagttgcagcttcctgtgagcctgcaggatcttgggctgtccaacgccagtcttagtgatcttcaacaggtctgtgccttcgcctgccgtgaaggatcagacctgcacaaccttccatttgcggtgacaccgggggcgttgcttgaggcattggtgggagccgccgaacccagtcccgtcgcgccttga

SEQ ID NO: 257 - protein, 366 aa, Synechococcus sp. WH 8102
MVVSISSHAIAPAVVLRGEGAWAEALSKISALCSRPLLLGRSQATVSLRSALVSDLVHSCLTPQPAELSYDCCEEDLQRLAAEAADCDAVLAAGGGKVLDAGKLLAHRLQLPCITVPLSAATCAGWTALSNLYSMHGAFEGDVALTRCPELLVFDHGLVRQAPARTLASGIADALAKWYEASVSSGDSSDGLVQQAVQMARVLRDQLMIDGPLALQDPHSAAWARTAEACALTAGVIGGLGGARCRTVAAHAVHNGLTQLQACQDVLHGEKVGFGILVQLRLEERLGGNRLAGQAHRQLLPLLRQLQLPVSLQDLGLSNASLSDLQQVCAFACREGSDLHNLPFAVTPGALLEALVGAAEPSPVAP

SEQ ID NO: 258 - DNA, 1077 bp, Gloeobacter violaceus PCC 7421
  CDS (1)..(1077): transl_table=11
gtggccccgcagcaagtacggcgcggtcacggcactatcgaaatcttgggggaatggacccggcggctcggaagccgaccgctgatcgtcggtggccaaaataccctggcgcgctggcgaccgacgctggagaagattttacaggaagcggggcttgaagcagtctttgccgattacggtatcgactgtaccgaagcgaacttggcgcgactggtggacaaggcgtccgggcacgacgtggtgatcggcgtcgggggcggtaaagccctcgacatggccaaactggtcgcggcgcgccgcggcctgccgatgatcgcgctgcccacctcggcggccacctgtgcggcttgggcggctttgtcgaatatttactccgaagcgggccagtggctctacggcgtcgaactcgaccacgcacctgaagggctcatcgtcgattacgacttgattgccaccgccccggtgcgcacgctggtgagcggcatgggggacgccctcgccaagtggtacgaagcgtccatcagctccggcgactcggacgatgtgctggtgattagcgccgtgcagcaggcccgggtgctgcgcgacttgattttgcagttgggagaagcggccgtgggcgaacccggcggccgggcctgggagcagatggtcgatgcaagcatttgcctggcggggatggtggggggccttgggggggcgcgctgccgcaccgtcgccgcccacgccgtccacaacggcctcaccagcctgggtgccacccgccgctcgttgcacggcgaaaaagtcgccctgggtgttctggttcaacttaggctcgaagaaaccgtcggccgccagcgcctggcaagcatcgcccgcgagcagctcgaacagttctaccgccgtgtgggtctgcctttgagccttgaggatctgcacctcgctgcgctggacgacgagcagttgctggcggttgcccggctgtgctgccagccgcaatccgacatccattacttgccttttgccgtcgaacccgagcagttggcgcgggtgctgcgcgagagcgcccggccgcgcgccgctcgtctaagctga

SEQ ID NO: 259 - protein, 358 aa, Gloeobacter violaceus PCC 7421
MAPQQVRRGHGTIEILGEWTRRLGSRPLIVGGQNTLARWRPTLEKILQEAGLEAVFADYGIDCTEANLARLVDKASGHDVVIGVGGGKALDMAKLVAARRGLPMIALPTSAATCAAWAALSNIYSEAGQWLYGVELDHAPEGLIVDYDLIATAPVRTLVSGMGDALAKWYEASISSGDSDDVLVISAVQQARVLRDLILQLGEAAVGEPGGRAWEQMVDASICLAGMVGGLGGARCRTVAAHAVHNGLTSLGATRRSLHGEKVALGVLVQLRLEETVGRQRLASIAREQLEQFYRRVGLPLSLEDLHLAALDDEQLLAVARLCCQPQSDIHYLPFAVEPEQLARVLRESARPRAARLS

SEQ ID NO: 260 - DNA, 1101 bp, Photorhabdus luminescens subsp. laumondii TTO1
  CDS (1)..(1101): transl_table=11
atgctgaaaattattcaatccccatccaaatatattcaaggacctgatgccctgctccatattggtcaatataccaaaaccatcgccgatcacgttttggttatcatcggtaattccgcgatgaaattggtgggagatacggttcatagcagcctggaacaatacgaaattactcgtcattttgaagtgtttggcggtgaatgtagtcggaatgagattaaacgcctgtctgacattcttaaaaaacatgaatgccaagccgttattggtatcggtggcggcaaagtacaagatacggcaaaagcggtcgcttacgaatccagattacctgttctgattgcccccactatcgcttccactaatgccccaaccagtgctctctctgttatttacagcgatgatggcaaatatgaagactatctgtttctcccaacaaacccagatattgtcctaatcgataccagcattatcgctaaagccccaacccgttttctgattgccggaattggcgacgcgctggcaacttacttcgaagcccgcatttgtggagccggctataaacctcgaatgacagagggtgggatatcccgtaccgcagtcgccctcgctcatctctgttacgaaactttgttagaagagggctataaagcaaaactggctgttgaaaccgacgtcagtacacctgcggtggaaaatgtcatcgaagctattacttacttaagcggcctaggctttgaaaatacgggtgtagccgccgctcattccgtacacaatggctttaccgtattagaagaatgccaccacatgtaccacggcgaaaaagtcgccttcgggatattagttcaactaatactggaaaatagcccaaatgaagaattagatactttacttgatttctgtgtacagatgggactaccggttactctggatcaacttggcgtgaaggatggtgaaaaactgaaagaaaaagtgatggcagtggcaacagcaagttgtgccgaggacgaaaccattcacaacatgccttttgaagtgacaccggaaaaagtgtacgccgctattatggctgctgaccggatgggacgcgactggttgtattaa

SEQ ID NO: 261 - protein, 366 aa, Photorhabdus luminescens subsp. laumondii TTO1
MLKIIQSPSKYIQGPDALLHIGQYTKTIADHVLVIIGNSAMKLVGDTVHSSLEQYEITRHFEVFGGECSRNEIKRLSDILKKHECQAVIGIGGGKVQDTAKAVAYESRLPVLIAPTIASTNAPTSALSVIYSDDGKYEDYLFLPTNPDIVLIDTSIIAKAPTRFLIAGIGDALATYFEARICGAGYKPRMTEGGISRTAVALAHLCYETLLEEGYKAKLAVETDVSTPAVENVIEAITYLSGLGFENTGVAAAHSVHNGFTVLEECHHMYHGEKVAFGILVQLILENSPNEELDTLLDFCVQMGLPVTLDQLGVKDGEKLKEKVMAVATASCAEDETIHNMPFEVTPEKVYAAIMAADRMGRDWLY

SEQ ID NO: 262 - DNA, 1089 bp, Vibrio vulnificus YJ016
  CDS (1)..(1089): transl_table=11
atgttaacaacaactatatttccaggtcgttatgttcaaggtaaagatgctcgaaaacaacttggagtagaactcaatcgttttggaaaaaaaggtctaatgatctgtgactcatttgtttatgatacattattttctgagtttgaaccttatcttgagaccgttgaagttgaagtgatccggtttgctagtgaatgttgtgacgaagaaataacacgtctgacagccatgttgaaaaattttgagggtgaatttgtggttggattaggtggaggaaaaaccattgatacagcaaaagcaacctcgtatgaagcgagagtccctgtggcaattgtgccgactttggcagcgagcgatgcaccatgcagtgcactatccgttatttacactcaagaaggagagtttaagcgttatcttttcctgcctcaaaatccgaatcttgtcttggtcgacacacaaattattgccaaggcacctgttcgattccttatagctgggatcggtgatgcgctagcaacatggtttgaagcagaatcatgccagcaaagttttgcctcgaatatgacaggttatatgggttcattgtcagcatatgcgttagcacgtttgtgttacgacactttgcttgaatacggcgtaatagctaaaacatcgaatgaacaaggtgtggttactccagcgctcgaacgtgttgtggaagcaaatacgttgcttagtggattaggtttcgaaagtggtggtcttgctgcttctcatgcgattcataatggtttaacagtattggagccaacacatgtgtttttgcatggtgaaaaagtcgcatttggtttgctttcttctctattccttactgataaaccagcacagaccatcgcaactgtttatgacttctgcgaaaaagttggcttgccaacgactctgtctcaaatcggtttagaaaatgtatccgatgaagatttattggcagtggctgaagcttcatgtgcagaaggtgagaccatccacaacgaacctcgaactgtaactccagatatggtgtttgcagcaatgaaagcggcaaatgtagaagggttacgtcgcaagagctaa

SEQ ID NO: 263 - protein, 362 aa, Vibrio vulnificus YJ016
MLTTTIFPGRYVQGKDARKQLGVELNRFGKKGLMICDSFVYDTLFSEFEPYLETVEVEVIRFASECCDEEITRLTAMLKNFEGEFVVGLGGGKTIDTAKATSYEARVPVAIVPTLAASDAPCSALSVIYTQEGEFKRYLFLPQNPNLVLVDTQIIAKAPVRFLIAGIGDALATWFEAESCQQSFASNMTGYMGSLSAYALARLCYDTLLEYGVIAKTSNEQGVVTPALERVVEANTLLSGLGFESGGLAASHAIHNGLTVLEPTHVFLHGEKVAFGLLSSLFLTDKPAQTIATVYDFCEKVGLPTTLSQIGLENVSDEDLLAVAEASCAEGETIHNEPRTVTPDMVFAAMKAANVEGLRRKS

SEQ ID NO: 264 - DNA, 1092 bp, Prochlorococcus marinus str. AS9601
  CDS (1)..(1092): transl_table=11
atgcagtcaatctctcccgaaactatatataggggaaataatgcttgggaaaaatctttacctcaaattactaaattaactaaaagtccattaattctaggcagagggattcaaacgaataatttgagaaataatatttttaatgatttaaaaaatcaaaaacttaatgtaaattttgccaatttacaatttgattgttgttacgaagatatttcaagagttaggaatattatttcaaataataataatgattgtgttattgcagctggaggtggcaaagttctagattctggaaaatatatagccgattctcttaatatcccttgtattacagttccccttagcgcctctacatgtgctggttggacagccttatcgaatatttatacaaaggatggtcaattcataaaagatgttgcattaggatcttgtccgaaaatactagtttttgatcataaatttattcaaacagctccatcaagaacacttgcaagtggcatagcagatgccttggcaaaatggtacgaatcctcaataacaagttcaaatatagatgacggtcttgttcaacaagcaattcagatatcaagagttttaagagatcaactattaatagatggagaaaaagcatttaaggctcaatttgaaaataatccatcttggcaaaatactgtagaagcatgtggacttacagcaggattggttggcggtattggtggagaaaaatgtaggactgccgcagcacatgctattcataatgcaattacccagataatcacccctaataaattctttcatggtgagattgttggggttggtttattattgcaattaagaatagaagaaatgaaaaataataataaattagctgatcaattaattaaacaattatttgtacttatgaatgaattgaatttgccaacttctatcggacaacttggaataaatgtttttgaaaataataatttagagaaaattgctgattttacttgtcgagataaatctgagattcactttttgccttttgaaattaataaacgggatataatagaggttatttcaaattttgaacaacaaaaaattaaaatataa

SEQ ID NO: 265 - protein, 363 aa, Prochlorococcus marinus str. AS9601
MQSISPETIYRGNNAWEKSLPQITKLTKSPLILGRGIQTNNLRNNIFNDLKNQKLNVNFANLQFDCCYEDISRVRNIISNNNNDCVIAAGGGKVLDSGKYIADSLNIPCITVPLSASTCAGWTALSNIYTKDGQFIKDVALGSCPKILVFDHKFIQTAPSRTLASGIADALAKWYESSITSSNIDDGLVQQAIQISRVLRDQLLIDGEKAFKAQFENNPSWQNTVEACGLTAGLVGGIGGEKCRTAAAHAIHNAITQIITPNKFFHGEIVGVGLLLQLRIEEMKNNNKLADQLIKQLFVLMNELNLPTSIGQLGINVFENNNLEKIADFTCRDKSEIHFLPFEINKRDIIEVISNFEQQKIKI

SEQ ID NO: 266 - DNA, 1095 bp, Prochlorococcus marinus str. MIT 9515
  CDS (1)..(1095): transl_table=11
atgcagtcaatatcaccagaaaaaatatttagggggagtggagcttggataaaagctataccacatattaaaagtatttcaaaacgcccattacttttaggaagaagtttagtaactaataatattaggcagcaaatctataaagatttgcttagcgaaaaccttgatacacatatttctaacctgcaattcgattgttgttatgaagatctcaaaagggtaaaaaacattgcactaaaaaataattgtgattctattattgccataggaggaggtaaagtcttagattccgggaaatttttagcagattctctttccatcccagttattactattcccttaagtgcatctacttgtgcaggctggactgcactatcaaacatttattcaacaactgggcaattcattaaggatattgagttgaaatcatgtcctaaaattttagtatttgatcatgcctttattaaaacagctccaaagaggacactttctagcggaatagctgactctttggccaaatggtatgaatcttctttaactagttcaaaagttaaagatggacttgtccagcaagcaattcaaatatcacgagtattaagagatcagcttcttattgatggagagagtgcttatcagagtcaatctcttcaaaatacttcttggtgcaatgtagttgaaggatgtgcacttactgcgggattgataggaggaataggaggagaaaagtgtagaacggcagctgctcatgctttccataatgctatcactcaaatagtttcaacacaaaagcccttacatggcgaaattgttggagttggaatattattgcaattaagactagaagaaaccaaaaataataataaattagctaaccaatctattaatcaattattggtattaatgaagaaattaaatttaccaactactatcgctcaattaggtataaatgtttttgaaaataataatttacagagaattgccgattttacatgcagggataaatctgagattcattttttaccttttaaaatcagtcaacaagatattattgaagttatttcgaattttgaaaggcaagaaattaagatttcataa

SEQ ID NO: 267 - protein, 364 aa, Prochlorococcus marinus str. MIT 9515
MQSISPEKIFRGSGAWIKAIPHIKSISKRPLLLGRSLVTNNIRQQIYKDLLSENLDTHISNLQFDCCYEDLKRVKNIALKNNCDSIIAIGGGKVLDSGKFLADSLSIPVITIPLSASTCAGWTALSNIYSTTGQFIKDIELKSCPKILVFDHAFIKTAPKRTLSSGIADSLAKWYESSLTSSKVKDGLVQQAIQISRVLRDQLLIDGESAYQSQSLQNTSWCNVVEGCALTAGLIGGIGGEKCRTAAAHAFHNAITQIVSTQKPLHGEIVGVGILLQLRLEETKNNNKLANQSINQLLVLMKKLNLPTTIAQLGINVFENNNLQRIADFTCRDKSEIHFLPFKISQQDIIEVISNFERQEIKIS

SEQ ID NO: 268 - DNA, 1119 bp, Prochlorococcus marinus str. NATL1A
  CDS (1)..(1119): transl_table=11
atgtttataaataatcactgcatttcaccttcaaatgtcgttagaggtgaaggagcatggggtgactcattagatctaataattaaattatgcaaaagacctttaataataggtagaagtagctctacaaaaaaaataagaacttcattcaaaaaagatcttcttttaaaaggtattcaatcaatctctctcgatttagatcatgattgctgtgaattagatatccaaaatgcatatctaatctcaaaacacaataactgtgatgggattattgctgcaggaggtgggaaagtacttgacgcaggaaaactaatcgctgatttacttggtattaattgcataactgttccattaagtgcctccacatgtgctggatggaccgctttatctaatatttatactcccgatggaaaatttgtaaaagatgtaactttgaaaagctgtccaaacttattgatctttgatcacacaattgttagaaacgccccaccaagaacacttgctagcggcatggctgatgctgtcgcaaaatggtacgagtcttccctaacaagcagttcaagccaagatggctttgttcagcaagcagttcagatggctagggttttacgcgatcaattatttttaaacggtcaaaaggctttcttggatccattaagcaattcttgggaaactgttgcagaaggatgtgccttaactgctgggataataggagggcttgggggcgcaagatgcagaacagccgcagctcatcctatacacaatggattaacacaactcgcatacactaacaaaccacttcatggagaacttgttggatttggcttactcgtgcaattacatctagaagaaaaaaattcaaacagtcaattaccaaagcaagctaaatcacaacttttagagttcttctcgcaactcaatctccctatttcaattgagtctatttgtcttagaaatactacctcgaatgaactatataaagcatgtaaattcgcctgtaatgatgactctgatatacataaattacctttcccaataaatgaaaaagacattttagaggctattcaaagtttacaatccttgccaacaacctccagaataaaaataaataatacttaa

SEQ ID NO: 269 - protein, 372 aa, Prochlorococcus marinus str. NATL1A
MFINNHCISPSNVVRGEGAWGDSLDLIIKLCKRPLIIGRSSSTKKIRTSFKKDLLLKGIQSISLDLDHDCCELDIQNAYLISKHNNCDGIIAAGGGKVLDAGKLIADLLGINCITVPLSASTCAGWTALSNIYTPDGKFVKDVTLKSCPNLLIFDHTIVRNAPPRTLASGMADAVAKWYESSLTSSSSQDGFVQQAVQMARVLRDQLFLNGQKAFLDPLSNSWETVAEGCALTAGIIGGLGGARCRTAAAHPIHNGLTQLAYTNKPLHGELVGFGLLVQLHLEEKNSNSQLPKQAKSQLLEFFSQLNLPISIESICLRNTTSNELYKACKFACNDDSDIHKLPFPINEKDILEAIQSLQSLPTTSRIKINNT

SEQ ID NO: 270 - DNA, 1254 bp, Prochlorococcus marinus str. MIT 9303
  CDS (1)..(1254): transl_table=11
atgacaacaagcaaatcgttgtccgccatgtcagcaaaactactgccacaccggaactcgctggagcaggcgtctgacacctctccaacatcaatgaacaaaaacaatttgcctgaggaggtctctcactgctctcactccatcgcccccgcaaaggttgttaggggagaaagggcttgggaagaaagccatcaactcattgcctcgatttgccgctcacctttacttcttggacgcagcatcgccacggctgagttacgccagggattactcaacaacctcaggaaccttggactcaacacagtttctgctgagctcaagcacgattgttgcgagatggatctcaagcggatcaatgctcttgccttgtacaactcctgcgacggcgtgattgccgccggtgggggcaaggtgctagatgccgggaagcttttggcccatcggctaggcatcccatgcatcacagttccacttagtgcagccacctgtgccggttggaccgccctcgccaatatctattcaccaacaggtgcttttcaacgcgatcaagttctggctcgatgtccacatctgatgatctttgatcatggtctcgtgcgtcaggctcctccccggactctcgcaagcggcatcgcagatgcaatcgccaagtggtacgaagcgtctgtcagcaatggctccagcaacgatggcttgattcaacaagctgtgcagatggcaagggtcttgcgcgatcagctgctgcttgatgggcctgaagcgctgaaagatcaaaacagcctggcctggatcagggttgccgaagcctgcgcactaactgcagggctgatcggagggattggcggttctcgctgccgtactgccgctgcccacgcggtacacaacgcactcacgcaattaaaagattgccatgaggtccttcatggagaaaaggtgggttacgggattctcgtacagttgcgtcttgaggagattattggaggccatcaactggccggacaagcaaggcgacagctgattccattcctcaaagaacttgatctgcctgtaaatcttgaggatctgggcctatcgaatttgagtcttcacgagctgcatgaggtctgccaatttgcctgtcaacaaggctctgaccttcatcaactgccgtttcccgtcaattccagcgccctactcgaagcactcctcggcgctagcgacaatggcccggtccccgtcgaatccacagtcaccaagcgaatggcagcctcttga

SEQ ID NO: 271 - protein, 417 aa, Prochlorococcus marinus str. MIT 9303
MTTSKSLSAMSAKLLPHRNSLEQASDTSPTSMNKNNLPEEVSHCSHSIAPAKVVRGERAWEESHQLIASICRSPLLLGRSIATAELRQGLLNNLRNLGLNTVSAELKHDCCEMDLKRINALALYNSCDGVIAAGGGKVLDAGKLLAHRLGIPCITVPLSAATCAGWTALANIYSPTGAFQRDQVLARCPHLMIFDHGLVRQAPPRTLASGIADAIAKWYEASVSNGSSNDGLIQQAVQMARVLRDQLLLDGPEALKDQNSLAWIRVAEACALTAGLIGGIGGSRCRTAAAHAVHNALTQLKDCHEVLHGEKVGYGILVQLRLEEIIGGHQLAGQARRQLIPFLKELDLPVNLEDLGLSNLSLHELHEVCQFACQQGSDLHQLPFPVNSSALLEALLGASDNGPVPVESTVTKRMAAS

SEQ ID NO: 272 - DNA, 1092 bp, Prochlorococcus marinus str. MIT 9301
  CDS (1)..(1092): transl_table=11
atgcagtctatctctccagaaacaatatacaggggaaattctgcttgggaaaaatctttacctcagattactaaattaactaaaagaccattaattctaggtagagggtttcaaacgaataatttgagaaataatatttttaatgatttaaaaagtcaaaaattaactgtaaattctgctaatttgcaatttgattgttgttacgaagatatttcaagagttaagaacattatctcaaataataataatgattctgttatcgcagctggaggtggcaaagttctagactctggaaaatatatagccgagtctcttaatatcccttgtattacagttccgcttagcgcctctacatgtgctggttggactgccttatcgaatatttatacaaaggatggtcaatttataaaagatgtcgcattaggatcttgtccgaaaatactagtttttgatcataagtttattcaaacagctccatcaagaacacttgcaagtggcatagcagatgccttggcaaaatggtatgaatcctcaataacaagttcaaaaatagacgacggtcttgttcaacaagcaattcagatatcaagagttttaagagatcaacttttaatagatggaggaaaagcatttaagggtcaatttgaaaataatatatcttggcaaaatactgttgaagcatgtggacttacagcaggattagttggcggtattggtggagaaaaatgtaggacagcagcagcacacgcttttcataatgcaattactcagataatcacccctaataaattcttacatggtgagattgttggggttggattattattgcaattaagactagaagaaatgaaaaataataataaattagctgatcaatcaattaaacaattatttgtactcatggaagaattgaatttaccaactactatcggacaacttggcataaatgtttttgaaaataataatttagaaaaaattgctgattttacttgtcgagataaatctgagattcactttttgccttttgaaattagtaaaggggaaataatagaagttattacaaattttgaaaaacaaaaaattaaaacataa

SEQ ID NO: 273 - protein, 363 aa, Prochlorococcus marinus str. MIT 9301
MQSISPETIYRGNSAWEKSLPQITKLTKRPLILGRGFQTNNLRNNIFNDLKSQKLTVNSANLQFDCCYEDISRVKNIISNNNNDSVIAAGGGKVLDSGKYIAESLNIPCITVPLSASTCAGWTALSNIYTKDGQFIKDVALGSCPKILVFDHKFIQTAPSRTLASGIADALAKWYESSITSSKIDDGLVQQAIQISRVLRDQLLIDGGKAFKGQFENNISWQNTVEACGLTAGLVGGIGGEKCRTAAAHAFHNAITQIITPNKFLHGEIVGVGLLLQLRLEEMKNNNKLADQSIKQLFVLMEELNLPTTIGQLGINVFENNNLEKIADFTCRDKSEIHFLPFEISKGEIIEVITNFEKQKIKT

SEQ ID NO: 274 - DNA, 1104 bp, Listeria monocytogenes str. 4b F2365
  CDS (1)..(1104): transl_table=11
ttgaataaagaattgattgttcgcggagctccgcaagaatatttatgccaagtaggcgcgtgggatacattacctactcacctagaacgccgcggtttgaaaaatgtattagtagttcgtggaaatgcttcttgggaagtcgctaaaaagaaattccctgttttatcaactgttacatctacttttgaagtatataatggtggttctacctacgaggagcgcgatcgtctggtggcaatcatggaaacaaataagatggatgcgattatcgcagtaggtggcggaaaaatagctgacgtatgtaaagcgacagcagcagttctacgtttaccagtcattatcttaccgacacttgcatcaacttgtgccgcttatacaccacttagtgtgatgtacgacgaagagggcgctatgattcgttacgatgtgtttgcgagtagtaatgcgctgttattaattgattcggaaatgattttagactcaccgaaagagttactagttgctggaattggcgatacgctagccaaatggtacgaagcagacgtgattattaattccttaccaactaaatcagtcgaaattgaaatcgcgcattttgctgccaaaatgtgccgtgataacttgttgcaatatagcgaagaagcacttgctgccatggacaaacaagtattgaatgaagggtttgttaaaattattgagacgaatattttagttggtggaatggtcggtggttttggcgatgattatggacgttgtgcaggagcgcattcgattcatgacgcgctaacgatggttccagaaacacatcacttattgcatggtaataaagtagcttatggtattttagttcaattagtaatagaaaatagatgggatgaaatcgagcgtttgttgccattttattctgagctcggtcttccgatgagtttatatgatatgggacttgcgacacttgcggaagaaacgcttgtggccgtatctaaacgtgcaacggagccacatgaaacaatccatatgatgcccggtgaaatgacagctgatgtagtattaaatgcgatgaaacagttagaagatagtatggcaatgaaacgagtggctaagtaa

SEQ ID NO: 275 - protein, 367 aa, Listeria monocytogenes str. 4b F2365
MNKELIVRGAPQEYLCQVGAWDTLPTHLERRGLKNVLVVRGNASWEVAKKKFPVLSTVTSTFEVYNGGSTYEERDRLVAIMETNKMDAIIAVGGGKIADVCKATAAVLRLPVIILPTLASTCAAYTPLSVMYDEEGAMIRYDVFASSNALLLIDSEMILDSPKELLVAGIGDTLAKWYEADVIINSLPTKSVEIEIAHFAAKMCRDNLLQYSEEALAAMDKQVLNEGFVKIIETNILVGGMVGGFGDDYGRCAGAHSIHDALTMVPETHHLLHGNKVAYGILVQLVIENRWDEIERLLPFYSELGLPMSLYDMGLATLAEETLVAVSKRATEPHETIHMMPGEMTADVVLNAMKQLEDSMAMKRVAK

SEQ ID NO: 276 - DNA, 1098 bp, Erwinia carotovora subsp. atroseptica SCRI1043
  CDS (1)..(1098): transl_table=11
atgagtcatttcattttctcttcacctagaaaatatgttcagggtcgcggcgtgctggatgaactgggtgaacaactcaagcctctgggaacgaaagcgtttctgatggcagatggcattgtttgggacatcatcggccagcgcgtagatgcgtccctcaaacaggtgagcatcggctaccattacgagcgttttaacggtgaggcgtccagcaacgaaatcacccgtcttgctaagctagcacgcgacgcgggcaccaacattgtcgttgggttaggcggcggtaaaacgctggatacggcgaaagcggttgctgatgagctgaaacacaatgtcgcgattgtcccaaccgtggcctcaacggatgcaccgtgcagcgcgctgtccgtcatctacaccgacgagggcgtgttcgagtcctaccgcttttacgacaagaatcccgatctggtattggtcgataccgccgtgtgtgcgcaggctccagcacgcctgtttgcctccggcattgccgatggtctggcaacctttgtcgaagcacaggcggttctgcgctctcacgcactttctatgctgggcggtaaacctacgctagcgggcatggcgattgccgaaacctgcgaaaaaacgctgctagcctacggttatagtgcttacaaagcggtggaaaaaggtgtggtaacacccgcagtggaatccgtagttgaagccaacacgctactttccggcttgggctttgagaatggcggattggcgggcgctcacgccatccacaacgggtttaccgcgatcaaaggcgacatccaccacctcacgcatggggaaaaagtcgcctacggcacgctgacacatatggtgctggagcaacgtcctgacgaggaaatcgcacgctacattcgcttctaccgcgcgattaacatgccgacgctgctaaaagatctgcatctggaaaatgagccgtttgagaatttgatcaaagtgggtgaactggcgtgcagcgacgccgatacgctgaaaaatctggacagcggattaacggctgaagacgtcgctcacgcgattattgctgtcgacgcgttcagtaaaaccatcagctaa

SEQ ID NO: 277 - protein, 365 aa, Erwinia carotovora subsp. atroseptica SCRI1043
MSHFIFSSPRKYVQGRGVLDELGEQLKPLGTKAFLMADGIVWDIIGQRVDASLKQVSIGYHYERFNGEASSNEITRLAKLARDAGTNIVVGLGGGKTLDTAKAVADELKHNVAIVPTVASTDAPCSALSVIYTDEGVFESYRFYDKNPDLVLVDTAVCAQAPARLFASGIADGLATFVEAQAVLRSHALSMLGGKPTLAGMAIAETCEKTLLAYGYSAYKAVEKGVVTPAVESVVEANTLLSGLGFENGGLAGAHAIHNGFTAIKGDIHHLTHGEKVAYGTLTHMVLEQRPDEEIARYIRFYRAINMPTLLKDLHLENEPFENLIKVGELACSDADTLKNLDSGLTAEDVAHAIIAVDAFSKTIS

SEQ ID NO: 278 - DNA, 1104 bp, Erwinia carotovora subsp. atroseptica SCRI1043
  CDS (1)..(1104): transl_table=11
atgattgcaatacaagcgccacaaacctatctaaatcgtgatggcgtcattcgttctgtcggcgaatatgctgccccttacgccagcacaatactgattattaccagtccgcaggcatggaaaacgacggcggatgccgtcgaacacagcctcaatgagcacggcttacgctatcaggtcgaatttttgccgggcgattgcaccaaacccgcgatcgagacgctaaccgcacaggcgcgcacattcagtgcagaactgattttaggcattggcggtgggcgtgtgctggatgtcgccaaagccgtcggcgatattctggggcagatccccgtcatcgccgtacccaccattgccgctacctgcgccgcttggtcaccgatcagcgttatttacaatgagagtggtgcgcacaacggcccctttccactgacgcgtttaccagtgtgggtgctggtagacagtgaaatcatcgcccacagcccttcacgttacctcaaggctggtatcgtggatgcactggcaaagtggtacgagtttcaaccgtatctgcgccacggtgatgatgggctggcgttagcgctcaaagcacaagcggcaaagctagccgtagaaacgtttaatacgtacggcgagcaggccatcgcggataatgaacaagggttggtcacccctgccctgcgccgtgtgatcgatgccgttatcgcactggctggcgtcgcgaatagcatgaaagatgaggtgccacgcatcggcgtcgcgcatgcgattcacaacagcatgactcgcctgccggaactgcatgactggctgcacggagagaaagtgggttttggtctggctgcccaggcttttctggaacacgataacgacgctgaccgcgaagaactgttcacccagttgcgccgctacggtagtccgatcacgctaagcgcccttggtctgaacgaacgtccattgctggttgaaagcatcgcgcagaacgtgaaaatcgcccctaaaattgctgcccgtttgccgttcgcaacggatgccgaacgaattcaacaagcgctatggcacacgcaaacactggaaggccatgtggtagacagccacgcggcatga

SEQ ID NO: 279 - protein, 367 aa, Erwinia carotovora subsp. atroseptica SCRI1043
MIAIQAPQTYLNRDGVIRSVGEYAAPYASTILIITSPQAWKTTADAVEHSLNEHGLRYQVEFLPGDCTKPAIETLTAQARTFSAELILGIGGGRVLDVAKAVGDILGQIPVIAVPTIAATCAAWSPISVIYNESGAHNGPFPLTRLPVWVLVDSEIIAHSPSRYLKAGIVDALAKWYEFQPYLRHGDDGLALALKAQAAKLAVETFNTYGEQAIADNEQGLVTPALRRVIDAVIALAGVANSMKDEVPRIGVAHAIHNSMTRLPELHDWLHGEKVGFGLAAQAFLEHDNDADREELFTQLRRYGSPITLSALGLNERPLLVESIAQNVKIAPKIAARLPFATDAERIQQALWHTQTLEGHVVDSHAA

SEQ ID NO: 280 - DNA, 1089 bp, Erwinia carotovora subsp. atroseptica SCRI1043
  CDS (1)..(1089): transl_table=11
atgcacacaacgaccgttcgcgtacaggttggccctgccaactatttttcctttcccggtgctatcgataagttgctggagttttacccgccagaggtgctgaaaaacgcgctgtggatttatggtgagcgtgcgattgcagcggctcggccctatttaccggccgagtttgaagcaccttcagcccgacgtgttcaatttagtgcgcattgcagtgagggtgaagtggcaaaactggtcgcgcaagcgggcgatgactgtcaggttgtcatcggtgtcggcggcggcgctgtactggataccgcgaaggtcgctgcgcgtcatatcggcgtgccgctggtagccattccgactattgcggcaacctgtgcagcctggacgccgctgtccgtctggtataacgatgccggacaggcactgcgttttgaaatttttcccgatgctaaccatctggtactggtggagccgcggattatgctcgcagcgccggtggaatacctactggcaggggtcggcgatacgctggcgaagtggtatgaagccgtggttctcagcccccagcctgaaacgctgcctctttctgttcgtttgggcttacagactgcgctagatatccgcaatgtcttgttgcaacaaagtgcggctgcgttagaagccgtcaagcgtggcgagttgacgcaggattttctggatgtggtagatgcgatcattgccgggggcggcatggttggtgggttgggagagcgatatactcgcgtggcggcggcacatgcggttcataacggcttgacggtgttgccgcaaaccgaacgctttctgcacggcaccaaagtggcttatggcattctggtgcaaagcgccttgctgggagatagcgaaacgttgctccagttgaaagcggcgttcaaggtgtttggtttacctacatcgctggctgagttggatgtggatattcacgatcgtgctgcgcttcaggccgtgattgcacgtactttgcaagcgggggaatccattcattatctgccattgtcgttaaatgaagacgtcttgctggcagcgtttaacaccgttgagttgagcgggaaataa

SEQ ID NO: 281 - protein, 362 aa, Erwinia carotovora subsp. atroseptica SCRI1043
MHTTTVRVQVGPANYFSFPGAIDKLLEFYPPEVLKNALWIYGERAIAAARPYLPAEFEAPSARRVQFSAHCSEGEVAKLVAQAGDDCQVVIGVGGGAVLDTAKVAARHIGVPLVAIPTIAATCAAWTPLSVWYNDAGQALRFEIFPDANHLVLVEPRIMLAAPVEYLLAGVGDTLAKWYEAVVLSPQPETLPLSVRLGLQTALDIRNVLLQQSAAALEAVKRGELTQDFLDVVDAIIAGGGMVGGLGERYTRVAAAHAVHNGLTVLPQTERFLHGTKVAYGILVQSALLGDSETLLQLKAAFKVFGLPTSLAELDVDIHDRAALQAVIARTLQAGESIHYLPLSLNEDVLLAAFNTVELSGK

SEQ ID NO: 282 - DNA, 1101 bp, Symbiobacterium thermophilum IAM 14863
  CDS (1)..(1101): transl_table=11
ttgagcaaggtgatcgttgcacccggcaagtacatccaaggcccgggggagttggaccggctggccgaacacaccggccagctcggggcgcacgccttcgtcatcgccgacgagtttgtcatgaatctgaccggtgaccgcgtgaccgccagctatgccaaggcaggggccgcggtgacgatggaacgcttccagggggagatcacccaggccgagatcgagcggctgacggcgcgctgcaaggagtctcaggccgacgtggtggtgggcatcggcggcgggaaaacgttggattccgccaaggcagtcgcctactactgcggcaatctgcccgcagtcgtcgtgccgaccgtggcctccacggacgcgccgtgcagcgccctgtcggtgatctacaaggaggacggctcgttcgaacggtatctgttcctgccgtcgaacccggctgtcgtcgtcgtcgatacggcgatcatcgccaacgcgcccgtccgactcctggtcgcgggcatgggcgacgcgctcgccacctactttgaggcgcgcgcggcccagcgggcccacaagctgaacatcgtcggaggacacggcacgcaggcggccatggcgctggcccggctctgctacgacaccctgcttcaggagggcatcaaggccaaggctgcggccgaggcgcacgtgatcaccgaggccctggagcggatcgtcgaggccaacacctacctcagcgggctgggttttgaaagctgcgggctggcggccgcccacgcgatccacaacggcctgtccgccctggaggagacccacggcgcctaccacggcgagaaggtggccttcggcaccctcgcgcagctcgtcctcgagaacgcgcccctggacgagatcgaggaggtcatcgagttctgcctgaacgtgggcctgccggtgacgctcgcagatctgggggtgcacacggtccgggaggagcagatccgccgggtggctgagctgtcctgcgccgaaggggaaaccatcttcaacatgccgttcgaggtgacgccggagaaggtgtacgccgccatcctgacggctgaccggctgggtcacctgtacaagggcggttga

SEQ ID NO: 283 - protein, 366 aa, Symbiobacterium thermophilum IAM 14863
MSKVIVAPGKYIQGPGELDRLAEHTGQLGAHAFVIADEFVMNLTGDRVTASYAKAGAAVTMERFQGEITQAEIERLTARCKESQADVVVGIGGGKTLDSAKAVAYYCGNLPAVVVPTVASTDAPCSALSVIYKEDGSFERYLFLPSNPAVVVVDTAIIANAPVRLLVAGMGDALATYFEARAAQRAHKLNIVGGHGTQAAMALARLCYDTLLQEGIKAKAAAEAHVITEALERIVEANTYLSGLGFESCGLAAAHAIHNGLSALEETHGAYHGEKVAFGTLAQLVLENAPLDEIEEVIEFCLNVGLPVTLADLGVHTVREEQIRRVAELSCAEGETIFNMPFEVTPEKVYAAILTADRLGHLYKGG

SEQ ID NO: 284 - DNA, 1056 bp, Bacillus licheniformis ATCC 14580
  CDS (1)..(1056): transl_table=11
atgcagcctgaagatattgtcagaagcggtccaaaccaatacgtttgcagagaggggatcgtgaaagaactgccgtcatttgcgaatgcattcgaacgtcctgtcatcatttcaggggttaaatcgtttaaagcttttacacgttatacgacacctccagccgattggaaagtcgttcagcatacgggctgcagttccctaaataagattaaaaaagcagcagaggaagcagaatcagcagacgtcatcataggaataggcgggggaaccgtcttagatacagcgaaggcagccgccgatttgctgaacattgaagtcatgacgattccgacgatcccgggaacatgtgcggcaagcacgccgttaagcgtcatctatgacgatgaaggtaacttttcgggcgtccaatatcagaagcgctccagctatttgacactggtcgatccgctgctgcttctctcttcaccggtcgcttatgtgaaaagcggaatcggcgatacgcttgcgaaatggtatgaggcagaagcgatcatcagaaatacggccgattcgctttctatcatggttcagacagggctgaggcagtctgtctatattcgggatattttgttgacagaaagcctgaaagccatagagagccttgaaaaaggcgaatcctccccagctttcacaaatgtcctcgaagcggtcattgcgctggcaggcacagtaggcggatatgcgggccgctacggcagaatggccggggcccatgccattcacaacggcttgacgttcatccccgaaacccatcgtgtgctgcacggccaaaaggtagcctacgggatactggtgcagcttgctttagaagggcggacagatgaaatagccgaactgattcccttttatgaagggctcggttttccgagaagacttagcgatttgggcattttagaaaatattgaagcggccaaacggatcatcgccgcccatgccgcgcgtccggatgaatctttatgtttgatgggatcttttcatgaagcggatgtgattgcggcgatagagtcgcttgaataa

SEQ ID NO: 285 - protein, 351 aa, Bacillus licheniformis ATCC 14580
MQPEDIVRSGPNQYVCREGIVKELPSFANAFERPVIISGVKSFKAFTRYTTPPADWKVVQHTGCSSLNKIKKAAEEAESADVIIGIGGGTVLDTAKAAADLLNIEVMTIPTIPGTCAASTPLSVIYDDEGNFSGVQYQKRSSYLTLVDPLLLLSSPVAYVKSGIGDTLAKWYEAEAIIRNTADSLSIMVQTGLRQSVYIRDILLTESLKAIESLEKGESSPAFTNVLEAVIALAGTVGGYAGRYGRMAGAHAIHNGLTFIPETHRVLHGQKVAYGILVQLALEGRTDEIAELIPFYEGLGFPRRLSDLGILENIEAAKRIIAAHAARPDESLCLMGSFHEADVIAAIESLE

SEQ ID NO: 286 - DNA, 1104 bp, Bacillus licheniformis ATCC 14580
  CDS (1)..(1104): transl_table=11
atgtcaaaatcagtaaaatcagtcacatcacctaaaaaatttattacaggaaaacgactgctggagaacttgaacgactacattgaagattttggcgacaacgcatatatcatttgcgatgaattcattttggaacgcgctcaaaaagaagcggggaattcgattcagaaagccggcaatcaagccgtttttgaaaaattcaattacgaatgcacacaggaagaaatcgatcgcaaccgggagcttgcacgcaatgcaggcgctaatatcatcgttgggatcggaggcggtaaaacgcttgataccgcaaaagccaccgcttattacgagaagctgccggttgtgattttcccgacaattgcttctacggatgctccatgtacggcccttgccgtcatttataaacacgacggatcgtttgaccgctatctgtttttgccgacgaacccagatgtcgttcttgcggactctgagattttggcatccgcgccgccgcgctttttcgcagccggtatcggtgacgccttggcgacgtattttgaagcgcgtgcctgctttaaagcaaacggcgataacctcgtgctgatgaagccttcaacaactggattgggacttgcccgtctttgctatgatacgctgttggaaaacggtgtgaaagcgatgcaggcggttaagcacggcgtttccacacgagcggtcgaagatacaatcgaggcgaccatctatttaagcggcgtcggtgccgaatcaggcggtcttgccgccgcacacgcgatccacaacggaatgacagccgttccttctctgcacagggctcagcacggcgaaaaagtcacgttcggccttttggcgcagcttgttcttgaaaacgcgccggccgaagaattggagaccgttattgactttatcaaaggcgtcggtcttccgttgacattaaaagacctcggagtcgacgaatttgtcgaagaagaatggcgccaagtcgctcaaagcgcttgcgcggaaggcgacacaatgggcaacatgccgttcccagtcacccctgacgacgtctacaatgcgatcgtcgccgccaacgcgattgcagaatcttatcacgattaa

SEQ ID NO: 287 - protein, 367 aa, Bacillus licheniformis ATCC 14580
MSKSVKSVTSPKKFITGKRLLENLNDYIEDFGDNAYIICDEFILERAQKEAGNSIQKAGNQAVFEKFNYECTQEEIDRNRELARNAGANIIVGIGGGKTLDTAKATAYYEKLPVVIFPTIASTDAPCTALAVIYKHDGSFDRYLFLPTNPDVVLADSEILASAPPRFFAAGIGDALATYFEARACFKANGDNLVLMKPSTTGLGLARLCYDTLLENGVKAMQAVKHGVSTRAVEDTIEATIYLSGVGAESGGLAAAHAIHNGMTAVPSLHRAQHGEKVTFGLLAQLVLENAPAEELETVIDFIKGVGLPLTLKDLGVDEFVEEEWRQVAQSACAEGDTMGNMPFPVTPDDVYNAIVAANAIAESYHD

SEQ ID NO: 288 - DNA, 1197 bp, Synechococcus elongatus PCC 6301
  CDS (1)..(1197): transl_table=11
atggaagtttcgacgggctaccttccgcaggcagtcttcgcccctgccgatcaaggtcatcctgccccgcgtgtctttatctcgccccagcgctacatccaagggcgaggtgttttgcggagtgttggccgctacctctccctattgcaggcaaaacgagcaggcctgctgatgtcgcaacgcagcagtcgaaatgaaggagatttattactagccggactgcgatcggctggtgttgatgctgtcgtcagcacctttcagggcgaatgtacaaccgatgaaatcaccgctcacaccaccgctttttccaaagagcgaatcgactgcgtgattgctgcgggaggtgggaaatgtatcgataccggtaaagcgatcgcgtttcggttggggattcctgtcgttgtcgtcccgacccttgcctccaacgatgccccctgttctgcgctctctgtcctctactcccctgagggaatttctcaaggcgtcgagttctatcccaatagcccagccatcgtggttgtcgataccgacatcattgccgcagcgcccgaacgctaccttgtggctgggatgggtgacgcgatggcgacttggtatgaggcgtctgtctgtcttcgtaatccggcggctgtcacaaccgtgggcgctcgtcccaccttggctgcatgtgcgatcggtgaagtctgtgcccataccctctttcaagaaggctgtgctgccgctgcggctgttgcctccaaaacggtcaacgacgccttggagtcagtggtagaagcaaataccttacttagcgggctgggctttgaaagtggtgggttggccggcgctcatgctgtcgcccaaagctacacagcgattccccatgtgcgtgccaactaccttcacggcgaaatggtagcgatggggactcttgctcaactgatgatggaatcgcgccccaaggaagcaacacgagttgccgagttttttgctgctgttgggctgccgattcatcttggtcaactctcgctaagcagtagcgacacccaagctttagagatcgttagtgaagcttcattaggcttcccttttgtcggtaatatgccaatgaaaataacaccagaatttgtgaaatctgcaattcttgatgctcatcacctaggactcagtatacccgagcagatcggagacagtgcttatcgacatctacagggctaa

SEQ ID NO: 289 - protein, 398 aa, Synechococcus elongatus PCC 6301
MEVSTGYLPQAVFAPADQGHPAPRVFISPQRYIQGRGVLRSVGRYLSLLQAKRAGLLMSQRSSRNEGDLLLAGLRSAGVDAVVSTFQGECTTDEITAHTTAFSKERIDCVIAAGGGKCIDTGKAIAFRLGIPVVVVPTLASNDAPCSALSVLYSPEGISQGVEFYPNSPAIVVVDTDIIAAAPERYLVAGMGDAMATWYEASVCLRNPAAVTTVGARPTLAACAIGEVCAHTLFQEGCAAAAAVASKTVNDALESVVEANTLLSGLGFESGGLAGAHAVAQSYTAIPHVRANYLHGEMVAMGTLAQLMMESRPKEATRVAEFFAAVGLPIHLGQLSLSSSDTQALEIVSEASLGFPFVGNMPMKITPEFVKSAILDAHHLGLSIPEQIGDSAYRHLQG

SEQ ID NO: 290 - DNA, 1107 bp, Bacillus clausii KSM-K16
  CDS (1)..(1107): transl_table=11
atggacgagaaaatttttattagtccaagcaagtatgtgcaaggcagaggggttctcgacaagacaggggaatacgtgaaagacttaggcaaaaaggcgctgcttatagctgatgaatttgtctgggggatagctgcaaaccgagtggcggacagcttgaaagaagttgggcttgacgtggtggaagtcacatttgaaggtgaatcgtcagaagcggaaattaagcggattgtaaaaaaggccgaaagcggaggcgctgatattatcgttggaatcggcggcggaaaaacattggacacagctaaaggggttcgagatcgcttgaaaggtgccgcctgtgccattgttccgaccacggcttccaccgatgcgccgacaagcgctttgtcggtcatctattcagaggacggtgtgtttgaacgctattccttttatagcaagaacccagatatgatccttgtcgattcgacagtcattgctagtgctccgccgaaatttttagcagcaggcattgctgatgctcttgctacttgggtcgaggctcgagcttcttttgaagggcgtggcactacaatggcaggaggaaaagcaaccatcgctgggttagcgattgctgagaagtgtgagcaagttttatttgattacgggttgcttgcttatgaagccaataaacggggagttgtttcccacgcccttgaacaagtcatagaagccaatacactgttaagtggcctcgggtttgaaagtgggggtctcgcattggcgcatgctgtccataatggttttaccgtgcttgatggcgatatccatcatctaagccacggggaaaaggtctcgtttggcatattgacacaactagcgtgggaagaccgcaatcaattcgagattaaccgttacattcaattactgtcaaaacttggtttgcctgtgacatttaaagacctccatattgaagaaataagccgcgatgagttattaaaagtcgcacaaacagctttgcaagaaggcgaaagcagccataacttggcaagcgttccttctgccgatgacctcgttgatgccatggttgctgcagaccagtattccatcgcctatctcggaaaataa

SEQ ID NO: 291 - protein, 368 aa, Bacillus clausii KSM-K16
MDEKIFISPSKYVQGRGVLDKTGEYVKDLGKKALLIADEFVWGIAANRVADSLKEVGLDVVEVTFEGESSEAEIKRIVKKAESGGADIIVGIGGGKTLDTAKGVRDRLKGAACAIVPTTASTDAPTSALSVIYSEDGVFERYSFYSKNPDMILVDSTVIASAPPKFLAAGIADALATWVEARASFEGRGTTMAGGKATIAGLAIAEKCEQVLFDYGLLAYEANKRGVVSHALEQVIEANTLLSGLGFESGGLALAHAVHNGFTVLDGDIHHLSHGEKVSFGILTQLAWEDRNQFEINRYIQLLSKLGLPVTFKDLHIEEISRDELLKVAQTALQEGESSHNLASVPSADDLVDAMVAADQYSIAYLGK

SEQ ID NO: 292 - DNA, 1095 bp, Bacillus clausii KSM-K16
  CDS (1)..(1095): transl_table=11
atggagtcgcttgttgttcgcggagcaccacatgaatatgtattggaagaagggatactgtcttccttagaaactaaactaaaagcgagaggatttcaccatgttttagtggtccacggcgatgcctcttggaaagcggcagaacgattttggccggaatttacagctgttgaggcaacttactggcaatacaatggaatttgttcacaaaatcaaatggaccaactggcagctgttgtgcaaagcggcgagtacgatgcgattgtcggcgtggggggcggcaaactccttgacctagtcaaaggaggggcttaccaaacgaaacggccttatgtgctcgtgccgacgctagcctcaaattgtgccccttggacgccgcttgcggccgtttatacagatgaggggacctatacacactacgacgtttacccagaaaatgcgtcgttgctattacttgaaccgcgcttgcttttgactgcgccaaaagagctgtttgtcgctggcataggcgatacgcttgcaaaatggtacgaagcggatgtccagcttggttcgatggatgaaaagtccccagcattagaggtggcttattatacggctaaactatgtcgtgacattttgttggaaaaaagcgatgaagctttgcgcgcttttgacataggcgaagtgagcactgctttttgtaaagttgcagaaacgattattatgctaggtggcatggttggaggatttggggaccaatatggacggattgcaggagcccattcgatccataacggcttgacggttttagcggaaacacatggtattctccacggcgacaaagtggcatacggcattctcgtccaattggcgttagaagagaaatggcacgaaatcgaagcattgcggctattttatgaaaaagttggccttccatattcattaactcagttaggcatttccctccaagctgatttgcgttcagttgctgaaaaagcgacagtcgcagaagaatccattcatgtaatgccgtttccagtatcagcggatgctgtggtctctgccataaaaaaattggaagaaaaaaacgaagggctgcaagcaggagtgtaa

SEQ ID NO: 293 - protein, 364 aa, Bacillus clausii KSM-K16
MESLVVRGAPHEYVLEEGILSSLETKLKARGFHHVLVVHGDASWKAAERFWPEFTAVEATYWQYNGICSQNQMDQLAAVVQSGEYDAIVGVGGGKLLDLVKGGAYQTKRPYVLVPTLASNCAPWTPLAAVYTDEGTYTHYDVYPENASLLLLEPRLLLTAPKELFVAGIGDTLAKWYEADVQLGSMDEKSPALEVAYYTAKLCRDILLEKSDEALRAFDIGEVSTAFCKVAETIIMLGGMVGGFGDQYGRIAGAHSIHNGLTVLAETHGILHGDKVAYGILVQLALEEKWHEIEALRLFYEKVGLPYSLTQLGISLQADLRSVAEKATVAEESIHVMPFPVSADAVVSAIKKLEEKNEGLQAGV

SEQ ID NO: 294 - DNA, 1104 bp, Staphylococcus epidermidis RP62A
  CDS (1)..(1104): transl_table=11
atgtctaaatttatttatcaatcaccaggaagatatgtacaagggaaaggtattgttagctctatcgctgaagaaacagaacgtcttggtagtcacgcgttgattattgcagatgaagtggtttggaatatcactgaagaaaaaataaaagaaagtttctcagcaaataacaacgttgattttgaatatgaagtatttaaaggagaatcttctgaagaagaaattcaacgtatagttaaacaatataaagaaaaaaacattgacgttgttattggtttaggcggaggtaaagcgttagatacaggtaaagctgtagcatttgaacttaaagcaagcgtcatcgattttgcgtctacagcatcaatggatgcaccaacagcagcagtatctgttatttataacgaagatggatcatttagtggttatgaattctaccctaaaaaccctgatacagttatcgtagattctgaaattgttgcacaagcacctgtacgtttatttgcatcaggtatgagtgatggtttagcaacattaatcgaagttgaatctacacttcgtagacaagggcaaaacatgttccatggcaaacctacattagcaagtttagcaatcgctcaaaaatgtgaagaggttatttttgaatatggttacagtgcttatacttctgtagaaaaacatatcgtgacaccacaagtagatgctgtgattgaagccaatacattactttcaggtttaggatttgaaaacggcggattagcaggtgcacacgcaattcataatggattcacagctttagaaggagatatccaccacttaactcatggtgaaaaagtggcatacggtattttagtacaattagtacttgaaaatgcgccaactgaaaaattcatgaaatacaaaacattcttcgataatatcaatatgccaacaacattagaaggtcttcacattgaaaacacaagttatgaagaattagttcaagtaggtgaacgtgcattaacaccaaatgatacgtttgctaacttaagtgataaaatcactgctgatgaaatcgcagacgcaattttaactgttaatgatttatctaaaagtcagttcaactaa

SEQ ID NO: 295 - protein, 367 aa, Staphylococcus epidermidis RP62A
MSKFIYQSPGRYVQGKGIVSSIAEETERLGSHALIIADEVVWNITEEKIKESFSANNNVDFEYEVFKGESSEEEIQRIVKQYKEKNIDVVIGLGGGKALDTGKAVAFELKASVIDFASTASMDAPTAAVSVIYNEDGSFSGYEFYPKNPDTVIVDSEIVAQAPVRLFASGMSDGLATLIEVESTLRRQGQNMFHGKPTLASLAIAQKCEEVIFEYGYSAYTSVEKHIVTPQVDAVIEANTLLSGLGFENGGLAGAHAIHNGFTALEGDIHHLTHGEKVAYGILVQLVLENAPTEKFMKYKTFFDNINMPTTLEGLHIENTSYEELVQVGERALTPNDTFANLSDKITADEIADAILTVNDLSKSQFN

SEQ ID NO: 296 - DNA, 1188 bp, Thermobifida fusca YX
  CDS (1)..(1188): transl_table=11
atggcgaagacaaccacgatgccgacgacgcggtcgctgctcgccccggggcggtatgtgcaggggcggggggttctcgcggatctcggcacctatgtcgcagcgatcgggtccgtgccgctgatcctggctgatcccgtggtccggcagttgacggaggccacggtgaccgagtcgttccggcaggcggggctcgcggtgcggttcgaagagttcggcgggatccccaccgccgctgaggcgcggcgggtcgccgacgtgctctctgaccgcggctgcgacgtgatcatcggtctcggcggcggttcgacgatcgacactgccaaggctgccggggacaacgcggggatccggtgggtgagcgtgccgacggtggcgtccacggacgcccccacttcggcgctgtcggtcgtctacagcgaggaaggcgtcttcgaaacctaccggttctactcgcgcaaccccgaccttgtcctcgtggatacgcagctcgtcgccaacgctccggcacggttcctggtctcgggtatcggggatgcgctcgccacgtggatcgaagcgcgcgccgtgcagcgggcgaacggccccacgctcgccgggggaatggcgacgcacaccgggatcgcgttggccaaactgtcgtgggacctgttgtgggagaacgcgctgccagcggtcgaggcggtgcggagcaacctggtcacccccgccgtggaggcggtggtggaggcgaacacgctgctgtccggtctcgggttcgagtcgggaggcttggcggcggcgcactcggtccacgacgggttgacggtcgtgccccacacccaccacctcatgcacggcgagaaggtgaacatcgggtcgatcacccagctcatcttggaggcggcggcagccgaggagatccgcgagttcatcgagttcaccgcgcggctcggactgccgaccacgttgacggaggcaggcctgggccacgtggacgacgaagtgctccgcatggtggtggaggcggcgctcgccccggaggagacgatccacaacctgccgttctcggtttcggagaacgacctgttggacgcgttgaagatggtggaagagctggggcggtcggtccgtgccgaggctggactgcccgagcctcgcgccccgcaggaggagcgtccgccggtgccggccgcccgcatggcgtag

SEQ ID NO: 297 - protein, 395 aa, Thermobifida fusca YX
MAKTTTMPTTRSLLAPGRYVQGRGVLADLGTYVAAIGSVPLILADPVVRQLTEATVTESFRQAGLAVRFEEFGGIPTAAEARRVADVLSDRGCDVIIGLGGGSTIDTAKAAGDNAGIRWVSVPTVASTDAPTSALSVVYSEEGVFETYRFYSRNPDLVLVDTQLVANAPARFLVSGIGDALATWIEARAVQRANGPTLAGGMATHTGIALAKLSWDLLWENALPAVEAVRSNLVTPAVEAVVEANTLLSGLGFESGGLAAAHSVHDGLTVVPHTHHLMHGEKVNIGSITQLILEAAAAEEIREFIEFTARLGLPTTLTEAGLGHVDDEVLRMVVEAALAPEETIHNLPFSVSENDLLDALKMVEELGRSVRAEAGLPEPRAPQEERPPVPAARMA

SEQ ID NO: 298 - DNA, 1119 bp, Prochlorococcus marinus str. NATL2A
  CDS (1)..(1119): transl_table=11
atgtttataaataatcacagcatttcaccttcaaatgtcgttagaggtgaaggggcatgggctgactcattagatctaataactaaattatgcaaaaggcctttaataataggtagaagtagctctacaaagaaaataagaacttcattcaaaaaagatcttcttttaaaaggtattcaatcaatctcactagatttagaccatgattgctgtgaattagatatcaaaaatgcatatctaatctcaaaacacaataactgtgatgggattattgcggcaggaggtgggaaagtgcttgacgcaggaaaactaatcgctgatttacttggtattaattgcataactgttccattaagtgcctccacatgtgctggatggaccgctttatctaatatttacactcctgatggaaaatttgtaaaagatgtaactttgaaaagctgtccaaacttattgatctttgatcacacaattgttagaaacgccccaccaagaacacttgctagcggcatggccgatgctgtcgcaaaatggtacgagtcttccctaacaagcagttcaagccaagatggctttgttcagcaagcagttcagatggctagggttttacgcgatcaattatttttaaacggtcaaaaggctttcttggatccattaagcaattcttgggaaactgttgcagaaggatgcgccttaactgctggaataataggagggcttgggggcgcaagatgcagaacagccgcagctcatcctatacacaatggattaacacaactcgcatacactaataaaccacttcatggagaacttgttggatttggcttactcgtgcaattacatctagaagaaaaaaattcaaccagtcaattaccaaaacaagctaaatcacaacttttagagttcttctcgcaactcaatctccctatttcaattgagtctatttgtcttaggaataccacctcgaatgaactatataaagcatgtaaattcgcctgtaatgatgactctgatatacataaattacctttcccaataaatgaaaaagaccttttagaggctattcaaagtttacaatccttcccaacaagctccagaataaaaataaataatacttaa

SEQ ID NO: 299 - protein, 372 aa, Prochlorococcus marinus str. NATL2A
MFINNHSISPSNVVRGEGAWADSLDLITKLCKRPLIIGRSSSTKKIRTSFKKDLLLKGIQSISLDLDHDCCELDIKNAYLISKHNNCDGIIAAGGGKVLDAGKLIADLLGINCITVPLSASTCAGWTALSNIYTPDGKFVKDVTLKSCPNLLIFDHTIVRNAPPRTLASGMADAVAKWYESSLTSSSSQDGFVQQAVQMARVLRDQLFLNGQKAFLDPLSNSWETVAEGCALTAGIIGGLGGARCRTAAAHPIHNGLTQLAYTNKPLHGELVGFGLLVQLHLEEKNSTSQLPKQAKSQLLEFFSQLNLPISIESICLRNTTSNELYKACKFACNDDSDIHKLPFPINEKDLLEAIQSLQSFPTSSRIKINNT

SEQ ID NO: 300 - DNA, 1098 bp, Ralstonia eutropha JMP134
  CDS (1)..(1098): transl_table=11
atggtgcgtacgatgggttttccggggcaatatctgcaagggcctggcgccctgcggcaactgcccccgctactgcagcgcatgggctggcggcgcccgttggcgatctgcgacgccatcgttgcggagaaggtctggcccgccgtggcgcaggcactgtgcgaagccggagtcgcggcaaggcaactggcctttcccggggaatgcacgcgggcggtgatcgccgggatggtggatcaggcgtcgcagggcagccatgacgtggtcattggcctgggcggcggcaaggcactcgacaccgccaagggcgtggcgcgcgcgcttgacgttcccattgtcatttctccgaccattgcgtcgaacgatgcgccgacgagccgcgtgattgtcctgtacgacgatgcacaccggctggaaggcgccgaattcctgaagaccaatcccgcagcggtgatcgtcgacacgcaggtcatcgcgcaggcgccggtgcgcttcttcgccgccggcatcggcgacgccatcagcaagaaattcgaggctgcgcaatgcagggcgacgggacgcaacaacgcattcggaacgccgccgctggatacggcattgctgctcgctggcgctacctatgaaacactggtcaaacacggacctgccgcctgcgaagctatccggcgccaggagcccaatgaagccgtggaacgtgtggtcgaggcgaccgtgctgctcagtggcctgggcttcgaaggcggaggactggcgcttgcccatgcgctgacgcgcggcttcagcgcggtccccggcatggcgcaggcgctgcatggcgaacaggtcgcctttggtgcgctggtccaactggtggccgagcagcgagaccaggaggagatcgcagaacttgtcgatctgctctgcgcggtcggcctgcctgtcacgctgcaacagctaggggtggcgcccgagaaccatcacgacagcattgccaccatcgtccaggccacgttggcgggacagacgagcaacgtcatcagcccttctctcaaccctcagcaactggctgcggcgctcgcgcatgccgacagtatcggcacgctggccctcggctga

SEQ ID NO: 301 - protein, 365 aa, Ralstonia eutropha JMP134
MVRTMGFPGQYLQGPGALRQLPPLLQRMGWRRPLAICDAIVAEKVWPAVAQALCEAGVAARQLAFPGECTRAVIAGMVDQASQGSHDVVIGLGGGKALDTAKGVARALDVPIVISPTIASNDAPTSRVIVLYDDAHRLEGAEFLKTNPAAVIVDTQVIAQAPVRFFAAGIGDAISKKFEAAQCRATGRNNAFGTPPLDTALLLAGATYETLVKHGPAACEAIRRQEPNEAVERVVEATVLLSGLGFEGGGLALAHALTRGFSAVPGMAQALHGEQVAFGALVQLVAEQRDQEEIAELVDLLCAVGLPVTLQQLGVAPENHHDSIATIVQATLAGQTSNVISPSLNPQQLAAALAHADSIGTLALG

SEQ ID NO: 302 - DNA, 1191 bp, Anabaena variabilis ATCC 29413
  CDS (1)..(1191): transl_table=11
atgcctaatcaattatctaatcaaaccttgtctactcaaactgctagttcattaatcaccctcgcggttgccccggcaaaagtaatccgtggctctaatatattgcaggtagccgccacagaaattgccaagttgggcagtcgtcctttaattgtggcaggtaatagcaccgttgctatcagccaagagagtctgcaaccaattttagaagcccagaatctgcacgttgcccaagcctcctacggtgcagattgcgcggaagctagcttaaaagccttgaggaaagcagccaaagaacataaagccgatgccattatcggcattggtgggggtaaagctttagatacagctaagttagttgcccatcagttagatttacctgtagccacaattcccacctcagcagctacctgtgccgcttggacggcgctatccaatgtatattctgaagacggggcgtttctttacgatgtggctttatctcgctgtcccgatttactaatacttgactacgacttgattcaaacagcaccacaacatacactagtggcagggattggggatgcgatcgctaaatggtacgaagcttccgttagtagtggtcatctagaacaaactttaattatctccgcagtccaacaagcgcgagttttacgtgatattttattccaaaagtcggcaattgccttacaacaaccaggcagtgaagcttggcgggaagttgttgatgccacagttttactagctggtgtcatcggtggactaggtggggcccagtgtcgtacagtcgctgcccatgcagtccataatggtttaactcacattgccggacacagtagcatccacggtgaaaaagtcgcctatggaattttggtgcaactgcgtctggaagaaatggtgcaaggcaatcaactagccaccgcctcacgacagcaactattaaagttttatgcagagattggcctgccacaaaaattaggagacttggggttgggtaatattaccttaggcgagttgcaaacagccgccgaaatcgctttaacacctcaatctgacattcatcgcctaccattcaaagttgcgttggaacagttaatggcagcgatggtttctaccactgcaccaacagatagtagagactcagttcatcgtgtctccaccaggggaataagtgacgaggttgaggaatga

SEQ ID NO: 303 - protein, 396 aa, Anabaena variabilis ATCC 29413
MPNQLSNQTLSTQTASSLITLAVAPAKVIRGSNILQVAATEIAKLGSRPLIVAGNSTVAISQESLQPILEAQNLHVAQASYGADCAEASLKALRKAAKEHKADAIIGIGGGKALDTAKLVAHQLDLPVATIPTSAATCAAWTALSNVYSEDGAFLYDVALSRCPDLLILDYDLIQTAPQHTLVAGIGDAIAKWYEASVSSGHLEQTLIISAVQQARVLRDILFQKSAIALQQPGSEAWREVVDATVLLAGVIGGLGGAQCRTVAAHAVHNGLTHIAGHSSIHGEKVAYGILVQLRLEEMVQGNQLATASRQQLLKFYAEIGLPQKLGDLGLGNITLGELQTAAEIALTPQSDIHRLPFKVALEQLMAAMVSTTAPTDSRDSVHRVSTRGISDEVEE

SEQ ID NO: 304 - DNA, 1101 bp, Synechococcus sp. CC9605
  CDS (1)..(1101): transl_table=11
atggttcgatccatctcgtcccattccattgcccccgccagcgtcttgcggggggatggagtctgggatgaggccttgcctcagatcaaatccctctgttcacgtccgttggtgctcggtcgcagtgcttccactgcggatcagcgtcagcttttggtgtcggatctccaggcccaggggctcaatccccttcaggctcagctccagttcgattgctgtgagcaggatctgcagagagtggctgcggaagccaaggtctgtgacgccgttctggctgcaggcggtggaaaagtgctggacgccggcaagctgctggcccatcgcctctctcttccctgcgtcaccgttccgctgagtgcctccacctgtgctggctggacggctctctccaacatctattcccctcagggtgcttttgaaggggatgtggccctggatcgttgcccagatctacttgtctttgaccatggcctggtgcgccaggcgcctccgcgcaccttggccagtggcgtcgctgacgccctggccaagtggtacgaagcctcagtgagcagcggcgacagcagcgatggtctggtgcagcaggccgtgcagatggcacgggtgctgcgggatcaactgctgctcgacagcccagctgcgctgcgggacccagacagtgccgcctgggtgcgcaccgctgaagcctgtgcccttaccgccggggtgatggggggactcggcggcgcccgttgccgcactgttgcggcccacgccgttcacaacggcctcacccagcttgaggcttgccaccacgttctccatggcgagaaggtgggtttcggcatccttgtgcagctccgcctggaggagcgtctgggtggtaaccggcttgcaggccatgcgcaccgccagctgttgccgctgcttcggcagctcggcttgcccgtcagtcttgatgatctgggtttggcacaggccagcctcagtcagttgcaggaggtgtgtcgcttcgcctgccgcgagggttccgatctgcatcatttgcccttcgctgtgacgcctggtgctttgctggaggcccttgtgggtgctgcggaactaagccccagcagcctttga

SEQ ID NO: 305 - protein, 366 aa, Synechococcus sp. CC9605
MVRSISSHSIAPASVLRGDGVWDEALPQIKSLCSRPLVLGRSASTADQRQLLVSDLQAQGLNPLQAQLQFDCCEQDLQRVAAEAKVCDAVLAAGGGKVLDAGKLLAHRLSLPCVTVPLSASTCAGWTALSNIYSPQGAFEGDVALDRCPDLLVFDHGLVRQAPPRTLASGVADALAKWYEASVSSGDSSDGLVQQAVQMARVLRDQLLLDSPAALRDPDSAAWVRTAEACALTAGVMGGLGGARCRTVAAHAVHNGLTQLEACHHVLHGEKVGFGILVQLRLEERLGGNRLAGHAHRQLLPLLRQLGLPVSLDDLGLAQASLSQLQEVCRFACREGSDLHHLPFAVTPGALLEALVGAAELSPSSL

SEQ ID NO: 306 - DNA, 1092 bp, Prochlorococcus marinus str. MIT 9312
  CDS (1)..(1092): transl_table=11
atgcagttaatttctccagaaattgtatttagggggaaagatgcttgggaaaaagctttacctcaaattactaaattaaccaaaagtccattaattttaggtagggggattcatacaaataatctgagaaataaaatatttaatgatttaaaaaatcaaaaccttattgttaattctgctaatttacaatttgattgttgttatgaagacatttcaagagtaaagaatatcattttaaagaataataatgattctgttatcgctgctggaggtggcaaggttctagattctgggaaatatatagcagagtgtcttaatatcccttgtattacagtgcctcttagcgcctctacatgtgcaggttggacagccttatcgaatatttatacaaaagatggccaattcataaaggatgttgcattaggatcttgtccaagaatcctagtatatgatcataaatttattcaaaaagccccatctagaacacttgctagtggcatagctgatgctttggcaaaatggtatgaatcctcaataacaagttcaacaatagatgatggacttgttcaacaagcgattcagatatcaagagttttaagagatcaactattaatagatggagaaaaagcttttaaaggacaattcgaaaataatccttcttggcgaaatactgtagaagcttgtggacttacagcaggattaatcggaggtattggtggagaaaagtgtaggactgccgcagcacatgctattcataatgcaattactcagataattacccctaataaattcttacatggtgagattgttggagtaggattattattgcaattaagactagaagaaattaaaaataataataaattagctgatcaatcgattaaacaattattggtactcatgaaagaattgaaattaccaactactattgcacaacttggaataaatgtttttgaaaataataatttagagaaaattgctgattttacttgtcgagataaatctgagattcattttttgccttttgaaatttttaaacaggacataatagaggtcattacaaattttgaacaacaaaaaattaaaatataa

SEQ ID NO: 307 - protein, 363 aa, Prochlorococcus marinus str. MIT 9312
MQLISPEIVFRGKDAWEKALPQITKLTKSPLILGRGIHTNNLRNKIFNDLKNQNLIVNSANLQFDCCYEDISRVKNIILKNNNDSVIAAGGGKVLDSGKYIAECLNIPCITVPLSASTCAGWTALSNIYTKDGQFIKDVALGSCPRILVYDHKFIQKAPSRTLASGIADALAKWYESSITSSTIDDGLVQQAIQISRVLRDQLLIDGEKAFKGQFENNPSWRNTVEACGLTAGLIGGIGGEKCRTAAAHAIHNAITQIITPNKFLHGEIVGVGLLLQLRLEEIKNNNKLADQSIKQLLVLMKELKLPTTIAQLGINVFENNNLEKIADFTCRDKSEIHFLPFEIFKQDIIEVITNFEQQKIKI

SEQ ID NO: 308 - DNA, 1197 bp, Synechococcus elongatus PCC 7942
  CDS (1)..(1197): transl_table=11
atggaagtttcgacgggctaccttccgcaggcagtcttcgcccctgccgatcaaggtcatcctgccccgcgtgtctttatctcgccccagcgctacatccaagggcgaggtgttttgcggagtgttggccgctacctctccctattgcaggcaaaacgagcaggcctgctgatgtcgcaacgcagcagtcgaaatgaaggagatttattactagccggactgcgatcggctggtgttgatgctgtcgtcagcacctttcagggcgaatgtacaaccgatgaaatcaccgctcacaccaccgctttttccaaagagcgaatcgactgcgtgattgctgcgggaggtgggaaatgtatcgataccggtaaagcgatcgcgtttcggttggggattcctgtcgttgtcgtcccgacccttgcctccaacgatgccccctgttctgcgctctctgtcctctactcccctgagggaatttctcaaggcgtcgagttctatcccaatagcccagccatcgtggttgtcgataccgacatcattgccgcagcgcccgaacgctaccttgtggctgggatgggtgacgcgatggcgacttggtatgaggcgtctgtctgtcttcgtaatccggcggctgtcacaaccgtgggcgctcgtcccaccttggctgcatgtgcgatcggtgaagtctgtgcccataccctctttcaagaaggctgtgctgccgctgcggctgttgcctccaaaacggtcaacgacgccttggagtcagtggtagaagcaaataccttacttagcgggctgggctttgaaagtggtgggttggccggcgctcatgctgtcgcccaaagctacacagcgattccccatgtgcgtgccaactaccttcacggcgaaatggtagcgatggggactcttgctcaactgatgatggaatcgcgccccaaggaagcaacacgagttgccgagttttttgctgctgttgggctgccgattcatcttggtcaactctcgctaagcagtagcgacacccaagctttagagatcgttagtgaagcttcattaggcttcccttttgtcggtaatatgccaatgaaaataacaccagaatttgtgaaatctgcaattcttgatgctcatcacctaggactcagtatatccgagcagatcggagacagtgcttatcgacatctacagggctaa

SEQ ID NO: 309 - protein, 398 aa, Synechococcus elongatus PCC 7942
MEVSTGYLPQAVFAPADQGHPAPRVFISPQRYIQGRGVLRSVGRYLSLLQAKRAGLLMSQRSSRNEGDLLLAGLRSAGVDAVVSTFQGECTTDEITAHTTAFSKERIDCVIAAGGGKCIDTGKAIAFRLGIPVVVVPTLASNDAPCSALSVLYSPEGISQGVEFYPNSPAIVVVDTDIIAAAPERYLVAGMGDAMATWYEASVCLRNPAAVTTVGARPTLAACAIGEVCAHTLFQEGCAAAAAVASKTVNDALESVVEANTLLSGLGFESGGLAGAHAVAQSYTAIPHVRANYLHGEMVAMGTLAQLMMESRPKEATRVAEFFAAVGLPIHLGQLSLSSSDTQALEIVSEASLGFPFVGNMPMKITPEFVKSAILDAHHLGLSISEQIGDSAYRHLQG

SEQ ID NO: 310 - DNA, 1080 bp, Synechococcus elongatus PCC 7942
  CDS (1)..(1080): transl_table=11
gtgttacgaggctggggcgcactctcagaggcaggatctgcgatcgcccgcgttggtcagcgtccccttgtggtgggtggcgatcgcgccagagcactcgtccaagacagtttgacggcgatcgcttcagaacaatccctgaccctaggttggggcagcagcttgccggactgtagtgaagcggttttggcacggctccagcaagcagcaaccgagcatcaagctgattgcattctaggtgtgggcggcggtaaggcgctcgatacggccaaactgctggggcatcaactgtcgctgccggtgatcaccgtgccgacgagtgcggcgacctgtgcggcttggacagcattggcgaatgtctataccgatgccggggcttggctctacgatgtcggtctcgatcgctgtcctgagttgctgattctcgactttgaactgattgcccaagcgcccccccgcaccctagcggcgggaattggggatgcgatcgccaagtggtacgaagcttccgtcagcagtggtcatcgccaagaaactttggtcgttgcggcggttcagcaagctcgtgtcctgcgtgatctgctcttccagaaatcggctgccgcgatcgcggaacctggcggtgagcaatggtacgaagtggtggaagccaccgttttacttgcaggcgtgattggggggttaggtggggcgcaatgccgcacggtggctgcccatgctgtccacaatggcttgacccatctgcccgcttgtcatgattggctgcacggcgagaaggttgccttcggtattttggtgcagttgcgtttagaagaactgcaaggcaccaacccgctggcagcaaccgcacggcaacaactgctgagcttctatgccgatctggggctgccgcgccaatggtctgacatgggcttagcgtccgtcagcttagcggatttgcagcaagcggcaattctggcctgtgcgcccgagtcggacattcaccacctgccttttgcggtggatcctgatcagcttttggcggcgatggtttccacgactaccccgatcgcccgcagcaacagtgtggtggctgaatga

SEQ ID NO: 311 - protein, 359 aa, Synechococcus elongatus PCC 7942
MLRGWGALSEAGSAIARVGQRPLVVGGDRARALVQDSLTAIASEQSLTLGWGSSLPDCSEAVLARLQQAATEHQADCILGVGGGKALDTAKLLGHQLSLPVITVPTSAATCAAWTALANVYTDAGAWLYDVGLDRCPELLILDFELIAQAPPRTLAAGIGDAIAKWYEASVSSGHRQETLVVAAVQQARVLRDLLFQKSAAAIAEPGGEQWYEVVEATVLLAGVIGGLGGAQCRTVAAHAVHNGLTHLPACHDWLHGEKVAFGILVQLRLEELQGTNPLAATARQQLLSFYADLGLPRQWSDMGLASVSLADLQQAAILACAPESDIHHLPFAVDPDQLLAAMVSTTTPIARSNSVVAE

SEQ ID NO: 312 - DNA, 1092 bp, Moorella thermoacetica ATCC 39073
  CDS (1)..(1092): transl_table=11
ttgctggaacgaattatcgcccccgggagctacctccggggtccggctgtcattgaaaaagccggccaggctctggcaaggctgggcgccagggcctgcctggccggaggccaccgggccctggcggcggcagccccggccctgcaggaggccctatcttcagccggggtagaaccggcggggcaggtctggtacgggggagaatgttgcccggaaaatattgccagggtagcgacaactgttaaggaaacaggagccgatttcttgataggggttggcggcggcaaggccctggataccgccaagggagccgcctggcaggcaggggtgcccctggtgacggtgccgaccatcgctgctacctgcgccgcctttacctccattgccatcatctatgatcgggagggccacttcttggctatatcccacgaggcggcgaatccgtctctggtcctggtagacagccggatcatcgctgccgcccctggccgttacctggctgccggcatgggggacaccattgccaagtatatcgaactgcgtgccaccagcacggcagccgcccggcatctagccctggaaggcgccctggagttggctcgcctatgctatgacagcatcctggccgccgggccaggtgccagggcagcggtagatgaccgggcagtcaccccggatctggagaaggtcattgacgccgtgattcttatcagcgggttggtcagcggcctgggaggcgatgacgggcggactgccggcgcccacggcgtttatgaaggcttaaccgcttcccccctgacccgttcttactgccatggagaactggtagccttcggcaacctggtccagctggtcctggaagggagagagaggggggaaatcaggggagtggctgattttaaccgccgggtcggcctgccggtaaccctggaaggtgtggggctatccccggaggacgggccttccctggacctggtcagccgggcggcggcagagagcccggatatggccaacatgcccttcccggtgacggccaccatgatccgggaagccctgctggcagccgaccgcctcggccgggagacagcttag

SEQ ID NO: 313 - protein, 363 aa, Moorella thermoacetica ATCC 39073
MLERIIAPGSYLRGPAVIEKAGQALARLGARACLAGGHRALAAAAPALQEALSSAGVEPAGQVWYGGECCPENIARVATTVKETGADFLIGVGGGKALDTAKGAAWQAGVPLVTVPTIAATCAAFTSIAIIYDREGHFLAISHEAANPSLVLVDSRIIAAAPGRYLAAGMGDTIAKYIELRATSTAAARHLALEGALELARLCYDSILAAGPGARAAVDDRAVTPDLEKVIDAVILISGLVSGLGGDDGRTAGAHGVYEGLTASPLTRSYCHGELVAFGNLVQLVLEGRERGEIRGVADFNRRVGLPVTLEGVGLSPEDGPSLDLVSRAAAESPDMANMPFPVTATMIREALLAADRLGRETA

SEQ ID NO: 314 - DNA, 1074 bp, Methanococcoides burtonii DSM 6242
  CDS (1)..(1074): transl_table=11
atggatgtgacgcatgatatgaacggacagaagaaatggatgcagctaccaagaaatgttgtgataggaaatggtgtcatcaacgaggtcagagatgtctgcacagacctgaaacttatcgacaacgcattagtggtcacaggaaagagtactaaggggatagcaggtgagatagttcaggattcattgcaggatgcgggccagaatgtagaactcgtaatatcagaatcagcatctatgaaagaagttgaaaggataaggaagcatgcaattgaatccggcaccaaatactttttgggcgttggtagcggtaaaactatcgatgttgctaaacttgctgccactgatctggaagtgccgttcataagtgtcccaacagctgcctcacatgatggtatcgtttcttcgagagcttccataaaggatgggaagaccactacatcggtccaggctaatgcaccaatggcagttattgcagatactgagatcatagccaatgcaccctacagattattagcagccggctgtggagacattatctcgaattgtaccgcagtgcttgactggcaactcgcaagccgtctccagaatgtgcagttcagtgaatatgccgctgcgctcgcaagtatgaccgcacaaatacttatcgattcagcagattcgataaaacccgaacttgaaagctctgtcagaatggtcgttaaggcacttgtatcaagcggagtcgcaatgagcattgccggctcatcaagacctgcatccggctccgagcatatgttcagccatgcacttgaccgggtagcagatgaaccggcacttcacggggaacaatgcggggttggtacaatattgatgatgtaccttcatggcggtgactggaaaaaaataagtgatgctttaaagctgataggggcacccacgactgccaaagagctgggtattgaagataagtatatattagaagcacttgtactctcacatactatcagaccagaaaggtataccatacttggaacagggctgacacccgatgccgctgaaatagtcgcaaggaagacaaaggtcatatcctaa

SEQ ID NO: 315 - protein, 357 aa, Methanococcoides burtonii DSM 6242
MDVTHDMNGQKKWMQLPRNVVIGNGVINEVRDVCTDLKLIDNALVVTGKSTKGIAGEIVQDSLQDAGQNVELVISESASMKEVERIRKHAIESGTKYFLGVGSGKTIDVAKLAATDLEVPFISVPTAASHDGIVSSRASIKDGKTTTSVQANAPMAVIADTEIIANAPYRLLAAGCGDIISNCTAVLDWQLASRLQNVQFSEYAAALASMTAQILIDSADSIKPELESSVRMVVKALVSSGVAMSIAGSSRPASGSEHMFSHALDRVADEPALHGEQCGVGTILMMYLHGGDWKKISDALKLIGAPTTAKELGIEDKYILEALVLSHTIRPERYTILGTGLTPDAAEIVARKTKVIS

SEQ ID NO: 316 - DNA, 1131 bp, Clostridium perfringens ATCC 13124
  CDS (1)..(1131): transl_table=11
atgagaaaggcttttatatgcccaacaaaatatgttcaaggagaaaatgaattacttaatttaggttactttgtagagacttacggaaagtcagcacttttaatagctcatccagaagatataaagagagttaaagataaattagatgcaacagcaaagaaatttaacattgaatttgtagaaggcggatttaaaggtgaatgttcacgtcaagaagttaaaagacttcaagatcttgcaaaggaaatgaaatgtgattgtacagtaggtcttggtggaggaaaagctttagacacagctaaatgtgttgctgaaggtgaaaaacttatagtagtaccaacaatagcagctacagatgctccaactagtcactcagcagttttatatacagaagatggatcatttgatgattatgcatactttaaagcaagcccaagtgttgttttagtagacacagaggtaatagcaaaagctccaactcgtttcttagtagcaggtatgggagatgctttatcaacttactttgaagcaagagcaacatcaagttcatttactaaagtcaatgcgggattaccatgtggggtaagagaagaaaaatgtagaccagcaattggaacaaatgcttcattagcacttgctaagctttgctatgaaacattattagaagacggaaagaaagctaaagatgcttgtgattgtaactgtgttactaaatctttagaaaatatagtagaaacaaacatattattatcaggtttaggatttgagagtggtggattagctgcagctcatgctatacatgatggtttaacaatattagaaggaacacatggatatttccatggagaaaaggttgcttttggaacaatagctcaattagttcttgaaaatgcaccaaaagaagaattatatgaagttttagatttctgtttagaaataggtcttccagtatgtcttgaagatataggtgtaacagaagtttcagatgaagaattatttgaagttgcagaaaaagcttgtataccagaagagtcaatttactcaatgccatttggaatagaagtttcagaagtagtatcagcaattaaattagcagataagataggtaaagactacaaaaatagaaaataa

SEQ ID NO: 317 - protein, 376 aa, Clostridium perfringens ATCC 13124
MRKAFICPTKYVQGENELLNLGYFVETYGKSALLIAHPEDIKRVKDKLDATAKKFNIEFVEGGFKGECSRQEVKRLQDLAKEMKCDCTVGLGGGKALDTAKCVAEGEKLIVVPTIAATDAPTSHSAVLYTEDGSFDDYAYFKASPSVVLVDTEVIAKAPTRFLVAGMGDALSTYFEARATSSSFTKVNAGLPCGVREEKCRPAIGTNASLALAKLCYETLLEDGKKAKDACDCNCVTKSLENIVETNILLSGLGFESGGLAAAHAIHDGLTILEGTHGYFHGEKVAFGTIAQLVLENAPKEELYEVLDFCLEIGLPVCLEDIGVTEVSDEELFEVAEKACIPEESIYSMPFGIEVSEVVSAIKLADKIGKDYKNRK

SEQ ID NO: 318 - DNA, 1134 bp, Trichodesmium erythraeum IMS101
  CDS (1)..(1134): transl_table=11
atgattaaatctactcatatctcccagacagctacaaccttactatctctaaacatagcccctactcaaattattcgaggtaaaaatgctctggcccaatcaggagaggcgatcgctcgtattggccatcatcccctaatcgttgggagtcctcgctctttgaacatcatcctgccccacctccaacccttattacaaatccataatttaaaattcacccaagctaactatggttcagactgtagtgaaactagtttagccaatctttctcaagctgtagccacacaaaaaccagacctaataattggtattggtggtggtaaagctcttgacacagcaaaactcctagcttataaatgtcatttgcccataattaccattcccacctcagcagctacttgcgcagcttggacagcattatcaaatatctactcagaccaaggggccttcttatacgatataagtttagctaaatgtccagaattgctaattctagattatggaattattaaaactggcccttcacggactttagtggctggtattggagatgcgatcgccaaatggtatgaagcttcagtctctagtggccattcagagtcaacaatgattatttctgctgtccaacaagccagagtactaagggatatcctttttcaaaaatcaacttttgccctagaacaaccaggaggagaaacctggcaagaggttgtagatgcaacagtattattagcaggtttaattggaagtattggtggtgcacaatgtcggactgtggcagcccatgctattcataatggcctcactcatttatctgctagccatgaaaaattacatggagaaaaagtcgcttatggtatattggttcagctaaggttagaagaaatgctacaaagcaatcaactagctgcaactgctagacaacaactgttaaaattctataatcagattggtttaccaaaaagcttaaatgacttaggcttaaaagaaattactttatctgaattacgccatgttgctgaagttgcttgtcatccaaattctgacattcatcggttaccatttagaataattccagagcaattagtagcagcaatggtttctacaacagtcccattagagctagagaaataa

SEQ ID NO: 319 - protein, 377 aa, Trichodesmium erythraeum IMS101
MIKSTHISQTATTLLSLNIAPTQIIRGKNALAQSGEAIARIGHHPLIVGSPRSLNIILPHLQPLLQIHNLKFTQANYGSDCSETSLANLSQAVATQKPDLIIGIGGGKALDTAKLLAYKCHLPIITIPTSAATCAAWTALSNIYSDQGAFLYDISLAKCPELLILDYGIIKTGPSRTLVAGIGDAIAKWYEASVSSGHSESTMIISAVQQARVLRDILFQKSTFALEQPGGETWQEVVDATVLLAGLIGSIGGAQCRTVAAHAIHNGLTHLSASHEKLHGEKVAYGILVQLRLEEMLQSNQLAATARQQLLKFYNQIGLPKSLNDLGLKEITLSELRHVAEVACHPNSDIHRLPFRIIPEQLVAAMVSTTVPLELEK

SEQ ID NO: 320 - DNA, 1137 bp, Synechococcus sp. CC9311
  CDS (1)..(1137): transl_table=11
atggcctacccactggaacaaggctgcattcatcagcgtccgctagccgtgctggcgtcccctggtcgctacgtgcaaggtccaggggcaacgcatgaactcggtcgagagttaaaacgattggggctggccgattctgtgttgttcattgctggcggtacagcacagcgctgcctagcccgcatctggcaagcagagctcccgccccttggcctcacccctgtgattgaaacctttggaggggaatccagcgaagcggaaattgatcgtcttgttgaacttgccaaaacccatacgttcacagcagttgtgggcgccggtggtggcaaagcatccgacaccgcgcgcgccgtcgcgaacgagctggaacttcccgtggtgatcacccccaccctggcaagcacagattccccttgcagtgcactttcagtgctgtacacggagcaaggggagatgctgagttatcgcttctatacccgccatcctgcgttggtgctcgtcgacaccacagtgatcgcgcaggctcctaaacgacagctcgtggccggccttggcgatgcacttgccacctggtttgaagccagaacggtgcgccagagccacgtgaacaatcagttagggggcaagcccacgacatcgggaacagccctggcaaagctttgccacgagatcctgctaaccgacggtcctgccgcttgtgccgcagtggatgcaggtgttgcgaccccagcactggaacgcatcgttgaagccaacaacctgctttcaggtcttggctttgaaaacggcggacttgctgctgcgcatgcggttgccaacggcttcagcatgattgccggcagtcaccgcatgctccatggagagaaggtggccatgggcctccacacccagttggttctcgaaggacaacctcaatccgaaatttgcgaaatttttgagtactgcagaagcgtggggcttcccaccaccttggcccaattgggagtcaacgccgatagcgacaaagacattcaaaccattgctgaacgtgcagtgatgcctggagaaaccatccacaacgaaccctttgaagtcagcgccgctgccgtggactgcgctctcaaagccgccgatcaacaagggcgcgcctatgcctaa

SEQ ID NO: 321 - protein, 378 aa, Synechococcus sp. CC9311
MAYPLEQGCIHQRPLAVLASPGRYVQGPGATHELGRELKRLGLADSVLFIAGGTAQRCLARIWQAELPPLGLTPVIETFGGESSEAEIDRLVELAKTHTFTAVVGAGGGKASDTARAVANELELPVVITPTLASTDSPCSALSVLYTEQGEMLSYRFYTRHPALVLVDTTVIAQAPKRQLVAGLGDALATWFEARTVRQSHVNNQLGGKPTTSGTALAKLCHEILLTDGPAACAAVDAGVATPALERIVEANNLLSGLGFENGGLAAAHAVANGFSMIAGSHRMLHGEKVAMGLHTQLVLEGQPQSEICEIFEYCRSVGLPTTLAQLGVNADSDKDIQTIAERAVMPGETIHNEPFEVSAAAVDCALKAADQQGRAYA

SEQ ID NO: 322 - DNA, 1122 bp, Synechococcus sp. CC9311
  CDS (1)..(1122): transl_table=11
ttggtttgccacacacatgccattgctccttcccgggtcattcggggagagcaagcatggcaacgtggccttcctgccattgcagacctctgtcaaagaccagcactgctagggcgtagcccagcaactcaagccatacgtgatggtttgaaggctgatctcatttcaaacgaactgacagttgaagaagttcaactcaacttcgactgctgtgaggatgacctcattcgccttgaggcctcgctcaaggcaactgcgtgtgactccttgattgcagcaggaggaggcaaggttttagacgcaggaaagctcctggcctatcgcctcaaagttccttgcatcacagtgccgctcagtgcagcaacctgcgcaggttggacagctctcgccaacatttattccccagatggagcgtttgttgccgacgtggcactcgatgcttgcccagatctcctgatttttgatcatgggctggttcgccaagcaccgaatcaaaccctttccagtggtatcgccgacgccctagccaagtggtacgaagcttccgtgagtagcggatctagtacggacggaatgatccaacaggccgttcaaatggcccgagtgcttcgcgatcaacttttgattgatgcccttgacgccatcgctcgtcctgagagtgaggcctgggtccgggttgctgaagcctgtggtcttaccgccggagtgattggtggccttggaggagcgcagtgcaggacggttgcggcccatgcagtccataacggcctaacgcaattgccttcttgtcacggcaagttgcacggggaaaaagtgggatttggcattctggttcagcttcggcttgaagaacgccttggtggcaatcaactggccgcccaatcccgtcgccaacttctgcccttactcaaggaacttggtctacccgtttctctccaagatcttgggcttggagagacaggattgcatgatttgcgcgccatttgcagcttcgcctgccggccaggatccgacctacaccatctccccttcgaggtcaccgaaaccgatctgcttgaagctctcgtgagcaccgaggctgacagtcgctccatcaatacgtctctggagactgaagcttga

SEQ ID NO: 323 - protein, 373 aa, Synechococcus sp. CC9311
MVCHTHAIAPSRVIRGEQAWQRGLPAIADLCQRPALLGRSPATQAIRDGLKADLISNELTVEEVQLNFDCCEDDLIRLEASLKATACDSLIAAGGGKVLDAGKLLAYRLKVPCITVPLSAATCAGWTALANIYSPDGAFVADVALDACPDLLIFDHGLVRQAPNQTLSSGIADALAKWYEASVSSGSSTDGMIQQAVQMARVLRDQLLIDALDAIARPESEAWVRVAEACGLTAGVIGGLGGAQCRTVAAHAVHNGLTQLPSCHGKLHGEKVGFGILVQLRLEERLGGNQLAAQSRRQLLPLLKELGLPVSLQDLGLGETGLHDLRAICSFACRPGSDLHHLPFEVTETDLLEALVSTEADSRSINTSLETEA

SEQ ID NO: 324 - DNA, 1191 bp, Nostoc punctiforme PCC 73102
  CDS (1)..(1191): transl_table=11
atgtctaatcaactttctactcaaccttctttgtctactcaaacctctagctcattatttacgctcacagttgccccggcaaaagtcatccgtggttctggggtattgcaagcagccgcagcagagatcgcctgtttgggaagtcgtcccttaattgtggcaggtgaatcgactctcgctatcagccgaaagaatttgcaaccagttttagaaacgcaacagttacatcctgttcaagcttcttatggtgcagattgctgcgaagctagcctgaaatctttacagaagaaggcaaaagaacataaagctgatgtgattattggtgttggtggcggcaaagccttagatacagcaaaattactcgcgcagcagttacagttgccagtggtgacaattccgacatcaggggctacctgtgcagcttggagtgccttgtcgaatgtttattcggaaaatggggcatttctctacgatgtggggctgtctcgttgtcccgatttactgatactcgattatgacttgattcaaactgcaccacaacggactttagtagctggaattggtgatgcgatcgctaagtggtatgaagcctctgttagcagtgggcatttgcaagacactttaattattgctgcggtgcaacaagcaagagttttgcgagatatcctcttgcaaaagtcagccgccgccttgaaggaaccaggtagcgaagtttggcgagaagtcgtagacgcaagtgttttattagctggggtagttggaggacttggaggggcccagtgtcgcacagttgctgcccatgccgtgcataatggtttaactcatatttcaggacatggcagtattcatggcgaaaaggttgcttttggaattttggtgcaactgcgtttagaagaaatgctacaaggcaatcaactagcagcatcagcacgacaacagttgttaaagttctacacagaaattggactaccccaaaaattaagtgatttgggattgggcaatattacattaggtgagttacaaacagccgccgaaattgctctagttcctaattctgacatccatcgactaccgtttaaagtcgcgccagaacagttgatggcagcaatggtttccaccactgcacctatagatagtaaagacatgaatcgagtttcgcccaagggaatcagtgacgaggttgaagaatga

SEQ ID NO: 325 - protein, 396 aa, Nostoc punctiforme PCC 73102
MSNQLSTQPSLSTQTSSSLFTLTVAPAKVIRGSGVLQAAAAEIACLGSRPLIVAGESTLAISRKNLQPVLETQQLHPVQASYGADCCEASLKSLQKKAKEHKADVIIGVGGGKALDTAKLLAQQLQLPVVTIPTSGATCAAWSALSNVYSENGAFLYDVGLSRCPDLLILDYDLIQTAPQRTLVAGIGDAIAKWYEASVSSGHLQDTLIIAAVQQARVLRDILLQKSAAALKEPGSEVWREVVDASVLLAGVVGGLGGAQCRTVAAHAVHNGLTHISGHGSIHGEKVAFGILVQLRLEEMLQGNQLAASARQQLLKFYTEIGLPQKLSDLGLGNITLGELQTAAEIALVPNSDIHRLPFKVAPEQLMAAMVSTTAPIDSKDMNRVSPKGISDEVEE

SEQ ID NO: 326 - DNA, 1107 bp, Listeria monocytogenes str. 4b H7858
  CDS (1)..(1107): transl_table=11
ttgttgaataaagaattgattgttcgcggagctccgcaagaatatttatgccaagtaggcgcgtgggatacattacctactcacctagaacgccgcggtttgaaaaatgtattagtagttcgtggaaatgcttcttgggaagtcgctaaaaagaaattccctgttttatcaactgttacatctacttttgaagtatataatggtggttctacctacgaggagcgcgatcgtctggtggcaatcatggaaacaaataagatggatgcgattatcgcagtaggtggcggaaaaatagctgacgtatgtaaagcgacagcagcagttctacgtttaccagtcattatcttaccgacacttgcatcaacttgtgccgcttatacaccacttagtgtgatgtacgacgaagagggcgctatgattcgttacgatgtgtttgcgagtagtaatgcgctgttattaattgatccggaaatgattttagactcaccgaaagagttactagttgctggaattggcgatacgttagccaaatggtacgaagcagacgtgattattaattccttaccaactaaatcagtcgaaattgaaatcgcgcattttgctgccaaaatgtgccgtgataacttgttgcaatatagcgaagaagcacttgctgccatggacaaacaagtattgaatgaagcgtttgttaaaattattgagacgaatattttagttggtggaatggtcggtggttttggcgatgattatggacgttgtgcaggagcgcattcgattcatgacgcgctaacgatggttccagaaacacatcacttattgcatggtaataaagtagcttatggtattttagttcaattagtaatagaaaatagatgggatgaaatcgagcgtttgttgccattttattctgagcttggtcttccgatgagtttatatgatatgggacttgcgacacttgcggaagaaacgcttgtggccgtatctaaacgtgcaacggagccacatgaaacaatccatatgatgcccggtgaaatgacagctgatgtagtattaaatgcgatgaaacagttagaagatagtatggcaatgaaacgagtggctaagtaa

SEQ ID NO: 327 - protein, 368 aa, Listeria monocytogenes str. 4b H7858
MLNKELIVRGAPQEYLCQVGAWDTLPTHLERRGLKNVLVVRGNASWEVAKKKFPVLSTVTSTFEVYNGGSTYEERDRLVAIMETNKMDAIIAVGGGKIADVCKATAAVLRLPVIILPTLASTCAAYTPLSVMYDEEGAMIRYDVFASSNALLLIDPEMILDSPKELLVAGIGDTLAKWYEADVIINSLPTKSVEIEIAHFAAKMCRDNLLQYSEEALAAMDKQVLNEAFVKIIETNILVGGMVGGFGDDYGRCAGAHSIHDALTMVPETHHLLHGNKVAYGILVQLVIENRWDEIERLLPFYSELGLPMSLYDMGLATLAEETLVAVSKRATEPHETIHMMPGEMTADVVLNAMKQLEDSMAMKRVAK

SEQ ID NO: 328 - DNA, 1107 bp, Listeria monocytogenes str. 1/2a F6854
  CDS (1)..(1107): transl_table=11
ttgttgaataaagaattgattgttcgcggagctccgcaagaatatttatgccaagtaggcgcgtgggatacattacctactcacctagaacgccgcggtttgaaaaatgtattagtagttcgtggaaatgcttcttgggaagtcgctaaaaagaaattccctgttttatcaactgttacatctacttttgaagtatataatggtggttctacctacgaggagcgcgatcgtctggtggcaatcatggaaacaaataagatggatgcgattatcgcagtaggtggcggaaaaatagctgacgtatgtaaagcggcagcagcagttctacgtttaccagtcattatcttaccgacacttgcatcaacttgtgccgcttatacaccacttagtgtgatgtacgacgaagagggcgctatgattcgttacgatgtgtttgcgagtagtaatgcgctgttattaattgatccggaaatgattctagactcacctaaagagttactagttgctggaattggcgatacgttagccaaatggtacgaggcagacgtgattattaattccttaccaactaaatcagtcgaaattgaaatcgcgcattttgctgccaaaatgtgtcgtgataatttgctgcaatatagtggagaagctcttgctgccatggataaacaagtgttaaatgaagcatttgttaaaattatcgagactaatattttagttggtggaatggttggaggttttggcgatgattatggtcgttgtgccggagcgcattcgattcatgatgcgctaacaatggttccggaaacgcaccatttactacacggtaataaagtagcatacggaatcttagttcaattagtaatagaaaatagatgggatgaaatcgagcgtttgttgccattttattctgagcttggtcttccgatgagtttatatgatatgggacttgcgacacttgcagaagaaacgcttgtggccgtatctaaacgtgcaacggagctacacgaaacaatccatatgatgcccggtgaaatgacagctgatgtggtgttaaatgcgatgaaacagttagaagatagtatggcaatgaaacgagtgactaagtaa

SEQ ID NO: 329 - protein, 368 aa, Listeria monocytogenes str. 1/2a F6854
MLNKELIVRGAPQEYLCQVGAWDTLPTHLERRGLKNVLVVRGNASWEVAKKKFPVLSTVTSTFEVYNGGSTYEERDRLVAIMETNKMDAIIAVGGGKIADVCKAAAAVLRLPVIILPTLASTCAAYTPLSVMYDEEGAMIRYDVFASSNALLLIDPEMILDSPKELLVAGIGDTLAKWYEADVIINSLPTKSVEIEIAHFAAKMCRDNLLQYSGEALAAMDKQVLNEAFVKIIETNILVGGMVGGFGDDYGRCAGAHSIHDALTMVPETHHLLHGNKVAYGILVQLVIENRWDEIERLLPFYSELGLPMSLYDMGLATLAEETLVAVSKRATELHETIHMMPGEMTADVVLNAMKQLEDSMAMKRVTK

SEQ ID NO: 330 - DNA, 1122 bp, Crocosphaera watsonii WH 8501
  CDS (1)..(1122): transl_table=11
atgccaacaaaaaccactaaaattactccagttaccaccaagcttaattccttatttgtttccccaactcaggtaattcaaggtgaggggattatatcccaagcaggaaaaggtatctctcgtttgggtaagcgtcctttactggtggggggtaagcaaacccttgagctaatctcagcacatttaaagcccattttcaaacaatttaagttaacagcagcgtttgatagctacgcccctgactgttcggaaacttccctaaaaaacttgaccgaagctacccaaaatcatcaagctgatttgattattggtgttggtggaggaaaagctcttgatacggctaaattactcgcttatcagcaacaattacccattgttaccattcccacctctggggcaacttgcgccgcttggacagccctttctaacgtctattctaaccagggggcatttcaatacgatgtgccattatcccgttgtcctgatttactaattttggactataacctaattaaagcagccccgaaaaggactttagtggccggtattggtgatgcgatcgccaaatggtatgaagcttctgttagtagcggccagtctgaggccaccctcaccattgctgcggtacaacaagcgagggtattacgggacattctcttacaaaagtcggttaaggctttggataagataggaggagaagactggcgagaagtggtcaacgctacggtactgttagctggtgttattggtgggttaggaggggcaaactgtcgcactgtggcagcccatgctgtccataacggcctaacccatattcccgcagcacatcacgccttacacggggaaaaggtggcttatgggatcttagttcaattacgtctagaagagatgatacaggggaataaattagcggccacatctcgacaacaattgttaaaattttatgaagaaattggcttacccagaagtttagaagatttaggtttatctcaagtaactttagaagaattacgtcaggcggccatagtcacttgtcatcctaattctgatattcatcgtttaccgtttaaggtatccccagaacaattattatcggcaatggtatctactgtaggggcataa

SEQ ID NO: 331 - protein, 373 aa, Crocosphaera watsonii WH 8501
MPTKTTKITPVTTKLNSLFVSPTQVIQGEGIISQAGKGISRLGKRPLLVGGKQTLELISAHLKPIFKQFKLTAAFDSYAPDCSETSLKNLTEATQNHQADLIIGVGGGKALDTAKLLAYQQQLPIVTIPTSGATCAAWTALSNVYSNQGAFQYDVPLSRCPDLLILDYNLIKAAPKRTLVAGIGDAIAKWYEASVSSGQSEATLTIAAVQQARVLRDILLQKSVKALDKIGGEDWREVVNATVLLAGVIGGLGGANCRTVAAHAVHNGLTHIPAAHHALHGEKVAYGILVQLRLEEMIQGNKLAATSRQQLLKFYEEIGLPRSLEDLGLSQVTLEELRQAAIVTCHPNSDIHRLPFKVSPEQLLSAMVSTVGA

SEQ ID NO: 332 - DNA, 1026 bp, Exiguobacterium sibiricum 255-15
  CDS (1)..(1026): transl_table=11
atgattcgtcaagccgttttacaatacatacacgaagaacaagccgtcgatcggctttcagaattgttacgggggagaaaagcggtgctgattcacggtgaacaggcattaaaatcgtccgaacagtatttgccggaattgccgaagctgctgttttccggacattgtacagatcagcaggtaatagagcttacagaacaatgtgccgcgtacgaaatgatcatcgctcttggcggcgggtccgtcattgatacggccaaacaagtggccgtcaaacgaaattacccgttgattgtcattccgacgatcgtctcgaactgtgccccgtggacaccccttagtgtcatgtatgatgaacggggtcggtaccttcgttttgacacgattcctgtcgtcattgaagcattattgctcgactatcggattttagcagccagtccatatgattattttgttgccggactggtcgatacattagcgaaatggtacgaagcccgggcgctgagcggatcgacttctgaccatcctgtcgtcgaatcggccttacggatggcagaacactgtaaacgattaattttgcagacaccgatcagtccaaaacaatttcaggagtattcgtccccgattcaacatctggtggagacggtcattccgcttgccggaagtgtcggtggattcggtgacgaagcaacacgtggggcgattggtcacggtgttcataatgcgttatctccgttcccgtcgacgaaccggattttacacggaagtaaagtcggttacggcttattgattcaagagttgttgttagatgaaacggtgttctataacgagttgctacagtatttgatggaaaacaaacaaccgacgacgagtacagcgcttggattgacggaagcggagcgagccgacttggcgcaacgaattggtcgagaaccactctgtcaattgattgagacggattggtcgaaagcgaccgttctttcgactttaatgaaaaatgaccgggaagccgttctcataccttga

SEQ ID NO: 333 - protein, 341 aa, Exiguobacterium sibiricum 255-15
MIRQAVLQYIHEEQAVDRLSELLRGRKAVLIHGEQALKSSEQYLPELPKLLFSGHCTDQQVIELTEQCAAYEMIIALGGGSVIDTAKQVAVKRNYPLIVIPTIVSNCAPWTPLSVMYDERGRYLRFDTIPVVIEALLLDYRILAASPYDYFVAGLVDTLAKWYEARALSGSTSDHPVVESALRMAEHCKRLILQTPISPKQFQEYSSPIQHLVETVIPLAGSVGGFGDEATRGAIGHGVHNALSPFPSTNRILHGSKVGYGLLIQELLLDETVFYNELLQYLMENKQPTTSTALGLTEAERADLAQRIGREPLCQLIETDWSKATVLSTLMKNDREAVLIP

SEQ ID NO: 334 - DNA, 1110 bp, Exiguobacterium sibiricum 255-15
  CDS (1)..(1110): transl_table=11
atgtcagaacgtgttttcattagtccggcgaagtatgtccaagggaaaaatgtcattgatcggctcggtacatatgtgagtccgattggagacgtggccctagtgatcgccgatgatgtcgtttggaaaatcgtcgaggaacgtgtccatgcttcattttcagcagaaggaatcaaaattgaaaaagcagatttcagcggtgaagcctcaaaacatgaagtcgaacggattgccgcacaagccaaggatgccggcgtgaaattcgtcatgggggtcgggggcgggaagacgcttgatacggcaaaagccgtttcggacgagttccatctgccggtcgtcatcgtaccgacgatcgcttcgaccgatgcgccgacaagtgcactgtccgtcatctattcggatgagggaatctttgagagttaccgtttttataacaaaaatccggatcttgtcttggtcgatacaaaattgatttctgaagcgccggcccgtttctttgcttcggggattgccgatgcactggcgacatgggtcgaggtccggagtgtcattgcctttggaggcacgacgatggccggtggacggccgacgattgcggcggaagcgattgcgaaacgctgtgaagaagtgttgttcgagcacggacgtctcgcctatgagtcggttcaagcaaaggtcgtcacaccggcgcttgaagctgtcgttgaagccaatacgttgttgagtggtcttgggtttgaaagcggtggactggcggcagcacatgccatccataacggattcacggcgcttgaaggagacattcaccatttgacacacggggaaaaagtcgcgttcgggacgctcgtccagttggcgctcgaagaacacccgcaggaagaaatcgaacggtacatttcgttctatatggatcttggactgccggtcacactggaagacgtcaaactaaaagatgcttcacgcgaagacatcttaaaggtcggtcacgcagcgacggcagaaggggagacaattcacagcggctttgatgtaacggcggatgaagtggcggatgccatcattgccgctgaccgctattcaaaagcttatcaggcgaaattgaagaactga

SEQ ID NO: 335 - protein, 369 aa, Exiguobacterium sibiricum 255-15
MSERVFISPAKYVQGKNVIDRLGTYVSPIGDVALVIADDVVWKIVEERVHASFSAEGIKIEKADFSGEASKHEVERIAAQAKDAGVKFVMGVGGGKTLDTAKAVSDEFHLPVVIVPTIASTDAPTSALSVIYSDEGIFESYRFYNKNPDLVLVDTKLISEAPARFFASGIADALATWVEVRSVIAFGGTTMAGGRPTIAAEAIAKRCEEVLFEHGRLAYESVQAKVVTPALEAVVEANTLLSGLGFESGGLAAAHAIHNGFTALEGDIHHLTHGEKVAFGTLVQLALEEHPQEEIERYISFYMDLGLPVTLEDVKLKDASREDILKVGHAATAEGETIHSGFDVTADEVADAIIAADRYSKAYQAKLKN

SEQ ID NO: 336 - DNA, 1146 bp, Synechococcus sp. RS9917
  CDS (1)..(1146): transl_table=11
atggcaagccaatccgctgcatcgctgcccctggccagccatgcgattgccccggccacggtcctccgtggtccaggggcctggtcggatgcgctgccacgcatccaggtcctcagccagcgccccgttctgctcgggcgcagtggtgccaccgctgcaacccgtcaacgcctggccagtgacctcacggccgccgggcttcaggtgaccctggagacgctggagcacgactgctgcgatcccgacctggaacgcctggaggcgcgcctcagggccgaagccgtggatggcttgatcgccgccggcggcggcaaggtgctggatgcgggcaagtggttggccgatcgattgcagcttccctgcatcaccgtgcccctcagtgccgccacctgcgccggctggacagctctggcaaacatctataccccggagggggccttcctgcgcgatcaggccctcacccgttgccccgatctcctcgtgtttgatcaccacttggtgcggcaggcgccagcccgcaccctcgcgagtggtgtcgccgatgccctggcgaagtggtacgaggcctccgtgagcagcggctccagtcaggacggactgattcaacaggcggtgcagatggcccgcgtgctacgcgaccagttgctgatcgatgcccgtgaagcctgccgtgatccccagagcgatgcctggatccgcgtcgccgaagccagcgccctcaccgcaggggtgatcggggggctggggggggcccagtgccgcaccgtcgccgcccacgccgtgcacaacggcctcacccagctgcaggcctgccacaacagcctgcatggcgagaaggtgggattcggaattctggtgcaactgcggctggaggagaagctcggcggcaaccggctggcacaccaggcccgccgccagctcctgccgctgctcagggatctcggccttcccgtcagcctcgctgatctcggcctcggccaggtggggctgcatgagttgcgccaggcctgccgcttcgcctgtcgccccaactccgatctgcaccatctgcccttcccggtgagcgacaccgatctgctcgaagcgctgatcagcgccgaggccttgccggaaccctccgagaccagccggaggcgcggcgcttga

SEQ ID NO: 337 - protein, 381 aa, Synechococcus sp. RS9917
MASQSAASLPLASHAIAPATVLRGPGAWSDALPRIQVLSQRPVLLGRSGATAATRQRLASDLTAAGLQVTLETLEHDCCDPDLERLEARLRAEAVDGLIAAGGGKVLDAGKWLADRLQLPCITVPLSAATCAGWTALANIYTPEGAFLRDQALTRCPDLLVFDHHLVRQAPARTLASGVADALAKWYEASVSSGSSQDGLIQQAVQMARVLRDQLLIDAREACRDPQSDAWIRVAEASALTAGVIGGLGGAQCRTVAAHAVHNGLTQLQACHNSLHGEKVGFGILVQLRLEEKLGGNRLAHQARRQLLPLLRDLGLPVSLADLGLGQVGLHELRQACRFACRPNSDLHHLPFPVSDTDLLEALISAEALPEPSETSRRRGA

SEQ ID NO: 338 - DNA, 1188 bp, Synechococcus sp. WH 5701
  CDS (1)..(1188): transl_table=11
gtgccagcgtctgacgcctcgatggtgacagccctcagtcagcatgcgatcgcccccgcccgactggtgcgggggccttcggcatggtcggcttcgctcgacgccctgccctccctctgccgccgcccgctgctgctgggccgcagccaggccaccgcacatctgcgcgatcaggcctgctccgatctgctgcggttgggcctggagcccctgtccgccacccttcagttcgactgctgcgaggacgacctccggcgcctggcggcagaagcccagaccggccgctgcgacggggtgatcgccatgggaggcggcaaggtgctggacgcaggcaagctgctggcccatcgcctcggtctggcctgcatcaccgtgcccaccagcgccgccacctgcgccggatggaccgccctggccaatctctattccgtcgaaggggccttccgctccgatgtggcgctggatcgctgccccgacctgctgatcttcgatcacaatctggtcctgcaggctcccacgcgcaccctggccagcgggatcgccgatgccattgccaagtggtatgaggcctcggtgagcagtggctcgagcggcgatggtctggtgcaacaggcggtgcagcaggcccgtgtcctgcgcgatcagttgctgctggagggtgaggcagccatggccgagcccggtggcgaagcctgggtacgggtggcggaggcctccgcgctcacggccggactgatcggcggtctcggtggcgcccgctgccgcaccgtggctgcccacgcggtccacaacggtctcacccagttgcccgcctgtcatcaccttcttcacggtgaaaaggtgggcttcggcgttctcacccagctgcgtcttgaagagttgctcggtggccaccgcctggccagccaggcccgccgccagctgatccccttcttcagggccctggatctgccgctgaccctcgagggtctcggcctcgccgaagccagcctcaacgacctcaacgccgtctgcgccttcgctgttcttcccggctctgatctgcaccatctgcccttccccgtgaacgccaacgacctgctgaccgccatggtgagcaccacggcggagtcgcacccagctgagagtgctccaagtgctccagccccctgcgccgagggcagcctctgccctgagagcagcccttga

SEQ ID NO: 339 - protein, 395 aa, Synechococcus sp. WH 5701
MPASDASMVTALSQHAIAPARLVRGPSAWSASLDALPSLCRRPLLLGRSQATAHLRDQACSDLLRLGLEPLSATLQFDCCEDDLRRLAAEAQTGRCDGVIAMGGGKVLDAGKLLAHRLGLACITVPTSAATCAGWTALANLYSVEGAFRSDVALDRCPDLLIFDHNLVLQAPTRTLASGIADAIAKWYEASVSSGSSGDGLVQQAVQQARVLRDQLLLEGEAAMAEPGGEAWVRVAEASALTAGLIGGLGGARCRTVAAHAVHNGLTQLPACHHLLHGEKVGFGVLTQLRLEELLGGHRLASQARRQLIPFFRALDLPLTLEGLGLAEASLNDLNAVCAFAVLPGSDLHHLPFPVNANDLLTAMVSTTAESHPAESAPSAPAPCAEGSLCPESSP

SEQ ID NO: 340 - DNA, 1122 bp, Synechococcus sp. WH 7805
  CDS (1)..(1122): transl_table=11
atgtcctcaacagacagcaactgtttgatctctcaacactgcattgcaccggacctcgtgattcgcggctccggtgcatggcaaagcgctctgaccaagatccgtgcgctcagctccagaccactgttcttgggtcgaagcgcagcaacccaaccactgcgcaacggactgattaccagcctggtatccgcaggccttgacgtcacgcctgcatgcctgaatcacgactgctgcgaagaggatttaagtcgtctcgaagcggctttcacagttcaccgcggtgatgccgtcattgccgcaggcgggggcaaggtgttggatgctggcaagctcttggccgatcgtcttgatctgccgtgcatcacagtgccactgagtgcgtcaacttgtgccggctggaccgcgctttccaatctgtacacccctgaaggagcctttcttggcgatcaggccttgaaacgctgtcctgatcttctggtgttcgaccacgatcttcttcgccaggcaccaccccgcactctcgccagtggcatcgctgatgcccttgccaagtggtatgaagcctcagtgagcagcggcgccagccacgatggactgattcagcaagctgtccagatggcgcgggtgctgcgggatcagctcttgattgacagtgtggatgccatgcagtcccccgggggagacgcctgggtgcgagtgattgaagcctgcgggctgacagccggcctcatcggaggactagggggagctcgctgccgcacggttgcagcccatgctgttcataacgggctcacccaactccaggcttgtcacggatccctccacggcgaaaaagtgggcttcggagtgttggttcagttgcgactcgaagaacgtttgggtggcaatcgcttggcagaacaagcccatcgccaattgttacccctgctcatccaactcggactaccggtgagcctcgacgatctcggtctttccaatgccagtttgagtgaccttcaacaggtgtgcgagtttgcctgccgtgaaggatccgaccttcaccatcttcccttctccgtgacgcctggagcgcttctggaagctcttgtgggagcagccgaacccgccgttcgacgcccttga

SEQ ID NO: 341 - protein, 373 aa, Synechococcus sp. WH 7805
MSSTDSNCLISQHCIAPDLVIRGSGAWQSALTKIRALSSRPLFLGRSAATQPLRNGLITSLVSAGLDVTPACLNHDCCEEDLSRLEAAFTVHRGDAVIAAGGGKVLDAGKLLADRLDLPCITVPLSASTCAGWTALSNLYTPEGAFLGDQALKRCPDLLVFDHDLLRQAPPRTLASGIADALAKWYEASVSSGASHDGLIQQAVQMARVLRDQLLIDSVDAMQSPGGDAWVRVIEACGLTAGLIGGLGGARCRTVAAHAVHNGLTQLQACHGSLHGEKVGFGVLVQLRLEERLGGNRLAEQAHRQLLPLLIQLGLPVSLDDLGLSNASLSDLQQVCEFACREGSDLHHLPFSVTPGALLEALVGAAEPAVRRP

SEQ ID NO: 342 - DNA, 1098 bp, Photobacterium sp. SKA34
  CDS (1)..(1098): transl_table=11
atgatccctcgcagcatcacatcgccaaaaaaattcattattggtcaagatttactttctcaacttgatgcttttataaaagactttggcaataatgccttattgatttgtgatgatttcattttagatcgcgttcaacaagaagcggtgccttgtttagaactcgcggggatcaagacatattgcgagaaattccagtatgaatgtagtgataacgaaattgaacgtttacgtaagatagtaacagcacaaaatgcaaatgttgttgttggtattggtggtggtaaaaccatggatgtggcaaaggctgttgcgcattatagcaatgcatctgtggtgatcttcccaacaattgcgtcaagtgatgcaccttgtaccgcggtatctgttatctataaagagagcggtgaatttgatcgttacttgttattaccgcaaaaccctgatgtggtattagcagatactcgtattattgctcaagccccggaaaaatattttgccgcaggcattggtgatgcgctagcgaccttttttgaaacgcgtgcttgttgttatgccgcaggacttaatctggtacaaaaacgtgtgtcacgtaccggacttggtatggctcttatgtgttatgagctgattgtcgataatgttgaaatggcgatggaagccgtccgtcgtcaggaagttacaccggcattagaagagatggtagaagccattgtgtatttaagtggtgtggcggcagaatctggcggcattgcgtgtgcacatgcgatctgtaatggcatgtcgtcacttgagaaatttaaacatattcaacatggtgaaaaagtaacatttggcttattagtacaattggtattagaaaaagccgatattgaagaaatcgagaatgttatttacgtgatcaaaatggcagggttaccactgacattagctgattttggtattaatgaatgggttgaagatgattggcgtcagattgttgatattgcctgttctccaagtaattcaatgagtaatatgcctgttactgtgagtgcggagcaagtgtaccaagcggttattgcagccaatgaattagcacaacgttatcacgattaa

SEQ ID NO: 343 - protein, 365 aa, Photobacterium sp. SKA34
MIPRSITSPKKFIIGQDLLSQLDAFIKDFGNNALLICDDFILDRVQQEAVPCLELAGIKTYCEKFQYECSDNEIERLRKIVTAQNANVVVGIGGGKTMDVAKAVAHYSNASVVIFPTIASSDAPCTAVSVIYKESGEFDRYLLLPQNPDVVLADTRIIAQAPEKYFAAGIGDALATFFETRACCYAAGLNLVQKRVSRTGLGMALMCYELIVDNVEMAMEAVRRQEVTPALEEMVEAIVYLSGVAAESGGIACAHAICNGMSSLEKFKHIQHGEKVTFGLLVQLVLEKADIEEIENVIYVIKMAGLPLTLADFGINEWVEDDWRQIVDIACSPSNSMSNMPVTVSAEQVYQAVIAANELAQRYHD

SEQ ID NO: 344 - DNA, 1089 bp, Xanthobacter autotrophicus Py2
  CDS (1)..(1089): transl_table=11
atgcgcgaactcaaggtgttcggcgcccccggcctctatgtgcagggccccggcgcgctgcgcgaactcggccgcctcattgccccggtgggctcccgcgctttgctggtgtcggaccgcatcatgagcggcatgctcgcgccgcgcatcgccccgctgctggaggcggagggcatcgccttcgccgccaccggcttcgacggcgatgtcacccacgccaatgtcgatcggatggtggcggacggcacgccgctggcgccggacgtggtcatcgctgccggcggcggcaagggcatggatgcgggcaaggcggtgtgccgcgccttcggcgcccggctggtgagcctgcccaccgccgcctccaacgacggccccaccagccgcaacttcgtgttctatgacgaccatcacaagctgctctcggtggagaagctggtccgcaatccggacctggtgctggtggataccgacctcatcatcaaggcgccggccgccctgctggtctctggcatcggcgatgcgctggtgaagcgctttgaggccgagcaggcggtgggcgccgatggccccaacatgttcggagcacgggcgacgctcgcctccctcaccctcgcgcagcgctgcgacgaggtgctgcgggcggacgccgtggcggccctcgccgccgtgcgctcaaaccggccgggaccggaattcgagcgggtgatcgaggcctgcttcctgctggccggcctcggcttcgaggggtcgggcctgtccatcgcccacgccatgacgcgcggcctctccgcgatcccggccacggcggcgaccctgcacggctgccaggtcgcctatgccctgctggtgcagctcatgctggagcgccggccgcccgaattcatggccgagcagttcgccttctaccggtcggtgggcctacccgtcagcctgcgcgacctcgggctggcatccgccgcccgtgccgacctggaggtgatcgccgagctgagccaccgggcgccgcacacgaagaacttcgagcgcgccctcacccccgccgacttcgtggatgcgatggagcagctggaggccattggtcttatgtga

SEQ ID NO: 345 - protein, 362 aa, Xanthobacter autotrophicus Py2
MRELKVFGAPGLYVQGPGALRELGRLIAPVGSRALLVSDRIMSGMLAPRIAPLLEAEGIAFAATGFDGDVTHANVDRMVADGTPLAPDVVIAAGGGKGMDAGKAVCRAFGARLVSLPTAASNDGPTSRNFVFYDDHHKLLSVEKLVRNPDLVLVDTDLIIKAPAALLVSGIGDALVKRFEAEQAVGADGPNMFGARATLASLTLAQRCDEVLRADAVAALAAVRSNRPGPEFERVIEACFLLAGLGFEGSGLSIAHAMTRGLSAIPATAATLHGCQVAYALLVQLMLERRPPEFMAEQFAFYRSVGLPVSLRDLGLASAARADLEVIAELSHRAPHTKNFERALTPADFVDAMEQLEAIGLM

SEQ ID NO: 346 - DNA, 1146 bp, Xanthobacter autotrophicus Py2
  CDS (1)..(1146): transl_table=11
atgaaggtgttcggcgcgccgcggcgctatgtgcagggcaagggggcgctggatcatctgggtcccgagctggcgcgcctcaccgacgccgctgcgctggtcatagaccccttcatcgacgatctgttcggcgcccgccttcaggcctcgtgcaacgcggcgggggtgagccttgcccgcctgcgcttcggcggggaaagctcacccgcggagatcgaccgcctgcttgcagcgctgggcgacaccccgcccccgctggtcgcggcggcgggcggcggcaagtgcatcgacgcgggcaaggcgctcgccaaccgcatcggcgcgaaggtggcgaccatccccaccattgcctccaccgacgcgcccaccagccacaattacgtgctctatgacgacgaccaccgcctgctcgcggtggagaagctgccggccaatccggacctggtgctggtggatacccaggtgatcgccgaggcgccgcgccttctgttcctcgccggcatcggcgatgcggtggtgaagctgttcgaggtggagcgctgcgtggcggcgaagggccgcaacgtgttcggcgccgatcccgccttctccgccctgatcctcgcccgcggctgctacgacgtgctgcgccgccacgccccggcggcgctcgccgccgtggaccgcaaggcggccgacgacgcccttgacctggtggtggaagcaaccgtgctcatgagcggcctcagcttcgagagcggcggcctgtccatcgcccattccatgacgcggggcctctccgccgtgccgaaatatgcccgcgcgctgcacgggctggaggtcgcctacggcgtgctggtgcaattggtgctggagggccgtgacgcggacttcttcgacgatctcctcggcttctacgccgccatcggcctgcccacgagtcttgtcgccctcgccggtgcggcccccacgcccgaggaagcggccaccatcgcccgcctcaccctctcggcgccccacgcccggcatttcccccgggtgctggaagaggcggaggtggtgcgcgccatcctcgccatcgaggaggggcggttcgcggacgcgcttgtggaggatgcaatgcaggggagcaaatcccccagcaccgcacccgggctggccgtgtga

SEQ ID NO: 347 - protein, 381 aa, Xanthobacter autotrophicus Py2
MKVFGAPRRYVQGKGALDHLGPELARLTDAAALVIDPFIDDLFGARLQASCNAAGVSLARLRFGGESSPAEIDRLLAALGDTPPPLVAAAGGGKCIDAGKALANRIGAKVATIPTIASTDAPTSHNYVLYDDDHRLLAVEKLPANPDLVLVDTQVIAEAPRLLFLAGIGDAVVKLFEVERCVAAKGRNVFGADPAFSALILARGCYDVLRRHAPAALAAVDRKAADDALDLVVEATVLMSGLSFESGGLSIAHSMTRGLSAVPKYARALHGLEVAYGVLVQLVLEGRDADFFDDLLGFYAAIGLPTSLVALAGAAPTPEEAATIARLTLSAPHARHFPRVLEEAEVVRAILAIEEGRFADALVEDAMQGSKSPSTAPGLAV

SEQ ID NO: 348 - DNA, 1056 bp, Synechococcus sp. RS9916
  CDS (1)..(1056): transl_table=11
ttgaaactgatccctgcactgacccgcaggcctgcccttctgggacgcagtcaggcaacagcagatcttcgggaccagctggaatctgacttgcacaccgtcggagtggattcagttcaggtcgagctcgaatacgactgttgcgagcacgatctccagcgactgcaggacacgttgaacagccatggctgtgacggggtgattgctgccggcggtggcaaggtgctggatgcgggcaagctgctagccgatcgtctccagctcaattgcatcaccgtgcctctcagcgcagccacctgcgcgggctggacagccttgtcgaacatctattcaaccgatggagccttcgaaggagacgtcgcgctccaacggtgcccagatctgctgatctttgatcattcctttgctcgcctggcgcccgcaagaacattggccagcggcatcgccgatgccctcgccaagtggtacgaagcctccgtcagcagcggagccagcaacgacgggatcattcagcaggccgtgcagatggcacgcgtgcttcgcgaccaattgctgctggatgccaaggaggccctggagaatcccaaaagtgaagcctgggttcgcgtggctgaagcctgcggactcaccgctggtgtgatcggcggattggggggagcgcagtgccgcacggtggctgcccatgccgttcacaacgggctcacccagctaccggcctgccatcaggttttgcatggtgaaaaagtcggcttcggaatcctggtgcaacttcgccttgaagaacgtctgggtggaagccagcttgcagcgcaagcacgccgccagctcttccctctccttcacgacatgggtgtacccgtgaccctggaggacctcggtctcggtcaggcgggcttgcatgaactccggcaagcgtgtcaattcgcctgtcgagctggatcagaccttcatcaccttcccttccctgtgagtgaaacggagctccttgaagcgctcgtcagcacccagagtggagtggcagcaccaacacggcaggccaacaggagcggcagttga

SEQ ID NO: 349 - protein, 351 aa, Synechococcus sp. RS9916
MKLIPALTRRPALLGRSQATADLRDQLESDLHTVGVDSVQVELEYDCCEHDLQRLQDTLNSHGCDGVIAAGGGKVLDAGKLLADRLQLNCITVPLSAATCAGWTALSNIYSTDGAFEGDVALQRCPDLLIFDHSFARLAPARTLASGIADALAKWYEASVSSGASNDGIIQQAVQMARVLRDQLLLDAKEALENPKSEAWVRVAEACGLTAGVIGGLGGAQCRTVAAHAVHNGLTQLPACHQVLHGEKVGFGILVQLRLEERLGGSQLAAQARRQLFPLLHDMGVPVTLEDLGLGQAGLHELRQACQFACRAGSDLHHLPFPVSETELLEALVSTQSGVAAPTRQANRSGS

SEQ ID NO: 350 - DNA, 1083 bp, Vibrio sp. Ex25
  CDS (1)..(1083): transl_table=11
atggacaaaattattatcagcccaagcaaatacgtccaaggtgaacaagtacttacatctatcgctcactatgtgaaaacattgggtgaacgtccgttagtcattgccgatgagttcgtgactaacctggttggtgatgacgtcaaacaaagctttgctgacgaaaagcttccactcactatgaacatttttggtggcgaatgttcgcgcgttgagatcgaacgcatcacggacatttgtgcgactcaaaaacatgatgtcattgtcggtattggtggcggtaaaacgttagatacagcaaaggccgttgcgttttacaccaaaattcctgtcgtggtggttcctacaattgcctcgactgatgcgccaacctctgctcttgcggtgatatacacaccagaaggtgaatttgcggaatacttgatgatccctaaaaacccagacatggtcatcatggatacgtctgtcatcgcaaaagccccagttcgcctactggtatcggggatgggcgatgcgctctccacctactttgaagctcgtgccaacatgacctctggtaaggcaacaatggccggtggtttagcgacacgttcagcgcaagctcttgcaaaactttgctatgaaaccttgcttgaagatggtgtaaaagcaaaagctgcggtagaaaatggtgtgagcaccaaagcggtagaaaacattattgaagccaatacataccttagcggtatcggttttgaaagcagtggtctagcgggtgctcacgctattcataacggcctaaccaagctcgaagagtgtcatcatctctatcatggtgagaaagtcgcgttcggcacacttgttcaactggtgctagaaaacgcagcgatggaagagattaatacggttctcgccttctgccgatcggtaggtctaccaaccaacttgtttgatatgggcgttaaagagcttaatcacgataaattgcgcgaggtcgccgaagcttcaacggccgagggagaaaccatccacaatatgccattcccagtgacggcagaaaatgtctactctgctattctaaccgctcatcaactgggccaataa

SEQ ID NO: 351 - protein, 360 aa, Vibrio sp. Ex25
MDKIIISPSKYVQGEQVLTSIAHYVKTLGERPLVIADEFVTNLVGDDVKQSFADEKLPLTMNIFGGECSRVEIERITDICATQKHDVIVGIGGGKTLDTAKAVAFYTKIPVVVVPTIASTDAPTSALAVIYTPEGEFAEYLMIPKNPDMVIMDTSVIAKAPVRLLVSGMGDALSTYFEARANMTSGKATMAGGLATRSAQALAKLCYETLLEDGVKAKAAVENGVSTKAVENIIEANTYLSGIGFESSGLAGAHAIHNGLTKLEECHHLYHGEKVAFGTLVQLVLENAAMEEINTVLAFCRSVGLPTNLFDMGVKELNHDKLREVAEASTAEGETIHNMPFPVTAENVYSAILTAHQLGQ

SEQ ID NO: 352 - DNA, 1098 bp, Klebsiella pneumoniae
  CDS (1)..(1098): transl_table=11
atgctaaaagttattcaatctccagccaaatatcttcagggtcctgatgctgctgtcctgttcggtcaatatgccaaaaacctggcggagagcttcttcgtcatcgctgacgacttcgtgatgaagctggcgggggagaaagtggtgaatggcctgcagagtcacgatattcgctgccatgcggaacggtttaacggcgaatgcagccatgcggaaattaaccgcctgatggcgattttgcaaaaacagggctgcggcggcgtggttggcatcggcggcggtaaaaccctcgataccgcgaaggcgatcggttactaccagaagctgccggtggtggtgatcccgtctatcgcttcgaccgatgcgccgaccagcgcgctgtcggtgatctacaccgaagcgggcgagtttgaagagtatctgatctatccgaaaaacccggatatggtggtgatggacacggcgattatcgccaaagcgccggtacgcctgctggtctccggcatgggcgatgcgctctccacctggtttgaggccaaagcctgctacgatgcgcgcgccaccagcatggccggggggcagtccaccgaggcggcgctgagcctggcccgcctgtgctatgatacgctgctggcggagggcgaaaaggcccgtctggcggcgcaggccggggtggtgaccgaagcgctggagcgcatcatcgaagcgaacacctacctcagcggcattggctttgaaagcagcggcctggccgccgcccacgcgatccacaacggtttcaccattctggaagagtgccatcacctgtatcacggcgagaaagtggccttcggcaccctggcgcagctggtgctgcagaacagcccgatggacgagattgaaaccgtgctgggcttctgccagcgcgtcggcctgccggtgaccctcgcgcagatgggcgtcaaagaggggatcgacgcgaaaatcgccgcggtggcgaaagccacctgcgcggaaggggaaaccatccacaatatgccgtttgcggtgaccccggagagcgtgcacgccgctatcctcaccgccgatctgttaggccagcagtggctggcgcgttaa

SEQ ID NO: 353 - protein, 365 aa, Klebsiella pneumoniae
MLKVIQSPAKYLQGPDAAVLFGQYAKNLAESFFVIADDFVMKLAGEKVVNGLQSHDIRCHAERFNGECSHAEINRLMAILQKQGCGGVVGIGGGKTLDTAKAIGYYQKLPVVVIPSIASTDAPTSALSVIYTEAGEFEEYLIYPKNPDMVVMDTAIIAKAPVRLLVSGMGDALSTWFEAKACYDARATSMAGGQSTEAALSLARLCYDTLLAEGEKARLAAQAGVVTEALERIIEANTYLSGIGFESSGLAAAHAIHNGFTILEECHHLYHGEKVAFGTLAQLVLQNSPMDEIETVLGFCQRVGLPVTLAQMGVKEGIDAKIAAVAKATCAEGETIHNMPFAVTPESVHAAILTADLLGQQWLAR

SEQ ID NO: 354 - DNA, 1098 bp, Escherichia blattae
  CDS (1)..(1098): transl_table=11
atgctacaagttattcagtctccggcaaaatatcttcagggccctgatgctgcggcccagtttggtcagtatgccaaaaacctggcggacagcttttttgtgattgccgatgatttcgtgatgaaactggccggtgacaaggtgctgaacggcctgcatgagaacggggtaacctgccacgccgagcgctttaacggcgaatgcagccatgcagagatcaaccgcctgggggcgattctcaaacaaaaaggctgcaaaggggttgtcggggttggcggcgggaaaaccctcgataccgctaaagccattggctactaccagaagctgccggtggtgatcattccgaccatcgcctctaccgatgcgcccaccagcgccctgtctgttatctataccgaatccggcgagtttgaagagtatctggtctacccgaaaaaccccgatatggtggtgatggatacggcgattatcgccaaagcgccggtgcgtttactggtttccggcatgggggatgcgctctccacctggtttgaggcgaaagcctgctacgacgcccgcgctgtcagcatggccggtggtcagtctaccgccgctgccctgagcctggcccgcctgtgctacgacacgctgctggccgaaggggaaaaagcccgcctggccgctgaggcaggcgttgtgaccgtggcgctggagcgcattgtggaagccaacacctacctgagcggtattggttttgaaagcagcggcctggccggtgcccacgccatccataacggctttaccattctggaagagtgccaccacctctaccacggggagaaagtggccttcggtacgctggcacaactggtgctgcaaaacagcccgatggaagagattgaaaccgtgctcggtttctgccagaaagtgggcctgccggtgaccctggcccagatgggtgtcaaagacggtattgaagagaaaattcttgctgtggcaaaagccacttgcgccgaaggggaaaccatccacaatatgccgttcccggtaacaccggaaagtgtatatggcgccattctgaccgctgatcgcctcggcgcccagtgggcggcgaagtaa

SEQ ID NO: 355 - protein, 365 aa, Escherichia blattae
MLQVIQSPAKYLQGPDAAAQFGQYAKNLADSFFVIADDFVMKLAGDKVLNGLHENGVTCHAERFNGECSHAEINRLGAILKQKGCKGVVGVGGGKTLDTAKAIGYYQKLPVVIIPTIASTDAPTSALSVIYTESGEFEEYLVYPKNPDMVVMDTAIIAKAPVRLLVSGMGDALSTWFEAKACYDARAVSMAGGQSTAAALSLARLCYDTLLAEGEKARLAAEAGVVTVALERIVEANTYLSGIGFESSGLAGAHAIHNGFTILEECHHLYHGEKVAFGTLAQLVLQNSPMEEIETVLGFCQKVGLPVTLAQMGVKDGIEEKILAVAKATCAEGETIHNMPFPVTPESVYGAILTADRLGAQWAAK

SEQ ID NO: 356 - DNA, 1083 bp, Escherichia coli
  CDS (1)..(1083): transl_table=11
atggataagattattataagtccggctaaatatatccagggaaatggttctctggataatattgctacatatgcggcgagtttgggaacagaaccattaattattgcagatgaatttgtgaccggtctggttggtgacagagtaagccagagctttgcaagagaaaacattattgcggattttgatgttttttgcggtgaatgctcgcaaaatgaaatttctcgaattcgtaagaaatttaatcagcgtaaatataatgtcgttattggtattggcggcggtaaaacgttggatacggcaaaagccgtagcgtattaccaaaaaattccggtagtggtggtgccgacaattgcttccacagatgcgccaaccagttctctggcagtaatttacaccccggaaggccagtttagcgaatatctgtttttcccgaaaaacccggatatggtgattatggatactggcgtcatttcagccgcgccagtgcgtctgctggtggccggtatgggagatgcattgtcaacctggtttgaggcgagagccaatcaggcgtcaggaaaagccacaatggcaggtggggcgtcgacactggcggcactggctattgcccgactctgttataccacgctactggaagatggctataaggcaaaagtcgcggttgaacaaggtgttagcaccaaagcggtagagaatattatcgaagctaatacctatcttagcggcattggatttgaaagtagcggcctggcggcagctcatgccattcataacggcatgacgcaactggaggaatgccatcattgctaccacggtgaaaaagtggcatttggcgtcctggtacagctcgtactggaaaacgcaccacaggaggaaattgaaaccgtactcaatttctgccatagcgttggcttgccgacaaatcttcatatgttaggcgtgaaggaaattaataaagataaattacgggcagtggctaaagccgcgactgctgaaggggaaactatccataatatgccattcgtagtaacagcgcaggacgttctttgtgcaattttaactgcacatcatttgggactttaa

SEQ ID NO: 357 - protein, 360 aa, Escherichia coli
MDKIIISPAKYIQGNGSLDNIATYAASLGTEPLIIADEFVTGLVGDRVSQSFARENIIADFDVFCGECSQNEISRIRKKFNQRKYNVVIGIGGGKTLDTAKAVAYYQKIPVVVVPTIASTDAPTSSLAVIYTPEGQFSEYLFFPKNPDMVIMDTGVISAAPVRLLVAGMGDALSTWFEARANQASGKATMAGGASTLAALAIARLCYTTLLEDGYKAKVAVEQGVSTKAVENIIEANTYLSGIGFESSGLAAAHAIHNGMTQLEECHHCYHGEKVAFGVLVQLVLENAPQEEIETVLNFCHSVGLPTNLHMLGVKEINKDKLRAVAKAATAEGETIHNMPFVVTAQDVLCAILTAHHLGL

SEQ ID NO: 358 - DNA, 1143 bp, Clostridium butyricum
  CDS (1)..(1143): transl_table=11
atgagaaaagcatttatttgcccaactaaatatgtacaaggcgaagatgatattttaaacttgggatactttgttagaagttttggagaatcagctttattaatagcacacaaagatgatgttacacgtgtaaaggacaaattaaataaaacttgtgaaaagtttaaaattagttttgtagaaagtggatttaagggtgaatgttctagagaagaggtatgtagattacaacaaattgctagtgaaaataaatgttcatgcataattggtcttggtgggggtaaggctattgatactgctaaatgtgttgctgaaggagaagctttaattatagttccaacaatagcggctacagatgcaccaacaagccattcagctgtactttatacaaatgaaggcgcatttgatgattatgcttatttcaaacaaagtccaagtgtagttttaattgatactacagtaattgcaaatgcaccaactcgtttcttggtttcaggaatgggagatgcactatcaacatactttgaagcaagagcaacttcaaattcatattctaatgtaaatgcaggattaccttgtggatttagagaaggtgtttgcaatgaagctaaaggaactaatacagcattagctcttgcaaaattatgctatgaaactcttataaatgatggagcaaaggcaaaagtggcttcagactgcaatatagttacaccagcattagaaaatattatagaagcaaatattcttttatctggtattggatttgaaagtggtggactagctggagcacatgcaattcatgatggattgactatattagaaggaactcataaatatttccatggtgaaaaagttgcatttggaacaatagcacaattagtattagaaaattcaccaaaagaagaattaaatcaagtattagacttctgtttagaagttggattacctgtttgtttagcagatattggagtggagagtattaatgaaaatgaacttatggaagtagctaaaaaagcatgttataaggaagaatcgattcattctatgcctttcccaataagcgctgaagatgtagctgcatcaattattgcagctgataagataggtagagagtacaagctaaaaaaaggagggtgcaaataa

SEQ ID NO: 359 - protein, 380 aa, Clostridium butyricum
MRKAFICPTKYVQGEDDILNLGYFVRSFGESALLIAHKDDVTRVKDKLNKTCEKFKISFVESGFKGECSREEVCRLQQIASENKCSCIIGLGGGKAIDTAKCVAEGEALIIVPTIAATDAPTSHSAVLYTNEGAFDDYAYFKQSPSVVLIDTTVIANAPTRFLVSGMGDALSTYFEARATSNSYSNVNAGLPCGFREGVCNEAKGTNTALALAKLCYETLINDGAKAKVASDCNIVTPALENIIEANILLSGIGFESGGLAGAHAIHDGLTILEGTHKYFHGEKVAFGTIAQLVLENSPKEELNQVLDFCLEVGLPVCLADIGVESINENELMEVAKKACYKEESIHSMPFPISAEDVAASIIAADKIGREYKLKKGGCK

SEQ ID NO: 360 - DNA, 1059 bp, Clostridium beijerinckii
  CDS (1)..(1059): transl_table=11
atgattgcaccaagtaaatacattcaaggtaatggagaattaaaaaatattgcggaatacgtatctgtacttggtgaaaaagcattatgcttgattagtgaaagtggcttaaaaagggtaaaagatactatagacaaaagttttgagactaaaaatataggcgtaaaatatgatttatttaacggagaatgctctataactgaagtaaatcgtattatcaaaatttgtgatgaaaatcaattaactgttctcattggtattggcggtggaaaaattattgatactattaaagctgttggatactatgcaaatcttcctgttgtgattgtacctaccatagctgctacagatgctccatgcagtgctttgtcagttttatacactgatgatggcgtctttgataaatacttattcttaaagcaaaatcctaatatagttttggttgatactggtattattgcaaaagctccagttcgtcttttagtatctggtatgggtgatgccttagcgacatattttgaagcaagagcttgtgaaaaatccaatgctggaacatgtagcatttttggtactactactattacagctcaagcattagctagactatgctatgatacattaattactgaaggatataaggcaaaacttgctgtagaagaaggagtttgtacaaaatcagtagaaaaaatagttgaagctaatactcttcttagtggtcttggatttgaaagcggtggtattgcagcgcgtcacgctatccataatggtttaactgtattgccagcttgtcatcatatgtaccatggagaaaaagttgcatttggtacattagctcaattagttcttgaaaatgctccaatggatgaaattgaagaagtattagatttcagtactagagtcggtcttcctgttactttaaaacaattaggtatcaatgaaataaagccagaagaaattattgaagttgcaaaggctgctacttcaaaagaagatactgcacataatatgccatttgaagttacccctgaagatgtctgcgactgctattttaacagctaa

SEQ ID NO: 361 - protein, 352 aa, Clostridium beijerinckii
MIAPSKYIQGNGELKNIAEYVSVLGEKALCLISESGLKRVKDTIDKSFETKNIGVKYDLFNGECSITEVNRIIKICDENQLTVLIGIGGGKIIDTIKAVGYYANLPVVIVPTIAATDAPCSALSVLYTDDGVFDKYLFLKQNPNIVLVDTGIIAKAPVRLLVSGMGDALATYFEARACEKSNAGTCSIFGTTTITAQALARLCYDTLITEGYKAKLAVEEGVCTKSVEKIVEANTLLSGLGFESGGIAARHAIHNGLTVLPACHHMYHGEKVAFGTLAQLVLENAPMDEIEEVLDFSTRVGLPVTLKQLGINEIKPEEIIEVAKAATSKEDTAHNMPFEVTPEDVCDCYFNS

SEQ ID NO: 362 - DNA, 1113 bp, Bacillus stearothermophilus
  CDS (1)..(1113): transl_table=11
atggcggcagaaagagtatttatcagccctgcaaaatatgttcaaggtaaaaatgtcattacaaaaatcgcgaattatcttgaaggaattggaaacaagacagtcgtgatagctgatgaaatagtttggaaaatagctgggcatacaatagtaaacgaattaaaaaaaggaaatattgcagccgaagaagtagtttttagcggagaagcttcaagaaacgaggtagaaagaatcgcgaatattgcaagaaaagcagaagctgctattgtaatcggcgttggtggaggaaaaacgttagataccgcaaaagcggtagcggatgaattagatgcttatatagtgattgtgccgacagctgcttcaactgatgcgccaactagtgctctttctgttatatattctgatgacggcgtatttgaaagctaccgtttttataaaaagaatccagatcttgtacttgtcgatacgaaaattatcgccaatgctccgccacgtttacttgcctctggaatcgctgatgcacttgcaacttgggtggaagcacgcagtgttataaaatccggaggaaaaacgatggcgggcggtatccctacaattgcagctgaagcaattgcagaaaaatgtgaacaaactttattcaagtacgggaagcttgcctatgaatcagtaaaagcaaaagtcgtcacccctgcgttagaagcggtcgtcgaagcaaacacgctccttagcggactaggttttgaaagcggcggtttggcagcggctcatgctattcataacggatttaccgcgttagaaggcgaaatacatcatttgacacacggagagaaagtggcatttggtactcttgtccagctcgctctcgaagaacattcacaacaagaaattgaacgctatattgagctttatttgagccttgatttgccagtcacgttggaggacattaaattaaaagatgcttcacgcgaagatatactaaaagtcgctaaagcagcaaccgcagaaggggaaacaatccataatgcattcaatgtgacagctgatgatgtagcagatgcgatttttgctgctgatcaatatgcgaaagcatataaagaaaaacaccgcaaataa

SEQ ID NO: 363 - protein, 370 aa, Bacillus stearothermophilus
MAAERVFISPAKYVQGKNVITKIANYLEGIGNKTVVIADEIVWKIAGHTIVNELKKGNIAAEEVVFSGEASRNEVERIANIARKAEAAIVIGVGGGKTLDTAKAVADELDAYIVIVPTAASTDAPTSALSVIYSDDGVFESYRFYKKNPDLVLVDTKIIANAPPRLLASGIADALATWVEARSVIKSGGKTMAGGIPTIAAEAIAEKCEQTLFKYGKLAYESVKAKVVTPALEAVVEANTLLSGLGFESGGLAAAHAIHNGFTALEGEIHHLTHGEKVAFGTLVQLALEEHSQQEIERYIELYLSLDLPVTLEDIKLKDASREDILKVAKAATAEGETIHNAFNVTADDVADAIFAADQYAKAYKEKHRK

SEQ ID NO: 364 - DNA, 1098 bp, Citrobacter freundii
  CDS (1)..(1098): transl_table=11
atgctaaaagttattcaatctccagccaaatatctccagggccctgacgcttccaccttatttggtcaatacgctaaaaatctggcggacagctttttcgtgattgcggatgacttcgtgatgaagctggcgggagagaaggttctcaatggcctgcacagccacgacattagctgccacgcggaacgcttcaacggtgaatgcagccatattgaaattaatcgcctgattgccattctgaaacagcacggttgccgcggcgtggttgggattggcggcgggaaaacgttggataccgccaaagcgattggttactaccagaagctaccggtggtggtgatcccgactatcgcctctaccgatgcgccaaccagcgcgctgtccgttatctataccgaagccggtgagtttgaagagtatctgatctacccgaaaaacccggatatggtggtgatggacaccgcaatcattgccaaagcgccggtacgcctgctggtggccgggatgggcgatgcgctctcaacctggtttgaagcgaaagcctgttatgacgccagagcgaccagcatggcgggcggacagtccaccgtagcggcgctgagcctggcgcgcctatgctatgataccctgctggcggaaggcgaaaaggcacgctttgccgcgcaggctggcgtggtgactgatgcgctggagcgtattgtcgaagcgaacacttacctcagcggcatcggctttgaaagcagcggtcttgcaggggcgcatgctatccacaacggttttacgattctggaagagtgtcaccatttgtaccacggtgaaaaagtcgcctttggtacgctggcgcagctggtgctgcaaaacagcccgatggaagagatcgaaaccgtgctgaatttctgtcagaaagtaggcctgccggtaacgttagcggaaatgggcgtgaaagacgacattgacggcaagatcatggccgtggccaaagcgacctgcgcagaaggtgaaaccatccacaatatgccgttctcggtgacgcctgaaagcgtacatgccgcgatactgacggcagacctgctgggacagcagtggctggcgcgttaa

SEQ ID NO: 365 - protein, 365 aa, Citrobacter freundii
MLKVIQSPAKYLQGPDASTLFGQYAKNLADSFFVIADDFVMKLAGEKVLNGLHSHDISCHAERFNGECSHIEINRLIAILKQHGCRGVVGIGGGKTLDTAKAIGYYQKLPVVVIPTIASTDAPTSALSVIYTEAGEFEEYLIYPKNPDMVVMDTAIIAKAPVRLLVAGMGDALSTWFEAKACYDARATSMAGGQSTVAALSLARLCYDTLLAEGEKARFAAQAGVVTDALERIVEANTYLSGIGFESSGLAGAHAIHNGFTILEECHHLYHGEKVAFGTLAQLVLQNSPMEEIETVLNFCQKVGLPVTLAEMGVKDDIDGKIMAVAKATCAEGETIHNMPFSVTPESVHAAILTADLLGQQWLAR

SEQ ID NO: 366 - DNA, 1143 bp, Escherichia coli O6; identical to SEQ ID NO: 172
  CDS (40)..(1143): transl_table=11

SEQ ID NO: 367 - protein, 367 aa, Escherichia coli O6
MDRIIQSPGKYIQGADVINRLGEYLKPLAERWLVVGDKFVLGFAQSTVEKSFKDAGLVVEIAPFGGECSQNEIDRLRGIAETAQCGAILGIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENAPVEEIETVAALSHAVGLPITLAQLDIKEDVPAKMRIVAEAACAEGETIHNMPGGATPDQVYAALLVADQYGQRFLQEWE

SEQ ID NO: 368 - DNA, 1098 bp, Pseudomonas putida
  CDS (1)..(1098): transl_table=11
atggaccgcgccattcaatcacccggcaaatatgtacaaggggccgatgcgctgcaacggctgggggactacctcaagccgctggcggacagctggctggtgattgccgacaagttcgtgctgggctttgccgaagacaccatccgccaaagcctcagcaaggccgggctggccatggacatcgtcgccttcaacggcgaatgctcgcagggcgaggtcgatcgcctgtgccaactggccacgcaaaacgggcgcagcgccatcgtcggcattggtggcggcaagacgctggacaccgccaaggccgtggcctttttccagaaagtgcccgtggccgtggcccccaccatcgcctccaccgacgcgccctgcagcgcgctgtcggtgctctataccgatgaaggtgagttcgaccgctatctgatgctgcccaccaaccccgccctggtggtggtggacaccgccatcgtcgcccgtgcaccggcgcggctgttggcggccggcattggtgatgccctggccacctggttcgaggcgcgtgccgcatcgcgcagcagcgctgccaccatggccggcggcccggccacgcagaccgcactgaacctggccaggttctgctacgacaccctgctggaagagggtgaaaaagccatgttggccgtgcaggcccaggtggtgacgccggcgctggagcgcatcgtcgaggccaacacctatctgagcggggtcgggtttgaaagcggtggcgtggccgccgcccacgcggtgcacaacggcctgaccgccgtggccgaaacccaccacttctaccacggcgaaaaagtggcgtttggcgtgctggtgcaactggcgctggaaaacgcctccaacgcggaaatgcaggaagtgatgtcgctgtgccacgccgtgggcctgcccatcacgctggcgcagctggacattaccgaagacatccccaccaagatgcgcgccgtggccgagctggcctgcgccccaggcgagaccatccacaacatgcccggcggcgtgacggtggagcaggtctatggcgcgctgctggtggcggaccagctggggcagcattttctggagttttga

SEQ ID NO: 369 - protein, 365 aa, Pseudomonas putida
MDRAIQSPGKYVQGADALQRLGDYLKPLADSWLVIADKFVLGFAEDTIRQSLSKAGLAMDIVAFNGECSQGEVDRLCQLATQNGRSAIVGIGGGKTLDTAKAVAFFQKVPVAVAPTIASTDAPCSALSVLYTDEGEFDRYLMLPTNPALVVVDTAIVARAPARLLAAGIGDALATWFEARAASRSSAATMAGGPATQTALNLARFCYDTLLEEGEKAMLAVQAQVVTPALERIVEANTYLSGVGFESGGVAAAHAVHNGLTAVAETHHFYHGEKVAFGVLVQLALENASNAEMQEVMSLCHAVGLPITLAQLDITEDIPTKMRAVAELACAPGETIHNMPGGVTVEQVYGALLVADQLGQHFLEF

SEQ ID NO: 370 - DNA, 1158 bp, Synechocystis sp
  CDS (1)..(1158): transl_table=11
atggccccatcaatttcccctgtcacccaacctttggtttccatggcgatcgcccccacggtggtgattcgtagtgctttggctaaagcgggggaacatttgcaaaaattggggagtaagggcctagtggtaacgggtagccactctgctgagttgggggaaaagtctttacaaacattgcagaaaaattatggtctgaccctgcctctggccagctatttacctgactgcgccgagtcttccctcgaacagttgcggcgacgggttcaccaggaacagccagattttatcctaggtattgggggaggcaaagccctagatacggctaagttattggcccatcaaacccaattggcgatcgccacagtacctacctcggccgctacctgtgcgggttggactgccttggccaatgtttacagcgaaacgggggctttccgttatgacgtggccctagaccgatgcccggatttattgattgtggattatgaattgatccaacgggctgaaccaagattactagttgccggcattggagatgcgatcgccaaatggtatgaagcttccgttagtagtggtcaatccagcgatactttcaccgtggccgctgtacaacaagctcgaattttgcgggatattcttttccaaaaatccgctgaagccctggcccaaccgggtagcgaaacctggcgggaagtggtggatgccagtttgttgatggcgggggtaatcggtggtttgggtggtgctaactgccgcaccgtcgcagcccatgcagtccacaatggtttgacccaattgccccaggcccaccatgccctccacggggaaaaagtcgcctatggcattttggtgcagttacgcttagaagaattggtcagcggtaatcaactcgccgctactgcccgtcgccaattactgagcttttacgatgagataggtttacccaaaaccctgcaagatctgggtctgggacgaatttccctggaggaattacgacagacggcggaatttacctgtttacccaattcggacattcaccgcttaccctttactgtgaccccagaaacgttgatggcggccatggtttccaccctagtggaggaacaaggtactcgccaattatttgcccaaattcaagataattccggtctttaa

SEQ ID NO: 371 - protein, 385 aa, Synechocystis sp
MAPSISPVTQPLVSMAIAPTVVIRSALAKAGEHLQKLGSKGLVVTGSHSAELGEKSLQTLQKNYGLTLPLASYLPDCAESSLEQLRRRVHQEQPDFILGIGGGKALDTAKLLAHQTQLAIATVPTSAATCAGWTALANVYSETGAFRYDVALDRCPDLLIVDYELIQRAEPRLLVAGIGDAIAKWYEASVSSGQSSDTFTVAAVQQARILRDILFQKSAEALAQPGSETWREVVDASLLMAGVIGGLGGANCRTVAAHAVHNGLTQLPQAHHALHGEKVAYGILVQLRLEELVSGNQLAATARRQLLSFYDEIGLPKTLQDLGLGRISLEELRQTAEFTCLPNSDIHRLPFTVTPETLMAAMVSTLVEEQGTRQLFAQIQDNSGL

SEQ ID NO: 372 - DNA, 1089 bp, Escherichia coli
  CDS (1)..(1089): transl_table=11
atgcctcacaatcctatccgcgtggtcgtcggcccggctaactacttttcacatccaggaagtttcaatcacctgcacgattttttcactgatgaacaactttctcgcgcggtgtggatctacggcaaacgcgccattgctgcggcgcaaaccaaacttccgccagcgtttggactgccaggggcaaagcatattttgtttcgcggtcattgcagcgaaagcgatgtacaacaactggcggctgagtccggtgacgaccgcagcgtggtgattggcgtcggtggcggtgcactgctcgacaccgcgaaagccctcgcccgccgtctcggtctgccgtttgttgccgttccgacgatcgccgccacctgcgccgcctggacaccgctctccgtctggtataatgatgccggacaggcgctgcattatgagattttcgacgacgccaattttatggtgctggtggaaccggagattatcctcaatgcaccgcaacaatatctgctggcggggatcggtgacacgctggcgaaatggtatgaagcggtggtgctggctccgcaaccagaaacgttgccgctaaccgtgcgactggggatcaataatgcgcaagccattcgcgacgtcttgttaaacagtagcgaacaggcgctgagcgatcagcaaaatcaacagttaacgcaatcattttgcgatgtggtggatgctattattgctggtggtgggatggttggtggtctgggcgatcgttttacgcgtgtggcggcagctcatgccgtgcataacggtctgaccgtgctgccgcaaaccgagaagtttctccacggcaccaaagtcgcctacggaattctggtgcaaagcgccttgctgggtcaggatgatgtgctggcgcaattaactggagcgtatcagcgttttcatctgccgactacactggcggagctggaagtggatatcaataatcaggcggagatcgacaaagtgattgcccacaccctgcgtccggtggagtccattcattacctgccagtcacgctgacaccagatacgttgcgtgcagcgttcaaaaaagtggaatcgtttaaagcctga

SEQ ID NO: 373 - protein, 362 aa, Escherichia coli
MPHNPIRVVVGPANYFSHPGSFNHLHDFFTDEQLSRAVWIYGKRAIAAAQTKLPPAFGLPGAKHILFRGHCSESDVQQLAAESGDDRSVVIGVGGGALLDTAKALARRLGLPFVAVPTIAATCAAWTPLSVWYNDAGQALHYEIFDDANFMVLVEPEIILNAPQQYLLAGIGDTLAKWYEAVVLAPQPETLPLTVRLGINNAQAIRDVLLNSSEQALSDQQNQQLTQSFCDVVDAIIAGGGMVGGLGDRFTRVAAAHAVHNGLTVLPQTEKFLHGTKVAYGILVQSALLGQDDVLAQLTGAYQRFHLPTTLAELEVDINNQAEIDKVIAHTLRPVESIHYLPVTLTPDTLRAAFKKVESFKA

SEQ ID NO: 374 - DNA, 23 bp, Artificial sequence
  primer
atgccgcatttggcactactcat

SEQ ID NO: 375 - DNA, 23 bp, Artificial sequence
  primer
ttattcccactcttgcaggaaac

SEQ ID NO: 376 - protein, 375 aa, Artificial sequence
  consensus sequence
  Variant (2)..(72): Xaa in position 2 to 72 is any amino acid
  Variant (73)..(86): Xaa in position 73 to 86 is any or no amino acid
  Variant (91)..(92): Xaa in position 91 to 92 is any amino acid
  Variant (94)..(95): Xaa in position 94 to 95 is any amino acid
  Variant (97)..(98): Xaa in position 97 to 98 is any amino acid
  Variant (100)..(107): Xaa in position 100 to 107 is any amino acid
  Variant (108)..(110): Xaa in position 108 to 110 is any or no amino acid
  Variant (113)..(113): Xaa in position 113 is any amino acid
  Variant (115)..(115): Xaa in position 115 is any amino acid
  Variant (117)..(117): Xaa in position 117 is any amino acid
  Variant (119)..(122): Xaa in position 119 to 122 is any amino acid
  Variant (124)..(126): Xaa in position 124 to 126 is any amino acid
  Variant (128)..(130): Xaa in position 128 to 130 is any amino acid
  Variant (132)..(140): Xaa in position 132 to 140 is any amino acid
  Variant (141)..(142): Xaa in position 141 to 142 is any or no amino acid
  Variant (144)..(148): Xaa in position 144 to 148 is any amino acid
  Variant (150)..(155): Xaa in position 150 to 155 is any amino acid
  Variant (158)..(160): Xaa in position 158 to 160 is any amino acid
  Variant (162)..(163): Xaa in position 162 to 163 is any amino acid
  Variant (165)..(166): Xaa in position 165 to 166 is any amino acid
  Variant (168)..(168): Xaa in position 168 is any amino acid
  Variant (171)..(173): Xaa in position 171 to 173 is any amino acid
  Variant (176)..(193): Xaa in position 176 to 193 is any amino acid
  Variant (194)..(210): Xaa in position 194 to 210 is any or no amino acid
  Variant (212)..(217): Xaa in position 212 to 217 is any amino acid
  Variant (219)..(224): Xaa in position 219 to 224 is any amino acid
  Variant (226)..(239): Xaa in position 226 to 239 is any amino acid
  Variant (240)..(243): Xaa in position 240 to 243 is any or no amino acid
  Variant (245)..(249): Xaa in position 245 to 249 is any amino acid
  Variant (250)..(253): Xaa in position 250 to 253 is any or no amino acid
  Variant (255)..(255): Xaa in position 255 is any amino acid
  Variant (257)..(264): Xaa in position 257 to 264 is any amino acid
  Variant (265)..(267): Xaa in position 265 to 267 is any or no amino acid
  Variant (271)..(271): Xaa in position 271 is any amino acid
  Variant (275)..(275): Xaa in position 275 is any amino acid
  Variant (277)..(284): Xaa in position 277 to 284 is any amino acid
  Variant (285)..(286): Xaa in position 285 to 286 is any or no amino acid
  Variant (289)..(289): Xaa in position 289 is any amino acid
  Variant (292)..(293): Xaa in position 292 to 293 is any amino acid
  Variant (295)..(295): Xaa in position 295 is any amino acid
  Variant (297)..(297): Xaa in position 297 is any amino acid
  Variant (300)..(300): Xaa in position 300 is any amino acid
  Variant (303)..(317): Xaa in position 303 to 317 is any amino acid
  Variant (318)..(326): Xaa in position 318 to 326 is any or no amino acid
  Variant (329)..(330): Xaa in position 329 to 330 is any amino acid
  Variant (332)..(356): Xaa in position 332 to 356 is any amino acid
  Variant (357)..(363): Xaa in position 357 to 363 is any or no amino acid
  Variant (365)..(373): Xaa in position 365 to 373 is any amino acid
  Variant (374)..(374): Xaa in position 374 is any or no amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXGGGKXXDXXKXXAXXXXXXXXXXXPTXAXTXAXXXXLXXXYXXXGXXXXXXXXXXXPXXXXXDXXXXXXAPXXXLXXGXXDXLAXXXEAXXXXXXXXXXXXXXXXXXXXXXXXXXXXXXXXXXXAXXXXXXLXXXXXXAXXXXXXXXXXXXXXXXXXAXXXXXXXXXGXGXXXXXXXXXXXAHAXHNGXTXXXXXXXXXXHGXKVXXGXLXQLXLEXXXXXXXXXXXXXXXXXXXXXXXXLPXXLXXXXXXXXXXXXXXXXXXXXXXXXXXXXXXXXPXXXXXXXXXXA

SEQ ID NO: 377 - protein, 21 aa, Artificial sequence
  protein pattern
  Variant (2)..(3): Xaa in position 2 to 3 is any amino acid
  Variant (4)..(4): Xaa in position 4 is Ala or Gly
  Variant (5)..(5): Xaa in position 5 is Ala or Ser
  Variant (7)..(7): Xaa in position 7 is Cys, Asp or Asn
  Variant (9)..(9): Xaa in position 9 is Ala, Gly or Pro
  Variant (10)..(10): Xaa in position 10 is any amino acid
  Variant (11)..(11): Xaa in position 11 is Ala, Ser or Thr
  Variant (12)..(13): Xaa in position 12 to 13 is any amino acid
  Variant (14)..(14): Xaa in position 14 is Ala, Ser or Val
  Variant (15)..(16): Xaa in position 15 to 16 is any amino acid
  Variant (18)..(20): Xaa in position 18 to 20 is any amino acid
PXXXXTXAXXXXXXXXYXXXG

SEQ ID NO: 378 - protein, 24 aa, Artificial sequence
  protein pattern
  Variant (2)..(6): Xaa in position 2 to 6 is any or no amino acid
  Variant (8)..(8): Xaa in position 8 is any amino acid
  Variant (9)..(9): Xaa in position 9 is Asp, Glu, Gln or Arg
  Variant (10)..(10): Xaa in position 10 is any amino acid
  Variant (11)..(11): Xaa in position 11 is Phe or Leu
  Variant (12)..(12): Xaa in position 12 is any amino acid
  Variant (13)..(13): Xaa in position 13 is Ala or Ser
  Variant (15)..(15): Xaa in position 15 is Ile, Leu, Met or Val
  Variant (16)..(16): Xaa in position 16 is Ala, Gly, Ser or Val
  Variant (18)..(18): Xaa in position 18 is Ala, Gly, Ser or Thr
  Variant (19)..(19): Xaa in position 19 is Ile, Leu, Met or Val
  Variant (20)..(20): Xaa in position 20 is Ala or Ser
  Variant (21)..(23): Xaa in position 21 to 23 is any amino acid
AXXXXXPXXXXXXGXXDXXXXXXE

SEQ ID NO: 379 - protein, 21 aa, Artificial sequence
  protein pattern
  Variant (2)..(2): Xaa in position 2 is any amino acid
  Variant (3)..(3): Xaa in position 3 is Asp, Glu, Asn, Gln, Arg or Ser
  Variant (4)..(7): Xaa in position 4 to 7 is any amino acid
  Variant (9)..(9): Xaa in position 9 is any or no amino acid
  Variant (11)..(11): Xaa in position 11 is any or no amino acid
  Variant (13)..(13): Xaa in position 13 is Ala, Pro or Ser
  Variant (14)..(14): Xaa in position 14 is Phe, Ile or Val
  Variant (16)..(16): Xaa in position 16 is Asp or Asn
  Variant (17)..(17): Xaa in position 17 is Ala or Gly
  Variant (18)..(18): Xaa in position 18 is Phe, Ile, Leu or Met
  Variant (19)..(19): Xaa in position 19 is Ser or Thr
  Variant (20)..(20): Xaa in position 20 is any amino acid
  Variant (21)..(21): Xaa in position 21 is Ile, Leu or Val
GXXXXXXAXAXHXXHXXXXXX

SEQ ID NO: 380 - protein, 15 aa, Artificial sequence
  protein pattern
  Variant (3)..(3): Xaa in position 3 is Glu, Asn, Gln, Ser or Thr
  Variant (4)..(4): Xaa in position 4 is any amino acid
  Variant (6)..(6): Xaa in position 6 is Ala, Gly, Ser or Thr
  Variant (7)..(7): Xaa in position 7 is any amino acid
  Variant (9)..(9): Xaa in position 9 is any amino acid
  Variant (11)..(11): Xaa in position 11 is any amino acid
  Variant (13)..(14): Xaa in position 13 to 14 is any or no amino acid
HGXXVXXGXLXQXXL

SEQ ID NO: 381 - protein, 19 aa, Artificial sequence
  protein pattern
  Variant (5)..(6): Xaa in position 5 to 6 is any amino acid
  Variant (8)..(9): Xaa in position 8 to 9 is any amino acid
  Variant (11)..(18): Xaa in position 11 to 18 is any or no amino acid
GGGKXXDXXKXXXXXXXXA

SEQ ID NO: 382 - DNA, 1029 bp, Saccharomyces cerevisiae
  CDS (1)..(1029)
atgtggaactcactaaaagcattcgctctagtgttcggaggttgttgctccaatgttattacatttgaaaccttaatgagcaacgaaacaggcagcattaataatctcattactttttgtcaatttttatttgttacatgtcagggactccccgaatttctggatgttcatcaacctttcccttacttcaagcctctgaaaactccacttcacgtttatgtcattactgtcgttttattttatatttcatctacgacgaataataacgtatttaaatacaacatatccattccgattcatatcgttttcagatgcttcggaaccgtaataaccatgtttacatgctggttattaaatggtaggaaatatacaaagattcagattttatcaacactatttttaaccattggagctataattgcctcattattcaaagatgctgattttcggtaccaagatttgaaactgcaagcgtggaaaattggaagtgaccaatctgtagatctcacttttatttttggcatttgtatactagtactttcatcattcacatcatctttactttcagcatacaatgaacgtacgtatcaaaaatatggaaagcattggaaggagaatatcttttacagtcattttttatcattacctctctttctatttagtcgaaagcagttaattcacgaatatcgagtgatgagaaagtctgaaagaatattgtgttcaaattttggagggaagattctagtcccgcgagaagaaactctccttcttttcaatgtgttaacacaatatttttgcgtcaagggtgttaatatcctcgccagtaaaacaaacgctctgacactttccataacattacttgtaagaaaatttataagtcttttactgagcgtccgacttttcgataataacttgtcatatactggctacatcggggtctacctagtcttttttggtgcctttatatactcgctgggatcaattcaccccaggcaaaatgacaagggggcgataaagaaaagtaaatga

SEQ ID NO: 383 - protein, 342 aa, Saccharomyces cerevisiae
MWNSLKAFALVFGGCCSNVITFETLMSNETGSINNLITFCQFLFVTCQGLPEFLDVHQPFPYFKPLKTPLHVYVITVVLFYISSTTNNNVFKYNISIPIHIVFRCFGTVITMFTCWLLNGRKYTKIQILSTLFLTIGAIIASLFKDADFRYQDLKLQAWKIGSDQSVDLTFIFGICILVLSSFTSSLLSAYNERTYQKYGKHWKENIFYSHFLSLPLFLFSRKQLIHEYRVMRKSERILCSNFGGKILVPREETLLLFNVLTQYFCVKGVNILASKTNALTLSITLLVRKFISLLLSVRLFDNNLSYTGYIGVYLVFFGAFIYSLGSIHPRQNDKGAIKKSK

SEQ ID NO: 384 - DNA, 951 bp, Schizosaccharomyces pombe 972h-
  CDS (1)..(951)
atgatagcatctgcattgtctttcatatttggaggttgctgttcaaacgcatatgcgcttgaagcactcgtgcgagaattcccaagcagtggtattctgattacgttctcgcaatttatactgattactattgaaggcttgatatactttttgctaaacgacgttcagtcattgaaacatccaaaggtgccgcgtaaacgatggtttgtggttgtagtaatgttctttgctattaatgttttgaataatgtggccttggggtttgatatttcagtaccagtacatattattttaagaagtagtggacctttaacaacaatggcggttggcagaatcttagctggtaaaagatactcaagtcttcaaattggaagtgtcttcatacttactattggtgtcataatagcaacgttggggaatgcgaaggacttacatttgcatgtagaatcaatgactcgatttggcattggatttactattctggtgataactcaaatacttggtgccatcatgggattggtattggagaatacctacagaatatatggctcagattggcgtgaaagtttattttacactcatgctctttcccttcctttctttttgttccttttaaggcccataagaagtcagtggaatgatttatttgcaatccacacgaaagggtttttaaatttaccttccggagtatggtacttgtgcttcaatacgttggctcagtacttctgtgtacgtggagtaaacgcgctaggggcagaaacatcagctctaacagtcagtgttgttttgaacgtcagaaaatttgtgagtttatgtcttagcctcattctctttgaaaacgaaatgggacctgccgtaaaatttggggctttgttggtgtttggatccagcgcagtatatgcttctgctcggtcaaaaccaaaaacaaatggattgaaaaaaaatgattaa

SEQ ID NO: 385 - protein, 316 aa, Schizosaccharomyces pombe 972h-
MIASALSFIFGGCCSNAYALEALVREFPSSGILITFSQFILITIEGLIYFLLNDVQSLKHPKVPRKRWFVVVVMFFAINVLNNVALGFDISVPVHIILRSSGPLTTMAVGRILAGKRYSSLQIGSVFILTIGVIIATLGNAKDLHLHVESMTRFGIGFTILVITQILGAIMGLVLENTYRIYGSDWRESLFYTHALSLPFFLFLLRPIRSQWNDLFAIHTKGFLNLPSGVWYLCFNTLAQYFCVRGVNALGAETSALTVSVVLNVRKFVSLCLSLILFENEMGPAVKFGALLVFGSSAVYASARSKPKTNGLKKND

SEQ ID NO: 386 - DNA, 1332 bp, Magnaporthe grisea 70-15
  CDS (1)..(1332)
atgacggcccgcgcgaacgtcagacgccgtcagagcttgcagaagagcaatcatgcgatcccgaaacccgtgaacagcgggccacccacgccgcgtgtgatcaacgcagcgccgctgctcgaaaaggccgagatgtacggaatcgacgacgaccgtccgctctactcgcgcatgatggccctggccggtcgcatcttcattgagaccattccgcaatggatcgcagtcggggttatgctgagcttaatcttcggaggctgctgctcaaacgtctttgctcttgaggccatcatcaaggtcgagcccgccagtggaactctccttacctttgtccagttcctctttgtcgcagtgacgggatacgtgtcgcaattcgaccgcaggaggccacccttcttcatcaaggcaaacaaagtgccgctcaaacggtggcttttcaacatcatactgttctttggcatcaacgtcctcaacaaccatgccttcagctacgacatctcagtccctgtccacatcatacttcgttcaggcggaagtatcactacaatgattgcggggttcatgtacggcaagcgataccctcgtgtccaagtttttgccgttatccttttgacgataggggttgtactggcggcgtggtccgatgcccagaccaaggatgcaggagctggcgcgaacgaacatgatgagggtggcaccggcagcagcacccgtagcttcaccatcggactcagcattctctttacggcacaggtcatgtcggccattatgggactgtacactgaggagacttacaggaagtacggcccgcagtggcaggagaaccttttctattctcacatcctgtcactgcctcttttcatacccttcatgccgtccctctacaggcagtttatgaagctggcagccagcgagccgctgacgcttaccacaccgtttggcagctttattggagatgccgggctggaaaacccaacactagcgcaattgcaaaagagtctggagcagatccgagtgcccagccagatagtatacctggttctcaacgtgctgacgcagtacgcctgcatccggggcgtcaatcttctggctgcggcatcctctgcgcttacggtcaccatcgtgctcaacatccgcaagctggtgagcctgttgcttagcatctggctctttggaaacaggctcgcaccaggcacattgggcggtgccgtgattgtgtttgcgtctggcgcgctgtattcaatgggcggaagcggaggtggcggccccaaggcccgcaaggtgcaaccagcgcagagacctcgggcgggaagtcagatcaaggtgggatag

SEQ ID NO: 387 - protein, 443 aa, Magnaporthe grisea 70-15
MTARANVRRRQSLQKSNHAIPKPVNSGPPTPRVINAAPLLEKAEMYGIDDDRPLYSRMMALAGRIFIETIPQWIAVGVMLSLIFGGCCSNVFALEAIIKVEPASGTLLTFVQFLFVAVTGYVSQFDRRRPPFFIKANKVPLKRWLFNIILFFGINVLNNHAFSYDISVPVHIILRSGGSITTMIAGFMYGKRYPRVQVFAVILLTIGVVLAAWSDAQTKDAGAGANEHDEGGTGSSTRSFTIGLSILFTAQVMSAIMGLYTEETYRKYGPQWQENLFYSHILSLPLFIPFMPSLYRQFMKLAASEPLTLTTPFGSFIGDAGLENPTLAQLQKSLEQIRVPSQIVYLVLNVLTQYACIRGVNLLAAASSALTVTIVLNIRKLVSLLLSIWLFGNRLAPGTLGGAVIVFASGALYSMGGSGGGGPKARKVQPAQRPRAGSQIKVG

SEQ ID NO: 388 - DNA, 1125 bp, Gibberella zeae PH-1
  CDS (1)..(1125)
atggcgaccgaaacaccttctaatatcctccgcaagaggacagctgccgatatgacggtcgtcgaaaactcggtccgtcgcgacagcacctcgcgagagtcggctaatggtgatctcgagcgcggttcggggccatcaatagctcagcacattgctaaactaatggcccatgaggttggaccctcgttgcttacagttggtgtgatgctgagcttgatctttggaggatgctgttccaatgtgtatgctcttgaagcaatcgtgaagtcgttccatgcagctaacctgattgtagttttgaaccctccagtggtccctatcagtcgctggatcttcaacattgttctcttcttcaccatcaacctcttgaacaatcatgcgttcagctacgacatctccgtcccagttcatatcatccttcgatctggtggaagtattacgaccatggcggcgggttacctctatggcaagcggtatacccaaacccaagttattgctgtctttctcttaaccctcggcgtgatcctggctgcttggtctgatgctcaagccaagggcacaagtgaaagcagtggtcgcccagcctttagcactgggctcttgattctcttcgtggctcaggtcctctctgctatcatgggtctttatactgaggcaacctacgctaaatacggacctcagtggaaggagaatctattctattctcatgctttgtctctgccactatttctgccttttgctccctccatggttcgaacgttctctcatcttatgacgagcactgcgatacagcttccggggatattcggttctgtgttcaccaaagtcatggtgcccaaccaaatcatcttcctcattaccaatgtccttacgcagtatgcttgcatccgcggcgtcaatctcttggctgctgcgtcaacagccctcaccgtcactattgttctcaatatccgaaaactcgtcagtctgcttctgagtatctggctgtttggcaaccagcttgcttccggcacgttgctcggcgctgtcatagtttttagtgccggtggactatacacagttggatcgcggaggaaagtaccagcggagaaggatatgccagctagggatcaaaaggcgagctga

SEQ ID NO: 389 - protein, 374 aa, Gibberella zeae PH-1
MATETPSNILRKRTAADMTVVENSVRRDSTSRESANGDLERGSGPSIAQHIAKLMAHEVGPSLLTVGVMLSLIFGGCCSNVYALEAIVKSFHAANLIVVLNPPVVPISRWIFNIVLFFTINLLNNHAFSYDISVPVHIILRSGGSITTMAAGYLYGKRYTQTQVIAVFLLTLGVILAAWSDAQAKGTSESSGRPAFSTGLLILFVAQVLSAIMGLYTEATYAKYGPQWKENLFYSHALSLPLFLPFAPSMVRTFSHLMTSTAIQLPGIFGSVFTKVMVPNQIIFLITNVLTQYACIRGVNLLAAASTALTVTIVLNIRKLVSLLLSIWLFGNQLASGTLLGAVIVFSAGGLYTVGSRRKVPAEKDMPARDQKAS

SEQ ID NO: 390 - DNA, 1014 bp, Kluyveromyces lactis NRRL Y-1140
  CDS (1)..(1014)
atgatagaaatattggctattttatcgttgtttggtgggtgctgttccaatgtattgagtttagaagaacttttactagataataaagatcggttgggaaatgtggtcacttttacacagtttatattcgttatcctaattgaactgccgaagtttgtcagcttaaaagggaggaaagtctcaataaaaccctgcaagataccgttctttatccattcaacgtcagcgttgctctttttcattggatctgttcttaataataacgttttcatgtacaacatttcaattccattacacattgtcatcaaatgtttgagcaccgtaaacaccatgattttcagttcaataattctcaaaaagagatatccttttgctcaaattatagcagcactcatgatgacttttggggccataattacctctgttttcaggtctactgaaattacgtcgtggcataactttttggaaagctttcaatattctaacgggtcaaacaggctatttctcggtatattattactttcattatcaacgatggcgatgtcattactcgctgttcttaatgagtatacctttcgtaagtatggaaggttttgggaagagtcatcgttttattgtcatctactctcaacaccattgtttccaattttcactcgtttgaatttgaagaaggatcttccactattgatggagtcaaaagaaacagtcctgttaccgtatacgaacataaatcttccaagaaaattattcatgttgattgccaataacttgacccaattcatctgtattcagagtgtcaatttgttagcaagtttaactgacgctcttacattatctgtcatcatgcttatcaggaaatttgcgagtcttcttttaagcgtatacatcttcggcaaccacatgacaaaaacagctatttctgggactattatagtgttttcaggggctataatttattcttggaactccgttgccaatggtacttcaaaatgtgtgcagaagaaggttgaatag

SEQ ID NO: 391 - protein, 337 aa, Kluyveromyces lactis NRRL Y-1140
MIEILAILSLFGGCCSNVLSLEELLLDNKDRLGNVVTFTQFIFVILIELPKFVSLKGRKVSIKPCKIPFFIHSTSALLFFIGSVLNNNVFMYNISIPLHIVIKCLSTVNTMIFSSIILKKRYPFAQIIAALMMTFGAIITSVFRSTEITSWHNFLESFQYSNGSNRLFLGILLLSLSTMAMSLLAVLNEYTFRKYGRFWEESSFYCHLLSTPLFPIFTRLNLKKDLPLLMESKETVLLPYTNINLPRKLFMLIANNLTQFICIQSVNLLASLTDALTLSVIMLIRKFASLLLSVYIFGNHMTKTAISGTIIVFSGAIIYSWNSVANGTSKCVQKKVE

SEQ ID NO: 392 - DNA, 990 bp, Yarrowia lipolytica CLIB122
  CDS (1)..(990)
atggaatgggttggaattgcaactttgattttcggtggatgttgttccaacgtgttcactttggaggctattgtcaaggacattcccgattcggggtcactgatcacgtttgttcagtttctgtttgtgtcgattgagggtctgtttcactttgtggacttttcacagccctttttcctcaagccctcaaaggctccttactcgcgatggacggtatctgtgctgttgtttttcctcgtttcggttatcaacaactacgtgtggaagctgcacatttcggtgcccttgcacatcattttcaggtctggaggaacagttataaccatgttactgggggtcatcaagggaaagaagtacaccagaggacaagtattgtctgtagcaatactgacggtcggagtcattctcgccaccttctcgcaggcacctaataaagactcaaagcagaaggctaccacgacgcagtttgtgcttggaattgtgctccttctggtcgctgctattctgtcttcgttccagggtctgttttccgaagtgacatactcgaaatatggaggcaactggcgtgaatccttgttctacacccatttcttgtctctgccactgtttgctccattggcaagcgatatcattcgtcaatttggcagtgtatggggagctcatccaagactccactttgagactctgggctacgacttgcatgtctccagagccttcatgtggctcatgctaaatgcgacgacgcagtatctgtgcatccgaggagtcaacaaactgagcggagccacctcggctctcacggttggtattgtgctcaacgtgcgcaagtttgtgtctctgctgctttcggtggtgctctttggcaactcgctgtccagtctaaccattctgggaaccgtgctgctgttcataggtgctggactctactcttttgagggacgaaaggccgccgaacgagccaagttggccaaggccgacaaggacaaataa

SEQ ID NO: 393 - protein, 329 aa, Yarrowia lipolytica CLIB122
MEWVGIATLIFGGCCSNVFTLEAIVKDIPDSGSLITFVQFLFVSIEGLFHFVDFSQPFFLKPSKAPYSRWTVSVLLFFLVSVINNYVWKLHISVPLHIIFRSGGTVITMLLGVIKGKKYTRGQVLSVAILTVGVILATFSQAPNKDSKQKATTTQFVLGIVLLLVAAILSSFQGLFSEVTYSKYGGNWRESLFYTHFLSLPLFAPLASDIIRQFGSVWGAHPRLHFETLGYDLHVSRAFMWLMLNATTQYLCIRGVNKLSGATSALTVGIVLNVRKFVSLLLSVVLFGNSLSSLTILGTVLLFIGAGLYSFEGRKAAERAKLAKADKDK

SEQ ID NO: 394 - DNA, 981 bp, Candida albicans SC5314
  CDS (1)..(981): transl_table=12
atgagatcactcacttatatttcaatctctggatggttaaatatcttgttacaagttttcggaggttgttgcagcaatgtatttgtactagaggatttgctatataataataaactggaatattcgttaggtactttggtgacatttagtcaattcctaataacatcaatactttccatacctattagcaccaaagggttcattagaccgacagttcccgtatcaagatggattttccctgttgtactttattttttaacttcacttttgaataatttggtgtggcagtttgacataacagtcccaatgcatatcatattccgatctagtgggacagtagtcaccatgttggttggatattttttcggtaataaaagatacagtaagcatcagatagtttcttcaattttcatgactttgggtacaattatggcaacactaccagaaggaaattctctactgatcgaaatcaacattaaatttttaaccgggatattgattttgacaattgcaagtgtaatttcggcatttatgggattgtatagtgaattgatttataaacagtacgggaatcaatggcatgaaagtttattttacaatcattttttggcattgcccttgtttgtatttgtgtctccaaccatttatagagagtttggtgttgtcttacagagtaaacaagttacactaggtgcatttaagtttcctagacagttattaagtttgactgtaaatgtgttgacacagtttatatgcaccaagggagtgaacatgcttgctggggaaacaagtgcgttgacagtcactgtcgtattattagtgagaaagtttgttagtttgatccttagcgtgatattctatggcagctacatgtcgacgctggggatgatcggctcaattattgtgtttggcagtgcagcatattacagcattagtgggatttctgatagaaaaattatggaattaaagaaagaaacataa

SEQ ID NO: 395 - protein, 326 aa, Candida albicans SC5314
MRSLTYISISGWLNILLQVFGGCCSNVFVLEDLLYNNKSEYSLGTLVTFSQFLITSILSIPISTKGFIRPTVPVSRWIFPVVLYFLTSLLNNLVWQFDITVPMHIIFRSSGTVVTMLVGYFFGNKRYSKHQIVSSIFMTLGTIMATLPEGNSLSIEINIKFLTGILILTIASVISAFMGLYSELIYKQYGNQWHESLFYNHFLALPLFVFVSPTIYREFGVVLQSKQVTLGAFKFPRQLLSLTVNVLTQFICTKGVNMLAGETSALTVTVVLLVRKFVSLILSVIFYGSYMSTSGMIGSIIVFGSAAYYSISGISDRKIMELKKET

SEQ ID NO: 396 - DNA, 987 bp, Kluyveromyces lactis
  CDS (1)..(987)
atgagttttgtattgattttgtcgttagtgttcggaggatgttgttccaatgtgattagtttcgagcacatggtgcaaggcagcaatataaatttgggaaatattgttacattcactcaattcgtgtctgtgacgctaattcagttgcccaatgctttggacttctctcactttccgtttaggttgcgacctagacacattcctcttaagatccatatgttagctgtgtttttgttctttaccagttcagtcgccaataacagtgtgtttaaatttgacatttccgttccgattcatattatcattagatgttcaggtaccactttgacgatgataataggttgggctgtttgtaataagaggtactccaaacttcaggtgcaatctgccatcattatgacgcttggtgcgattgtcgcatcattataccgtgacaaagaattttcaatggacagtttaaagttgaatacggattcagtgggtatgacccaaaaatctatgtttggtatctttgttgtgctagtggccactgccttgatgtcattgttgtcgttgctcaacgaatggacgtataacaagtgcgggaaacattggaaagaaactttgttctattcgcatttcttggctctaccgttgtttatgttggggtacacaaggctcagagacgaattcagagacctcttaatttcctcagactcaatggatattcctattgttaaattaccaattgctacgaaacttttcatgctaatagctaataacgtgacccagttcatttgtatcaaaggtgttaacatgctagctagtaacacggatgctttgacactttctgtcgtgcttctagtgcgtaaatttgttagtcttttactcagtgtctacatctacaagaacgtcctatccgtgactgcatacctagggaccatcaccgtgttcctgggagctggtttgtattcatatggttcggtcaaaactgcactgcctcgctga

SEQ ID NO: 397 - protein, 328 aa, Kluyveromyces lactis
MSFVLILSLVFGGCCSNVISFEHMVQGSNINLGNIVTFTQFVSVTLIQLPNALDFSHFPFRLRPRHIPLKIHMLAVFLFFTSSVANNSVFKFDISVPIHIIIRCSGTTLTMIIGWAVCNKRYSKLQVQSAIIMTLGAIVASLYRDKEFSMDSLKLNTDSVGMTQKSMFGIFVVLVATALMSLLSLLNEWTYNKCGKHWKETLFYSHFLALPLFMLGYTRLRDEFRDLLISSDSMDIPIVKLPIATKLFMLIANNVTQFICIKGVNMLASNTDALTLSVVLLVRKFVSLLLSVYIYKNVLSVTAYLGTITVFLGAGLYSYGSVKTALPR

SEQ ID NO: 398 - DNA, 25 bp, Artificial sequence
  primer
atgtggaactcactaaaagcattcg

SEQ ID NO: 399 - DNA, 25 bp, Artificial sequence
  primer
tcatttacttttctttatcgccccc

SEQ ID NO: 400 - protein, 335 aa, Artificial sequence
  consensus sequence
  Variant (9)..(11): Xaa in position 9 to 11 is any amino acid
  Variant (13)..(22): Xaa in position 13 to 22 is any amino acid
  Variant (23)..(28): Xaa in position 23 to 28 is any or no amino acid
  Variant (31)..(31): Xaa in position 31 is any amino acid
  Variant (34)..(43): Xaa in position 34 to 43 is any amino acid
  Variant (44)..(59): Xaa in position 44 to 59 is any or no amino acid
  Variant (61)..(69): Xaa in position 61 to 69 is any amino acid
  Variant (73)..(77): Xaa in position 73 to 77 is any amino acid
  Variant (80)..(85): Xaa in position 80 to 85 is any amino acid
  Variant (88)..(88): Xaa in position 88 is any amino acid
  Variant (90)..(90): Xaa in position 90 is any amino acid
  Variant (93)..(94): Xaa in position 93 to 94 is any amino acid
  Variant (96)..(97): Xaa in position 96 to 97 is any amino acid
  Variant (99)..(101): Xaa in position 99 to 101 is any amino acid
  Variant (104)..(110): Xaa in position 104 to 110 is any amino acid
  Variant (111)..(111): Xaa in position 111 is any or no amino acid
  Variant (113)..(113): Xaa in position 113 is any amino acid
  Variant (115)..(117): Xaa in position 115 to 117 is any amino acid
  Variant (119)..(125): Xaa in position 119 to 125 is any amino acid
  Variant (127)..(127): Xaa in position 127 is any amino acid
  Variant (129)..(129): Xaa in position 129 is any amino acid
  Variant (131)..(131): Xaa in position 131 is any amino acid
  Variant (133)..(150): Xaa in position 133 to 150 is any amino acid
  Variant (151)..(164): Xaa in position 151 to 164 is any or no amino acid
  Variant (166)..(168): Xaa in position 166 to 168 is any amino acid
  Variant (170)..(183): Xaa in position 170 to 183 is any amino acid
  Variant (185)..(185): Xaa in position 185 is any amino acid
  Variant (188)..(189): Xaa in position 188 to 189 is any amino acid
  Variant (192)..(193): Xaa in position 192 to 193 is any amino acid
  Variant (195)..(195): Xaa in position 195 is any amino acid
  Variant (197)..(198): Xaa in position 197 to 198 is any amino acid
  Variant (201)..(201): Xaa in position 201 is any amino acid
  Variant (203)..(203): Xaa in position 203 is any amino acid
  Variant (205)..(205): Xaa in position 205 is any amino acid
  Variant (210)..(240): Xaa in position 210 to 240 is any amino acid
  Variant (241)..(267): Xaa in position 241 to 267 is any or no amino acid
  Variant (269)..(270): Xaa in position 269 to 270 is any amino acid
  Variant (272)..(273): Xaa in position 272 to 273 is any amino acid
  Variant (276)..(277): Xaa in position 276 to 277 is any amino acid
  Variant (279)..(280): Xaa in position 279 to 280 is any amino acid
  Variant (284)..(284): Xaa in position 284 is any amino acid
  Variant (286)..(290): Xaa in position 286 to 290 is any amino acid
  Variant (294)..(297): Xaa in position 294 to 297 is any amino acid
  Variant (299)..(300): Xaa in position 299 to 300 is any amino acid
  Variant (303)..(304): Xaa in position 303 to 304 is any amino acid
  Variant (307)..(307): Xaa in position 307 is any amino acid
  Variant (310)..(314): Xaa in position 310 to 314 is any amino acid
  Variant (316)..(323): Xaa in position 316 to 323 is any amino acid
  Variant (325)..(327): Xaa in position 325 to 327 is any amino acid
  Variant (330)..(334): Xaa in position 330 to 334 is any amino acid
FGGCCSNVXXXEXXXXXXXXXXXXXXXXTFXQFXXXXXXXXXXXXXXXXXXXXXXXXXXPXXXXXXXXXLFFXXXXXNNXXXXXXISXPXHIXXRXXGXXXTMXXXXXXXXKXYXXXQXXXXXXXTXGXIXAXXXXXXXXXXXXXXXXXXXXXXXXXXXXXXXXGXXXLXXXXXXXXXXXXXXEXTYXXYGXXWXEXXFYXHXLXLPLFXXXXXXXXXXXXXXXXXXXXXXXXXXXXXXXXXXXXXXXXXXXXXXXXXXXXXXXXXXLXXNXXTQXXCXXGVNXLXXXXXALTXXXXLXXRKXXSLXLSXXXXXNXXXXXXXXGXXXVFXXXXXY

SEQ ID NO: 401 - protein, 58 aa, Artificial sequence
  protein pattern
  Variant (2)..(3): Xaa in position 2 to 3 is any or no amino acid
  Variant (5)..(5): Xaa in position 5 is Phe or Tyr
  Variant (6)..(6): Xaa in position 6 is any amino acid
  Variant (8)..(8): Xaa in position 8 is any amino acid
  Variant (9)..(9): Xaa in position 9 is Lys or Arg
  Variant (13)..(13): Xaa in position 13 is any amino acid
  Variant (15)..(16): Xaa in position 15 to 16 is Ala, Gly or Ser
  Variant (17)..(17): Xaa in position 17 is any amino acid
  Variant (18)..(18): Xaa in position 18 is Ser or Thr
  Variant (19)..(19): Xaa in position 19 is Asp, Asn, Ser or Thr
  Variant (23)..(23): Xaa in position 23 is Leu or Val
  Variant (24)..(24): Xaa in position 24 is Gly, Ser or Thr
  Variant (25)..(25): Xaa in position 25 is Ile or Val
  Variant (26)..(26): Xaa in position 26 is Thr or Val
  Variant (28)..(28): Xaa in position 28 is any amino acid
  Variant (29)..(29): Xaa in position 29 is Ile or Val
  Variant (32)..(32): Xaa in position 32 is Phe or Leu
  Variant (33)..(33): Xaa in position 33 is Ile or Val
  Variant (36)..(36): Xaa in position 36 is any amino acid
  Variant (39)..(39): Xaa in position 39 is Ile, Leu or Val
  Variant (40)..(40): Xaa in position 40 is any amino acid
  Variant (41)..(41): Xaa in position 41 is Phe, Ile or Leu
  Variant (42)..(42): Xaa in position 42 is Phe or Tyr
  Variant (43)..(43): Xaa in position 43 is any amino acid
  Variant (44)..(44): Xaa in position 44 is Asn or Ser
  Variant (45)..(45): Xaa in position 45 is any amino acid
  Variant (46)..(46): Xaa in position 46 is Leu or Met
  Variant (47)..(47): Xaa in position 47 is Ala, Gly or Ser
  Variant (48)..(49): Xaa in position 48 to 49 is any amino acid
  Variant (50)..(50): Xaa in position 50 is Ala, Gly, Thr or Val
  Variant (51)..(52): Xaa in position 51 to 52 is any amino acid
  Variant (54)..(54): Xaa in position 54 is Ala, Ser, Thr or Val
  Variant (55)..(56): Xaa in position 55 to 56 is any amino acid
  Variant (57)..(57): Xaa in position 57 is Leu or Val
TXXQXXCXXGVNXLXXXXXALTXXXXLXXRKXXSLXLSXXXXXXXXXXXXXXGXXXXF

SEQ ID NO: 402 - protein, 48 aa, Artificial sequence
  protein pattern
  Variant (2)..(4): Xaa in position 2 to 4 is any amino acid
  Variant (5)..(5): Xaa in position 5 is His, Trp or Tyr
  Variant (6)..(7): Xaa in position 6 to 7 is any amino acid
  Variant (8)..(8): Xaa in position 8 is Ala, Asn, Pro, Ser or Thr
  Variant (9)..(9): Xaa in position 9 is Ala, Ile or Val
  Variant (10)..(10): Xaa in position 10 is Phe, Ile, Leu or Val
  Variant (12)..(12): Xaa in position 12 is any or no amino acid
  Variant (14)..(16): Xaa in position 14 to 16 is any amino acid
  Variant (17)..(19): Xaa in position 17 to 19 is any or no amino acid
  Variant (22)..(22): Xaa in position 22 is any amino acid
  Variant (23)..(23): Xaa in position 23 is Ala or Val
  Variant (24)..(24): Xaa in position 24 is Phe or Trp
  Variant (25)..(27): Xaa in position 25 to 27 is any amino acid
  Variant (29)..(29): Xaa in position 29 is Ser or Thr
  Variant (30)..(30): Xaa in position 30 is Ile or Val
  Variant (32)..(32): Xaa in position 32 is Ile, Leu, Met or Val
  Variant (35)..(35): Xaa in position 35 is Ile or Val
  Variant (36)..(36): Xaa in position 36 is Phe, Ile or Leu
  Variant (37)..(37): Xaa in position 37 is Lys or Arg
  Variant (38)..(38): Xaa in position 38 is Cys or Ser
  Variant (39)..(39): Xaa in position 39 is any amino acid
  Variant (40)..(40): Xaa in position 40 is Gly or Ser
  Variant (41)..(41): Xaa in position 41 is Ser or Thr
  Variant (42)..(43): Xaa in position 42 to 43 is any amino acid
  Variant (46)..(47): Xaa in position 46 to 47 is any amino acid
  Variant (48)..(48): Xaa in position 48 is Cys, Gly or Ser
PXXXXXXXXXLXFXXXXXXNNXXXXXXIXXPXHIXXXXXXXXXTMXXX

SEQ ID NO: 403 - protein, 40 aa, Artificial sequence
  protein pattern
  Variant (2)..(10): Xaa in position 2 to 10 is any amino acid
  Variant (11)..(14): Xaa in position 11 to 14 is any or no amino acid
  Variant (16)..(17): Xaa in position 16 to 17 is any amino acid
  Variant (19)..(21): Xaa in position 19 to 21 is any amino acid
  Variant (23)..(24): Xaa in position 23 to 24 is any amino acid
  Variant (26)..(26): Xaa in position 26 is any amino acid
  Variant (28)..(28): Xaa in position 28 is Asn, Ser or Thr
  Variant (29)..(29): Xaa in position 29 is Ile or Leu
  Variant (32)..(32): Xaa in position 32 is Asn, Ser or Thr
  Variant (34)..(34): Xaa in position 34 is any amino acid
  Variant (36)..(36): Xaa in position 36 is Ala or Ser
  Variant (39)..(39): Xaa in position 39 is Phe or Leu
VXXXXXXXXXXXXXEXXYXXXGXXWXEXXFYXHXLXLPXF

SEQ ID NO: 404 - protein, 17 aa, Artificial sequence
  protein pattern
  Variant (9)..(9): Xaa in position 9 is any amino acid
  Variant (10)..(10): Xaa in position 10 is Ala, Ser, Thr or Val
  Variant (11)..(11): Xaa in position 11 is Phe or Leu
  Variant (13)..(13): Xaa in position 13 is any amino acid
  Variant (14)..(14): Xaa in position 14 is Ile, Leu or Met
  Variant (15)..(15): Xaa in position 15 is Ile, Leu, Met or Val
  Variant (16)..(16): Xaa in position 16 is any amino acid
  Variant (17)..(17): Xaa in position 17 is Asp, Gly, Asn, Ser or Val
FGGCCSNVXXXEXXXXX

SEQ ID NO: 405 - protein, 28 aa, Artificial sequence
  protein pattern
  Variant (2)..(2): Xaa in position 2 is any or no amino acid
  Variant (4)..(4): Xaa in position 4 is any amino acid
  Variant (5)..(6): Xaa in position 5 to 6 is any or no amino acid
  Variant (8)..(8): Xaa in position 8 is Ile or Val
  Variant (9)..(9): Xaa in position 9 is any amino acid
  Variant (10)..(10): Xaa in position 10 is Ala or Ser
  Variant (11)..(11): Xaa in position 11 is Ala, Ser, Thr or Val
  Variant (12)..(12): Xaa in position 12 is Phe, Ile or Leu
  Variant (13)..(13): Xaa in position 13 is Phe, Ile, Leu or Met
  Variant (14)..(14): Xaa in position 14 is Leu or Met
  Variant (16)..(16): Xaa in position 16 is Phe, Ile or Leu
  Variant (18)..(18): Xaa in position 18 is Ala, Thr or Val
  Variant (19)..(19): Xaa in position 19 is Ile or Val
  Variant (20)..(20): Xaa in position 20 is Ile, Leu, Met or Val
  Variant (21)..(21): Xaa in position 21 is Ala or Thr
  Variant (22)..(22): Xaa in position 22 is Ala, Ser or Thr
  Variant (23)..(25): Xaa in position 23 to 25 is any amino acid
  Variant (26)..(26): Xaa in position 26 is Ala, Asp, Gly or Ser
  Variant (27)..(27): Xaa in position 27 is any amino acid
  Variant (28)..(28): Xaa in position 28 is Ala, Asp, Glu, Ser or Thr
RXYXXXQXXXXXXXTXGXXXXXXXXXXX

SEQ ID NO: 406 - DNA, 804 bp, Saccharomyces cerevisiae
  CDS (1)..(804)
atgtcaaccagtcgtgaagattctgtgtacctagccaagttggctgaacaggccgaacgttatgaagaaatggtcgaaaacatgaagactgttgcctcctctggccaagagttgtcggtcgaagagcgtaatttgttgtctgttgcttataagaacgttattggtgctcgtcgtgcctcttggagaattgtttcttctattgagcaaaaggaggagtccaaggagaagtccgaacaccaggtcgagttgatttgttcgtaccgttcgaagattgagaccgaactaactaagatctccgacgatattttgtccgtgctagactcccacttaattccatcagccaccactggcgagtccaaggttttctactataagatgaagggtgactaccaccgttatttggctgaattttctagtggcgatgctagagaaaaggccacaaacgcctctttagaagcatacaagaccgcttctgaaattgccaccacagagttacccccaactcacccaatccgtctaggtttggctcttaacttctctgtcttctattatgaaattcaaaactctccagacaaagcctgccatttggccaagcaagcttttgacgacgctattgctgagttggacactctgtctgaagaatcatacaaagatagcacacttatcatgcaactgctaagggacaatttaaccttatggacttcagacatgtccgagtccggtcaagctgaagaccaacaacaacaacaacaacatcagcaacagcagccacctgctgccgccgaaggtgaagcaccaaagtaa

SEQ ID NO: 407 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 408 - DNA, 789 bp, Arabidopsis thaliana
  CDS (1)..(789)
atgggttctggaaaagagcgtgacactttcgtctacctcgctaagctctctgagcaagctgagcgttatgaagaaatggtggaatcaatgaaaagtgttgcgaaattgaatgttgatctgacggtggaagagaggaacttactctctgtgggttacaagaacgtgattggttcaaggagagcttcgtggaggatcttctcgtcgattgaacaaaaggaagcagtgaaagggaatgatgttaatgtaaagaggatcaaagagtatatggagaaggttgagttagagctttctaacatatgcattgatattatgtctgtcttagatgagcatctcattccttcggcttccgagggtgaatctactgtcttcttcaacaagatgaaaggtgactattaccgctatcttgctgagttcaaatcagggaacgagaggaaagaggctgctgatcagtctttgaaagcctatgagattgctactactgctgctgaggctaagctccctccaacacaccctatcagattgggtttggctttgaatttctctgtcttctactacgagatcatgaacgcacctgaaagggcatgtcaccttgctaagcaggcgttcgatgaagctatctcagagcttgacactctgaacgaggaatcctacaaagatagcaccttaataatgcaactccttagggacaatctgaccttgtggacttctgacatctcagaagaaggagacgatgctcataagacgaatggttctgccaaacctggtgctggtggagacgatgcagagtga

SEQ ID NO: 409 - protein, 262 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGDDAHKTNGSAKPGAGGDDAE

SEQ ID NO: 410 - DNA, 831 bp, Arabidopsis thaliana
  CDS (1)..(831)
atgggttctggaaaagagcgtgacactttcgtctacctcgctaagctctctgagcaagctgagcgttatgaagaaatggtggaatcaatgaaaagtgttgcgaaattgaatgttgatctgacggtggaagagaggaacttactctctgtgggttacaagaacgtgattggttcaaggagagcttcgtggaggatcttctcgtcgattgaacaaaaggaagcagtgaaagggaatgatgttaatgtaaagaggatcaaagagtatatggagaaggttgagttagagctttctaacatatgcattgatattatgtctgtcttagatgagcatctcattccttcggcttccgagggtgaatctactgtcttcttcaacaagatgaaaggtgactattaccgctatcttgctgagttcaaatcagggaacgagaggaaagaggctgctgatcagtctttgaaagcctatgagattgctactactgctgctgaggctaagctccctccaacacaccctatcagattgggtttggctttgaatttctctgtcttctactacgagatcatgaacgcacctgaaagggcatgtcaccttgctaagcaggcgttcgatgaagctatctcagagcttgacactctgaacgaggaatcctacaaagatagcaccttaataatgcaactccttagggacaatctgaccttgtggacttctgacatctcagaagaaggaggagacgatgctcataagacgaatggttctgccaaacctggtgctggtggagacgatgcagaggtaagtataagagattcctttactcggggtaaatcaaattaa

SEQ ID NO: 411 - protein, 276 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGGDDAHKTNGSAKPGAGGDDAEVSIRDSFTRGKSN

SEQ ID NO: 412 - DNA, 741 bp, Arabidopsis thaliana
  CDS (1)..(741)
atggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagcgagtgagtctaaggtcttttacttgaagatgaaaggtgattatcatcggtacatggctgagtttaagtctggtgatgagaggaaaactgctgctgaagataccatgctcgcttacaaagcagctcaggatatcgcagctgcggatatggcacctactcatccgataaggcttggtctggccctgaatttctcagtgttctactatgagattctcaattcttcagacaaagcttgtaacatggccaaacaggcttttgaggaggccatagctgagcttgacactctgggagaggaatcctacaaagacagcactctcataatgcagttgctgagggacaatttaaccctttggacctccgatatgcagatggacgaggcctga

SEQ ID NO: 413 - protein, 246 aa, Arabidopsis thaliana
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQMDEA

SEQ ID NO: 414 - DNA, 765 bp, Arabidopsis thaliana
  CDS (1)..(765)
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggaaagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgtaacaggagatgagattaaggaggcatcaaagcccgatggtgccgagtaa

SEQ ID NO: 415 - protein, 254 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGKIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTVTGDEIKEASKPDGAE

SEQ ID NO: 416 - DNA, 759 bp, Arabidopsis thaliana
  CDS (1)..(759)
atggagaacgagagagcgaagcaagtgtacttggcgaaactcaacgagcaagctgagagatacgatgagatggttgaagcaatgaagaaagttgcagctcttgatgtagagctcaccattgaagagaggaatcttttatctgttggttacaaaaatgtgattggtgctaggagagcatcgtggaggatcctttcttcgatcgagcagaaagaagaatcgaaaggaaacgaacaaaatgccaagaggattaaggattacaggacaaaagttgaagaagaactctccaagatttgttacgatattttggctgtcatcgataagcatcttgtcccattcgcaacttcgggagaatccaccgtcttctactacaaaatgaaaggagattatttcagatacttggctgaatttaagtccggtgctgatcgcgaggaagctgcggacctatcactcaaggcgtatgaagctgcaacgagttctgctagcacggaattgtctacaacacatccaataagactcggcttggctctcaacttttctgtcttctactacgagatcttgaattctccggaaagagcatgtcatttggcaaagcgagcgtttgatgaagcaatcgctgagcttgacagtcttaacgaagattcatacaaggacagcacacttatcatgcaacttctcagagataacctcactttatggacctctgatctagaggaaggaggtgaacaatctaaaggccataatcaacaagatgagaactaa

SEQ ID NO: 417 - protein, 252 aa, Arabidopsis thaliana
MENERAKQVYLAKLNEQAERYDEMVEAMKKVAALDVELTIEERNLLSVGYKNVIGARRASWRILSSIEQKEESKGNEQNAKRIKDYRTKVEEELSKICYDILAVIDKHLVPFATSGESTVFYYKMKGDYFRYLAEFKSGADREEAADLSLKAYEAATSSASTELSTTHPIRLGLALNFSVFYYEILNSPERACHLAKRAFDEAIAELDSLNEDSYKDSTLIMQLLRDNLTLWTSDLEEGGEQSKGHNQQDEN

SEQ ID NO: 418 - DNA, 768 bp, Arabidopsis thaliana
  CDS (1)..(768)
atggagaacgagagagcgaagcaagtgtacttggcgaaactcaacgagcaagctgagagatacgatgagatggttgaagcaatgaagaaagttgcagctcttgatgtagagctcaccattgaagagaggaatcttttatctgttggttacaaaaatgtgattggtgctaggagagcatcgtggaggatcctttcttcgatcgagcagaaagaagaatcgaaaggaaacgaacaaaatgccaagaggattaaggattacaggacaaaagttgaagaagaactctccaagatttgttacgatattttggctgtcatcgataagcatcttgtcccattcgcaacttcgggagaatccaccgtcttctactacaaaatgaaaggagattatttcagatacttggctgaatttaagtccggtgctgatcgcgaggaagctgcggacctatcactcaaggcgtatgaagctgcaacgagttctgctagcacggaattgtctacaacacatccaataagactcggcttggctctcaacttttctgtcttctactacgagatcttgaattctccggaaagagcatgtcatttggcaaagcgagcgtttgatgaagcaatcgctgagcttgacagtcttaacgaagattcatacaaggacagcacacttatcatgcaacttctcagagataacctcactttatggacctctgatctagaggaaggaggtgaacaatctaaaggccataatcaacaagatgaggtaaacaaaatctaa

SEQ ID NO: 419 - protein, 255 aa, Arabidopsis thaliana
MENERAKQVYLAKLNEQAERYDEMVEAMKKVAALDVELTIEERNLLSVGYKNVIGARRASWRILSSIEQKEESKGNEQNAKRIKDYRTKVEEELSKICYDILAVIDKHLVPFATSGESTVFYYKMKGDYFRYLAEFKSGADREEAADLSLKAYEAATSSASTELSTTHPIRLGLALNFSVFYYEILNSPERACHLAKRAFDEAIAELDSLNEDSYKDSTLIMQLLRDNLTLWTSDLEEGGEQSKGHNQQDEVNKI

SEQ ID NO: 420 - DNA, 738 bp, Arabidopsis thaliana
  CDS (1)..(738)
atggagaatgagagagaaaagctgatttacttggctaagctcggttgccaagctggaagatatgatgatgtgatgaaatcgatgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgaaaggagattattttcgatatatggcagagtttggttctgatgctgaacgtaaagaaaatgcagataattctctagatgcatataaggttgcaatggaaatggcagagaatagtttagcacccaccaatatggttagacttggattggctttaaatttctcgatattcaattatgagatccataaatctattgaaagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttag

SEQ ID NO: 421 - protein, 245 aa, Arabidopsis thaliana
MENEREKLIYLAKLGCQAGRYDDVMKSMRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 422 - DNA, 741 bp, Arabidopsis thaliana
  CDS (1)..(741)
atggcgacgaccttaagcagagatcaatatgtctacatggcgaagctcgccgagcaagccgagcgttacgaagagatggttcaattcatggaacagctcgtaagtggagctacaccggccggtgagctgaccgtagaagagaggaatcttctctcggtcgcgtataagaacgtgattggatctcttcgtgcggcatggagaatcgtgtcttcgattgagcaaaaggaagagagcaggaagaacgaagaacacgtgtcgcttgttaaggattacagatctaaagttgagactgagctttcttcgatctgttctgggattctcaggttacttgattcgcatctaattccttcagctactgccagtgagtctaaggttttttacctgaagatgaaaggagattatcatcgttatttggctgagtttaaatctggtgatgagaggaaaactgctgctgaagatactatgatcgcttacaaagctgctcaggacgttgcagttgctgatctagcacctacacatccgatcaggcttggtttggctcttaacttctcagtgttttactacgagattctcaactcttcagagaaagcttgtagcatggcgaaacaggcttttgaagaagccattgctgagctggacacattgggagaggagtcatacaaggacagtactctcatcatgcagttgctaagggacaatctaaccctttggacctccgatatgcagatggatgaggcctga

SEQ ID NO: 423 - protein, 246 aa, Arabidopsis thaliana
MATTLSRDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQMDEA

SEQ ID NO: 424 - DNA, 777 bp, Encephalitozoon cuniculi GB-M1
  CDS (1)..(777)
atggcatccaagcagtacgaggaggcattgcaaaaggcaaatcttagcgacatggccgagaggtatgacgatatggcaaaggagatgaggcttgcagtgacacttgcacacgaggacaagcacatcctcaacgtgatggcaagaaaccttttttccgttgcatacaagaacctggtgagctcgagaagatccagttggagaatgctgtgctccgagaggcaaaaactcgagggaaaggaccccagtgtggtccatgtgatcaacgaaaagataaaggttgttgaggaggagcttttgaggttctgcgacgaggtcctggacatcatcacgacatacatactgagcctggaggaggctcagaagaatatcgagtacaacattttcttcttgaagatgaagggagactactacagatacaaggcagaggttgtcacgggtcctgagcactctgaggtatcgaagcatgctgccgagtcgtacaaggaagccaccgagaaggcaaagaccctcccccccacaaaccctataaagctggggcttgcgctgaactactccgtattccactacgagatcctcaacgactcggaaaaggcctgctcaatagccaagggggcttttgacgaggctatcaaggagttggacactctttctgaagagcactacagagactcaaccctgataatgcagcttcttagggacaacctcactctctggacttctcgagaagaggggaatgtaatgggtgatgaggggaagggagatcctgatgaaaattaa

SEQ ID NO: 425 - protein, 258 aa, Encephalitozoon cuniculi GB-M1
MASKQYEEALQKANLSDMAERYDDMAKEMRLAVTLAHEDKHILNVMARNLFSVAYKNLVSSRRSSWRMLCSERQKLEGKDPSVVHVINEKIKVVEEELLRFCDEVLDIITTYILSLEEAQKNIEYNIFFLKMKGDYYRYKAEVVTGPEHSEVSKHAAESYKEATEKAKTLPPTNPIKLGLALNYSVFHYEILNDSEKACSIAKGAFDEAIKELDTLSEEHYRDSTLIMQLLRDNLTLWTSREEGNVMGDEGKGDPDEN

SEQ ID NO: 426 - DNA, 765 bp, Arabidopsis thaliana
  CDS (1)..(765)
atggagaatgagagggaaaagcaggtttacttggctaagctctccgagcaaaccgaaagatacgatgaaatggtggaggcgatgaagaaagttgctcagcttgatgtggagctaactgtggaagagaggaatcttgtatctgtagggtacaagaatgtgattggtgcaaggagagcatcatggagaatactatcttccattgagcagaaggaagagtccaagggaaatgatgaaaatgtcaagaggcttaagaattatcgtaagagagttgaagatgagcttgctaaagtttgtaatgacatcttgtctgtcattgataagcatctcattccatcgtctaacgctgtggagtcaactgtctttttctacaaaatgaaaggagattactatcgctatcttgcggagttcagttctggtgctgaacgcaaggaagctgcagatcagtctcttgaagcatataaggctgctgttgctgctgcagagaatggtttggcacccacacatccagttagacttggcttggcgttgaacttttcagttttctactatgagatcttgaactctcccgaaagcgcatgccaattggctaagcaagcattcgatgatgcaattgctgaacttgacagcctcaacgaggaatcatacaaagacagcactcttattatgcagctacttagagacaatctcaccttgtggacttcagaccttaatgaggaaggagatgagagaaccaaaggtgctgatgagcctcaagatgaggtatga

SEQ ID NO: 427 - protein, 254 aa, Arabidopsis thaliana
MENEREKQVYLAKLSEQTERYDEMVEAMKKVAQLDVELTVEERNLVSVGYKNVIGARRASWRILSSIEQKEESKGNDENVKRLKNYRKRVEDELAKVCNDILSVIDKHLIPSSNAVESTVFFYKMKGDYYRYLAEFSSGAERKEAADQSLEAYKAAVAAAENGLAPTHPVRLGLALNFSVFYYEILNSPESACQLAKQAFDDAIAELDSLNEESYKDSTLIMQLLRDNLTLWTSDLNEEGDERTKGADEPQDEV

SEQ ID NO: 428 - DNA, 756 bp, Arabidopsis thaliana
  CDS (1)..(756)
atggagaatgagagggaaaagcaggtttacttggctaagctctccgagcaaaccgaaagatacgatgaaatggtggaggcgatgaagaaagttgctcagcttgatgtggagctaactgtggaagagaggaatcttgtatctgtagggtacaagaatgtgattggtgcaaggagagcatcatggagaatactatcttccattgagcagaaggaagagtccaagggaaatgatgaaaatgtcaagaggcttaagaattatcgtaagagagttgaagatgagcttgctaaagtttgtaatgacatcttgtctgtcattgataagcatctcattccatcgtctaacgctgtggagtcaactgtctttttctacaaaatgaaaggagattactatcgctatcttgcggagttcagttctggtgctgaacgcaaggaagctgcagatcagtctcttgaagcatataaggctgctgttgctgctgcagagaatggtttggcacccacacatccagttagacttggcttggcgttgaacttttcagttttctactatgagatcttgaactctcccgaaagcgcatgccaattggctaagcaagcattcgatgatgcaattgctgaacttgacagcctcaacgaggaatcatacaaagacagcactcttattatgcagctacttagagacaatctcaccttgtggacttcagaccttaatgaggaaggaggtattcttattttcttttgtttccctatctcatga

SEQ ID NO: 429 - protein, 251 aa, Arabidopsis thaliana
MENEREKQVYLAKLSEQTERYDEMVEAMKKVAQLDVELTVEERNLVSVGYKNVIGARRASWRILSSIEQKEESKGNDENVKRLKNYRKRVEDELAKVCNDILSVIDKHLIPSSNAVESTVFFYKMKGDYYRYLAEFSSGAERKEAADQSLEAYKAAVAAAENGLAPTHPVRLGLALNFSVFYYEILNSPESACQLAKQAFDDAIAELDSLNEESYKDSTLIMQLLRDNLTLWTSDLNEEGGILIFFCFPIS

SEQ ID NO: 430 - DNA, 837 bp, Magnaporthe grisea 70-15
  CDS (1)..(837)
atggccaccgagcgcgaaagcaagaccttcctcgccaggctctgcgagcaggccgagcgctacgatgagatggttacgtacatgaaggaggttgccaagcttggtggtgagcttaccgtcgacgagcgcaacctgctctcggttgcctacaagaacgtcgtcggcacccgccgcgccagctggcgcatcatctcctcgatcgagcagaaggaggagtccaagggctcagacaagcacgtgtccaccatccgtgactaccgcaacaagatcgaggccgagctcgagaaggtctgccaggatgtcctcgatgtccttgacgagtcgctcattcccaacgccgcctcgggcgagtccaaggttttctaccacaagatgaagggtgactaccaccgttacctcgccgagtttgcctcgggtgagaagcgcaagaccgctgccaccgctgcccacgaggcctacaagagcgctaccgatgttgcccagaccgagcttacccccactcaccccatccgtctgggtctggcccttaacttctccgtcttctactatgagatcctgaactcgcccgaccgtgcttgccacctggccaagcaggcatttgacgatgccattgccgagctcgactctctgtctgaggagtcataccgcgacagcacccttatcatgcagctgctccgcgacaacctgaccctgtggacctcgtctgagacgggtgagggtgagaccgccgccgccggtgctaccgatgcccccaaggaggaggccaagacggatgcgcccgctgctgagaagactgaggccaaggctgacgagcccgccgccgcccccgcttcgtaa

SEQ ID NO: 431 - protein, 278 aa, Magnaporthe grisea 70-15
MATERESKTFLARLCEQAERYDEMVTYMKEVAKLGGELTVDERNLLSVAYKNVVGTRRASWRIISSIEQKEESKGSDKHVSTIRDYRNKIEAELEKVCQDVLDVLDESLIPNAASGESKVFYHKMKGDYHRYLAEFASGEKRKTAATAAHEAYKSATDVAQTELTPTHPIRLGLALNFSVFYYEILNSPDRACHLAKQAFDDAIAELDSLSEESYRDSTLIMQLLRDNLTLWTSSETGEGETAAAGATDAPKEEAKTDAPAAEKTEAKADEPAAAPAS

SEQ ID NO: 432 - DNA, 819 bp, Magnaporthe grisea 70-15
  CDS (1)..(819)
atgggtcacgaagatgccgtttacctggccaagctcgccgagcaggctgagcgctacgaggagatggtcgagaacatgaagatcgtcgcctccgaggacagggacttgaccgttgaggagcgcaaccttctctcggtcgcctacaagaacgtcattggtgcccgcagggcctcgtggaggattgttacctcgattgagcaaaaggaggagtccaagggcaactcgtcgcaggtcggcctcatcaaggagtaccgcaccaagatcgaggccgagctggccaagatctgcgaggacatcctgtcggtcctcgacaagcacctcatcccctcggccaagagcggcgagtccaaggtcttttaccacaagatgaagggcgactaccaccgttacctcgctgagttcgccattggcgacaagcgcaaggactcggcagacaagtccctcgaggcttacaaggctgctaccgaggttgcccagaccgagctgcctcccacgcatcccattcgccttggtcttgctctgaacttctccgtcttctactacgagatcctcaacgctcccgaccaggcctgccatctggccaagcaggcctttgacgatgctattgctgagctggacaccctgagcgaggagagctacaaggactcaactctgatcatgcagctgttgcgtgacaaccttactctctggacttcgtcggaggctgagccgacagcttcaacgggacacgctgaggctcctgctgcagcggctgccacagaggagaagcccgccgaggctgctgctgccgccgaggaggcgccgaagcctgctgagtaa

SEQ ID NO: 433 - protein, 272 aa, Magnaporthe grisea 70-15
MGHEDAVYLAKLAEQAERYEEMVENMKIVASEDRDLTVEERNLLSVAYKNVIGARRASWRIVTSIEQKEESKGNSSQVGLIKEYRTKIEAELAKICEDILSVLDKHLIPSAKSGESKVFYHKMKGDYHRYLAEFAIGDKRKDSADKSLEAYKAATEVAQTELPPTHPIRLGLALNFSVFYYEILNAPDQACHLAKQAFDDAIAELDTLSEESYKDSTLIMQLLRDNLTLWTSSEAEPTASTGHAEAPAAAAATEEKPAEAAAAAEEAPKPAE

SEQ ID NO: 434 - DNA, 819 bp, Gibberella zeae PH-1
  CDS (1)..(819)
atgggtcacgaagatgctgtctaccttgccaagctcgctgagcaggccgagcgatatgaggagatggttgagaacatgaagattgtcgccggtgaggaccgagatctcaccgtcgaggagcgaaaccttctctctgttgcctacaagaacgtcatcggcgcccgccgtgcctcctggcgcatagtcacctccatcgagcagaaggaggagtcaaagggcaactctagccaggttaccctcatcaaggagtaccgacagaagattgaggccgagcttgccaagatctgcgaagatatcctcgaggtccttgaccagcacctgatcccctctgccaagtctggcgagtccaaggttttctaccacaagatgaagggtgactaccaccgttacctcgccgagttcgccattggcgaccgtcgcaaggactctgccgacaagtccctcgaggcctacaaggctgctactgaggttgctcagaccgagcttcctcccacccaccccatccgccttggtctcgccctcaacttctccgttttctactacgagatcctcaacgctcctgaccaggcttgccacctggctaagcaggccttcgatgatgccatcgctgagcttgacactctgagcgaggagagctacaaggactctacactgatcatgcaactgctccgagacaacctcactctctggacctcttccgaggccgagacctccgctgctggtcaggctgaggctcccaaggaggatgcccctgctgctgccaccgctgaggacgcccctgctgcccctgccgcggctgaggagcccaaggctgagtaa

SEQ ID NO: 435 - protein, 272 aa, Gibberella zeae PH-1
MGHEDAVYLAKLAEQAERYEEMVENMKIVAGEDRDLTVEERNLLSVAYKNVIGARRASWRIVTSIEQKEESKGNSSQVTLIKEYRQKIEAELAKICEDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAAGQAEAPKEDAPAAATAEDAPAAPAAAEEPKAE

SEQ ID NO: 436 - DNA, 750 bp, Candida glabrata CBS 138
  CDS (1)..(750)
atgtctttgagccgtgaggatagtgtgtttttgaccaagttggctgagcaagccgagagatatgaggagatggtggagaacatgaaggatgttgcctctgctggacaggagttgagtgtcgaggagagaaacttgttgtctgttgcatacaagaacgttattggtgctcgcagagcttcctggagaattgtctcttccattgagcagaaagaagagagcaaagagaactcggaacaccaaatcaaattgatcaaggactaccgtgccaagatcgaggcagagctaactaagatctccgacgacatcttgtcggtgctagataagcacttgatcccatccgcctcctccggcgagtctaaggtcttctactacaagatgaaaggtgactaccaccgttacttggctgagttctcccaaggcgacgtgagagaaaacgctaccaaggcctccctagacgcttaccaaaaggcctccgaaatcgccaccactgaattgccaccaacccaccctatcagattgggtttggctctaaatttctccgtgttctactacgagatccaaaactctccagacaaggcttgccatttggccaagcaggctttcgacgacgctatcgcagaattggatactttgtctgaagaatcctacaaggacagtactttgatcatgcaattactaagagataacttgaccttgtggacttctgacatgtctgaggccgatgaccaaaagaatgaagaatctaagtga

SEQ ID NO: 437 - protein, 249 aa, Candida glabrata CBS 138
MSLSREDSVFLTKLAEQAERYEEMVENMKDVASAGQELSVEERNLLSVAYKNVIGARRASWRIVSSIEQKEESKENSEHQIKLIKDYRAKIEAELTKISDDILSVLDKHLIPSASSGESKVFYYKMKGDYHRYLAEFSQGDVRENATKASLDAYQKASEIATTELPPTHPIRLGLALNFSVFYYEIQNSPDKACHLAKQAFDDAIAELDTLSEESYKDSTLIMQLLRDNLTLWTSDMSEADDQKNEESK

SEQ ID NO: 438 - DNA, 753 bp, Candida glabrata CBS 138
  CDS (1)..(753)
atgtcgccaagtcgtgaggatagtgtgtatttggccaagctggctgagcaggccgagaggtacgaggagatggttgagtctatgaaggaggtggcctcgagtggtcaggagttgagtgttgaggagcgtaacctgctgtcggttgcttataagaatgttattggtgcgcgcagagcgtcctggaggattatctcctcgatcgagcagaaggaggagagcaaagagaaggctgagcaccaggttgagttgatccgcacgtaccgtggcaagatcgagaccgagctgacgaagatctctgacgacatactgtctgtgctagactcccacctgatcccatccgccaccagcggcgagtccaaggttttctactacaagatgaagggtgactaccaccgttacttggctgagttctccagtggtgatgtgagggacaaggccaccgaggcctccctagaggcttacaagaccgcctcagagatcgccaccacagagctgccaccaacacatcctatcagattgggtctggctctgaacttctccgtgttctactacgagatccaaaactccccagacaaggcttgccacttggctaagcaagctttcgacgacgccatcgccgagctggatacattgtccgaggaatcctacaaggacagtactctaatcatgcaattgctaagagataacttgaccttgtggacttccgacatgtctgaagctcaagatgaacaaaatgacgaaccaccaaaatga

SEQ ID NO: 439 - protein, 250 aa, Candida glabrata CBS 138
MSPSREDSVYLAKLAEQAERYEEMVESMKEVASSGQELSVEERNLLSVAYKNVIGARRASWRIISSIEQKEESKEKAEHQVELIRTYRGKIETELTKISDDILSVLDSHLIPSATSGESKVFYYKMKGDYHRYLAEFSSGDVRDKATEASLEAYKTASEIATTELPPTHPIRLGLALNFSVFYYEIQNSPDKACHLAKQAFDDAIAELDTLSEESYKDSTLIMQLLRDNLTLWTSDMSEAQDEQNDEPPK

SEQ ID NO: 440 - DNA, 753 bp, Kluyveromyces lactis NRRL Y-1140
  CDS (1)..(753)
atgtctttaagtcgtgaagattcagtgtatttagccaaattggctgaacaagcagaacgttatgaagaaatggtggaaaacatgaagaatgttgcatcttctggtcaagaattgtccgttgaagaaagaaacttgttatctgttgcttacaagaacgttattggtgctcgtcgtgcatcctggagaatcgtttcctccattgaacaaaaagaggaagctaaggaaaaatctgaacatcaagttcaattgatcagaacttaccgttcgaagatcgaatccgaattgactaagatctgtgatgatatcttgtcagtgttagatactcatttgattccaagtgctacaaccggtgaatccaaggtattctactataagatgaagggtgactaccaccgttatctggccgaattctcttccggtgacgttagagaaagtgctactcaagcctctttggaagcctacaaggaagcatccgatatcgccaccacagaattgccaccaactcatcctatcagattgggtttggccttaaacttctccgtgttctattacgaaattcaaaattccccagacaaggcttgtcatttggctaagcaagccttcgatgacgctattgctgaactagataccttatccgaagaatcatacaaggacagtactttgatcatgcaattgttgagagataacttgaccttgtggacttctgatatgtctgagactggtcaagaagaccaacctgctgaaggtgcttaa

SEQ ID NO: 441 - protein, 250 aa, Kluyveromyces lactis NRRL Y-1140
MSLSREDSVYLAKLAEQAERYEEMVENMKNVASSGQELSVEERNLLSVAYKNVIGARRASWRIVSSIEQKEEAKEKSEHQVQLIRTYRSKIESELTKICDDILSVLDTHLIPSATTGESKVFYYKMKGDYHRYLAEFSSGDVRESATQASLEAYKEASDIATTELPPTHPIRLGLALNFSVFYYEIQNSPDKACHLAKQAFDDAIAELDTLSEESYKDSTLIMQLLRDNLTLWTSDMSETGQEDQPAEGA

SEQ ID NO: 442 - DNA, 768 bp, Debaryomyces hansenii CBS767
  CDS (1)..(768)
atgcctaccttaagagaagattctgtttatcttgccaaattagccgaacaagctgaacgttatgaagaaatggtcgaaaacatgaagaccgttgcttcgtctgggcaagaattgtccgttgaagaacgtaacttgttatcggttgcttacaagaatgttattggtgcacgccgtgcatcatggagaattgtgtcgtcgatcgagcaaaaggaagaagctaagggcaatgaaagccaagtttcgttaattcgcgactaccgttctaagattgaggctgaattatccaagatctgtgaagacatcttgtcggttttaaccgaccacttgatttcatctgctcaaactggtgaatccaaggttttctactataaaatgaagggtgactaccaccgttacttggccgaattcgccatttctgaaaaacgtaaagatgccgccgacttgtcgttagaagcttacaagtccgcatcagatgttgctgtgaccgaattgccacctactcatccaattagattagggttagctttgaacttttctgttttctactacgaaattttaaattctccagacagagcctgccatttagccaaacaagccttcgatgatgctgttgctgacttggaaactttgtctgaagactcttacaaagattctacgttgattatgcaattattgagggataacttaactttatggactgacttgtccgaagccccagcgccaactgaagaacaacaaccttcagaaccaaaagccgatgaagaataa

SEQ ID NO: 443 - protein, 255 aa, Debaryomyces hansenii CBS767
MPTLREDSVYLAKLAEQAERYEEMVENMKTVASSGQELSVEERNLLSVAYKNVIGARRASWRIVSSIEQKEEAKGNESQVSLIRDYRSKIEAELSKICEDILSVLTDHLISSAQTGESKVFYYKMKGDYHRYLAEFAISEKRKDAADLSLEAYKSASDVAVTELPPTHPIRLGLALNFSVFYYEILNSPDRACHLAKQAFDDAVADLETLSEDSYKDSTLIMQLLRDNLTLWTDLSEAPAPTEEQQPSEPKADEE

SEQ ID NO: 444 - DNA, 831 bp, Yarrowia lipolytica CLIB122
  CDS (1)..(831)
atgtcttctgagagagaaaccaagaccttccttgcccggctctgtgagcaggctgaccgatacgacgagatggtcaactacatgaaggacgtcgctaagtccggtgaggagcttactgtcgacgagcgaaatctgctttccgtcgcttacaagaacgttatcggcgctcgacgagccagctggagagtcattttccccatagagcagaaggaggaggccaagggtgccacccaccatctcgagcttctcaagacctacagagccaagattgaggcagagctcgaagacatctgcagcgatgttcttgatatcctcaccaaccacctcctccccaaggccgagaacgccgagtctaaggtcttctactacaagatgaagggtgactaccatcgataccttgccgagttcacctccggcgagaagcgaaaagaggctgccactgccgctcacgagtcatacaagagcgccactgatgttgcccagactgagctcagctcaactcaccccatccgacttggtctcgctctcaacttctccgtcttctactacgagattctcaactcgccagaccgtgcttgccaccttgccaagcaggctttcgatgatgccatcgctgagctcgacactctctccgaggagtctttccgagactctaccgtcattatgcagcttctgcgagacaacctgaccctctggaagaacgacctcgaagagtctctgcaagcccagcagtctgaggagacccctgccaccgatgctgccgctgcttccaccgaggctgctgcccccaaggaggaggccaagcccgctgctgaggagcccaaggagtag

SEQ ID NO: 445 - protein, 276 aa, Yarrowia lipolytica CLIB122
MSSERETKTFLARLCEQADRYDEMVNYMKDVAKSGEELTVDERNLLSVAYKNVIGARRASWRVIFPIEQKEEAKGATHHLELLKTYRAKIEAELEDICSDVLDILTNHLLPKAENAESKVFYYKMKGDYHRYLAEFTSGEKRKEAATAAHESYKSATDVAQTELSSTHPIRLGLALNFSVFYYEILNSPDRACHLAKQAFDDAIAELDTLSEESFRDSTVIMQLLRDNLTLWKNDLEESLQAQQSEETPATDAAAASTEAAAPKEEAKPAAEEPKE

SEQ ID NO: 446 - DNA, 786 bp, Aspergillus nidulans FGSC A4
  CDS (1)..(786)
atgggtcacgaagatgctgtttacctggccaagctcgccgagcaggctgaacgctatgaggaaatggttgagaacatgaaggttgtcgccgcctctgacgtagagctcactgtggaagagcggaatctgctttctgttgcctacaagaacgtcatcggcgcccgccgtgcgtcctggagaattgttacctccatcgaacaaaaagaggagtccaagggcaacgagtcccaagttgctctcattaaggagtaccgccagaagattgagggcgagctcgccaaaatctgccaggacatcctggacgttctcgaccagcacctgatcaagtccgctcagagcggcgagtccaaggtcttctaccacaagatgaagggtgactaccaccgttaccttgccgagttcgctgttggcgacaaccgcaaggctgcggccgacgcctccctggaggcctacaagtctgccaccgaagtcgctcagaccgaccttgcccctactcaccccatccgtctcggcttggcccttaacttctctgtcttctactacgagattctcaactctcccgaccaggcttgccacctcgccaagcttgctttcgacgatgctattgccgagcttgacaccctgagcgaagagagctacaaggactccactcttattatgcagcttctcagggataacctgactctctggacctcctctgaggccgaacccgctgcagagaatgcccccgccgaaaagaaggaggaagcccccgccgctgagggcgaggagaagcccgctgaataa

SEQ ID NO: 447 - protein, 261 aa, Aspergillus nidulans FGSC A4
MGHEDAVYLAKLAEQAERYEEMVENMKVVAASDVELTVEERNLLSVAYKNVIGARRASWRIVTSIEQKEESKGNESQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 448 - DNA, 801 bp, Aspergillus nidulans FGSC A4
  CDS (1)..(801)
atgacttctgagcgtgagaacaaaacattcctcgcccgcctctgcgagcaggccgagcgttacgatgagatggtcacgtatatgaagattggcggcgaacttaccgttgacgagcgtaaccttctctctgtcgcctacaagaacgtcgtcggtactcgacgtgcctcgtggcgtatcatctcctccattgaacagaaggaggaatctaagggctctgagcagcacgtcagcattatccgcgagtaccgtcaaaagatcgagaccgagcttgagaaggtctgccaagacgttctcgatgtactggacgagtccctcatccctaaggctgagacaggcgagtctaaggtgttctactacaagatgaagggtgactaccaccgctaccttgctgaattcgcgtctggcaacaagcgcaagcttgccgccaccgctgcccacgaggcttacaagaacgcaaccgacgttgctcagactgagcttacccccacgcaccccatccgcctgggacttgccctgaacttctccgtgttttactacgagatcctgaactcccctgaccgtgcctgccaccttgccaagcaggctttcgatgacgctattgcggagctggactcactttccgaggaaagctaccgtgatagcactctcatcatgcagttgctgcgtgataaccttactctgtggacttcgtccgacggcaacgaacccgagaacgtgtctgcccccaaggaggagaagcctgaggaggacgctgctgctcccgaggagaagcccgaggaagccaaggctcccgagtcgtaa

SEQ ID NO: 449 - protein, 266 aa, Aspergillus nidulans FGSC A4
MTSERENKTFLARLCEQAERYDEMVTYMKIGGELTVDERNLLSVAYKNVVGTRRASWRIISSIEQKEESKGSEQHVSIIREYRQKIETELEKVCQDVLDVLDESLIPKAETGESKVFYYKMKGDYHRYLAEFASGNKRKLAATAAHEAYKNATDVAQTELTPTHPIRLGLALNFSVFYYEILNSPDRACHLAKQAFDDAIAELDSLSEESYRDSTLIMQLLRDNLTLWTSSDGNEPENVSAPKEEKPEEDAAAPEEKPEEAKAPES

SEQ ID NO: 450 - DNA, 786 bp, Ustilago maydis 521
  CDS (1)..(786)
atgcccgaatcgcgtgaagactctgtctaccttgccaagctcgccgagcaggcggagcgctacgaggagatggtcgagaacatgaagcgcgttgcttcgtctgaccaggagcttactgtcgaggagcgcaaccttctctcggtcgcctacaagaacgtcattggtgctcgtcgtgcctcgtggcgcatcgtctcctccatcgagcagaaggaggagtccaagggtaacgagacccaagtttccatgatcaagacctaccgtgagaagatcgaggccgagctcgcccagatctgcgaggacatcctcgacgttttggacaagcacctcattccctcggccgcctcgggtgagagcaaggtcttctaccacaagatgaagggtgactaccaccgatacctcgccgagttcgccaccggtgacaagcgtaaggactctgccgacaagtcgctcgaggcctacaaggctgcttcggacgtcgctgtcaccgagctgccccctacccaccccatccgcctgggtcttgccctcaacttctcggtcttctactacgagatcttgaacagccccgaccgcgcttgccacctcgccaagcaggctttcgacgacgctatcgccgagctcgacaccctctcggaggagagctacaaggactcaaccctcatcatgcagttgctccgtgacaaccttaccctctggacttcggacatgcaagattccgagaagcccaccgaagccgccgctgccgacgctccggctgccgaggccaagggtgaggaggccgcctaa

SEQ ID NO: 451 - protein, 261 aa, Ustilago maydis 521
MPESREDSVYLAKLAEQAERYEEMVENMKRVASSDQELTVEERNLLSVAYKNVIGARRASWRIVSSIEQKEESKGNETQVSMIKTYREKIEAELAQICEDILDVLDKHLIPSAASGESKVFYHKMKGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQDSEKPTEAAAADAPAAEAKGEEAA

SEQ ID NO: 452 - DNA, 1038 bp, Hordeum vulgare var
  CDS (79)..(858)
  misc_feature (951)..(951): r is g or a
gcacgaggccactccccactccgccaagaaacagcaacagccacacgcccacgcgcacacaccagatcgtcgacagcgatggcagcggcagcgggaacgagggaggagatggtctacatggcgaagctggcggagcaggccgagcggtacgaggagatggtcgagttcatggagagggtcgtggcagcgacggggaccggcgagctcagcgtcgaggagaggaacctgctttcagtagcgtacaagaacgtcatcggggcgcgtcgtgcttcctggcgcatcgtgtcctccatcgagcagaaggaggaagggcgcggagctgcggggcacgccgccgcggcgcgcgggtaccgcgcacgtgtcgaggccgaactctccaacatctgcgcggggatcctccgtctcctcgacgaacgcctagtccccgccgccgccgccgtcgatgccaaggtattctacctgaagatgaagggagactaccaccgctacctcgcggagttcaagtcggccgccgagcgcaaggatgccgccgactccaccctcggtgcctaccaggccgctcaggacatagccatgaaggagctgccaccgactcaccccatcaggctgggcctcgcgctcaacttctctgtgttctactacgagatcctcaactcgcctgatcgggcgtgctcgctcgccaagcaggctttcgatgaagccattgctgagctggattccctcggggaagattcctacaaggacagcaccctgatcatgcaacttctccgtgacaatctcaccttgtggacctctgatatgcaggatgacgctggcgatgaaacgagggattcaagcaagcctgaggatgagcagtagtgaagggtcctagctactgcgctctttctctcttaaccttcgggtagttatgatgcttgtacaaggaccattttcgtttgtcctttgtcgctrgatcttttacctaccctttctttggttatattgttttataaaaaaaaaaaaaaaaaaaaaaaaaaaaaaaaaaaaaaaaaaaaaaaa

SEQ ID NO: 453 - protein, 259 aa, Hordeum vulgare var
MAAAAGTREEMVYMAKLAEQAERYEEMVEFMERVVAATGTGELSVEERNLLSVAYKNVIGARRASWRIVSSIEQKEEGRGAAGHAAAARGYRARVEAELSNICAGILRLLDERLVPAAAAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDETRDSSKPEDEQ

SEQ ID NO: 454 - DNA, 1000 bp, Hordeum vulgare var
  CDS (25)..(825)
cgcccttgcacaagccgagcgagcatgtcgccggcggagccgacgcgagacgagagcgtctacatggcgaagcttgcggagcaggccgagcgctacgaggagatggtcgagttcatggagcgcgtggccaaggccaccggcggggcagggcccggggaggagctatccgtggaggagcgcaacctgctctctgtggcttacaagaacgtcatcggggcccggcgcgcgtcctggaggattatctcctcaatcgagcagaaggaggaaggtcggggcaacgaggcgcacgccgccaccatccgctcctaccgcaccaagatcgaggccgagctcgcaaagatctgcgacggcatcctcgcgctgctcgattcccatctcgtgccatccgccggagccgccgagtccaaagtcttctatctgaagatgaagggcgactaccacaggtaccttgcagagtttaagtctggtgcggagaggaaggaagccgccgagagcaccatgaatgcgtacaaagctgctcaggatatcgctctagcagatttggcgccaacccaccccatcaggcttgggcttgcactcaacttctctgtgttctactatgagatcttgaactcccctgaccgcgcctgcaaccttgcaaaacaggcctttgatgaggctatatcagagctggacagcttaggcgaggaatcctacaaggatagcactttaatcatgcagctcctacgtgacaatttgactctatggacatccgacaccaatgaggatgacgttgatgagataaaggaagccccagctccaaaagaatcgggagacgggcagtgaggtgaatccaaacaacagtctgcattgttgggggcgatggaagccgatggtcttggttctagttcataatgtggtcatcactaccgatgtttaattatgcacataagaaagttctgggtctatgtttttctggggctgataaatgctggctggaggcgtgttttcttgtttaaat

SEQ ID NO: 455 - protein, 266 aa, Hordeum vulgare var
MSPAEPTRDESVYMAKLAEQAERYEEMVEFMERVAKATGGAGPGEELSVEERNLLSVAYKNVIGARRASWRIISSIEQKEEGRGNEAHAATIRSYRTKIEAELAKICDGILALLDSHLVPSAGAAESKVFYLKMKGDYHRYLAEFKSGAERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 456 - DNA, 1029 bp, Gossypium hirsutum
  CDS (35)..(796)
aaagatcaaagactcaaagagaaagaaagcggccatggagaaggaaagagagcaacaagtttacttggcaaggctcgctgagcaagctgaaagatacgatgagatggttgaggccatgaagagtgttgctaagttggatgttgagctgactgtggaggagaggaatctgttatctgtgggatataagaatgtgattggagcaagaagggcatcctggcggatactgtcttcaattgaacagaaggaggaggccaaaggtaacgaacaaaatgtgaagaggataaaggattataggcaaagggtcgaagatgaactctcaaagatatgcaatgacatactctcagtcattgataagcacctcattccatcttcctccaccggggaatcaactgttttctactataagatgaaaggagattattttcgttatttggcagaatttaaggcaggagatgatcgtaaagaagctgctgatcagtcacttaaggcttatgaggctgccacttccactgcaagctcagatttgcctccaactcacccaattagacttggcctggctttgaacttctcagttttctactatgagatattaaattctcccgagagggcttgtcatctggctaaacaagcatttgatgaggctattgctgagcttgatagccttaatgaagaatcttacaaggatagcacccttatcatgcagcttcttagggacaacctcaccttgtggacctcggatctgccagaggaaggaggtgagcaatcaaaagcagatgaacctcaggctgagagttaattggatgaaagagtattcttttaagactgggcttgtcgagataggaaaggggcttgctgctagagtgacctgctttcaactcatggtagtagtaccaggatttgttacctatgacatggttcgatttgtttatcagatgttttcagactgttgttctgtgttctcttctgtttaaacataattgaatcggttacactttatagtctttatgacttaaaaaaaaaaaaaaaaaa

SEQ ID NO: 457 - protein, 253 aa, Gossypium hirsutum
MEKEREQQVYLARLAEQAERYDEMVEAMKSVAKLDVELTVEERNLLSVGYKNVIGARRASWRILSSIEQKEEAKGNEQNVKRIKDYRQRVEDELSKICNDILSVIDKHLIPSSSTGESTVFYYKMKGDYFRYLAEFKAGDDRKEAADQSLKAYEAATSTASSDLPPTHPIRLGLALNFSVFYYEILNSPERACHLAKQAFDEAIAELDSLNEESYKDSTLIMQLLRDNLTLWTSDLPEEGGEQSKADEPQAES

SEQ ID NO: 458 - DNA, 1293 bp, Ipomoea nil
  CDS (154)..(942)
ggccacgcgccgcccccaactttctccaccctaacgcgttttctttataaaccgcctttcttctgtcagttcctctattgcatttcagtgtcggaaaaacgcagcggttgctgcttcagtttaagaattaggtattaattgagtatagcaaagatggtgtcaactgagtcatctcgtgaagagaatgtgtacatggccaagttggccgagcaggctgagaggtatgaggaaatggtggagttcatggagaaggttgccaagacggtggatgtggatgagctaaccgtggaggaaaggaaccttctctcggtggcgtacaagaatgtgattggtgcgaggagggcctcgtggagaatcatatcttctattgagcaaaaggaggagagccgtgggaatgaggagcttgttaagaccattaaggaatataggggtagaattgaggcagagctgagcaagatatgcgatggcatattgagccttctcgagtcccacctggttccctcggcttccactgctgagtccaaggtgttttacttgaagatgaaaggcgattaccataggtaccttgctgagtttaagaccggggctgagaggaaagaagctgccgagagcactttgttggcatataagtccgctcaggatattgcattgggtgaactggctccaacccaccctattaggctcggacttgcccttaacttttctgtgttctattacgaaatccttaactcacctgaccgtgcctgcaaccttgccaagcaggcctttgatgaagcaatcctcgagctagacacacttggtgaagaatcttacaaggacagcacattgatcatgcaacttctcagagacaacttaactctgtggacttctgataccgcggatgatggcggggacgagatcaaggaagcatcaaagcgggaatcaggcgaggggccgcagtaatatttagcgccattcttttgcactcccacaatctctctacgtttaatgttatgaatttaagaatgaatgatggtttgggtacttctctatagtgttgtgtttttaatacgatacagtcagtaatattcctattatcagttggttgggttgatgaagtagattatatgttagtggtttagccttgtgtctgttacaatgatgatggtaataccaatgttttttcaaatgttcttccctcctatgttggggatttgtgactattattgaaaaattttacagtttcaaaagtaatatttatgaagaataattcttgtacttagaaaaaaaaaaaaaaaaaaaaaaaaagcttgt

SEQ ID NO: 459 - protein, 262 aa, Ipomoea nil
MVSTESSREENVYMAKLAEQAERYEEMVEFMEKVAKTVDVDELTVEERNLLSVAYKNVIGARRASWRIISSIEQKEESRGNEELVKTIKEYRGRIEAELSKICDGILSLLESHLVPSASTAESKVFYLKMKGDYHRYLAEFKTGAERKEAAESTLLAYKSAQDIALGELAPTHPIRLGLALNFSVFYYEILNSPDRACNLAKQAFDEAILELDTLGEESYKDSTLIMQLLRDNLTLWTSDTADDGGDEIKEASKRESGEGPQ

SEQ ID NO: 460 - DNA, 1176 bp, Oryza sativa subsp
  CDS (101)..(871)
tccgccgaacaaaaagcattcgcatccacgagaccactcgaacccgacccgcctcgccgccgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgccggcgagggccagtaaaatgggaagatcgatcgatcgatggctccgcatgttattggagaccattgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtc

SEQ ID NO: 461 - protein, 256 aa, Oryza sativa subsp
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDAGEGQ

SEQ ID NO: 462 - DNA, 1066 bp, Solanum berthaultii
  CDS (60)..(845)
gaagaagaagaaaaagataaaaatctccatttttttcaactcagagagaagatcggaaaatggcttcatccaaagaacgtgaaaacttggtgtacatcgccaggcttgctgagcaagctgaacgctacgatgagatggtcgatgcaatgaagaatgttgcaaatctggatgttgaactgacagtggaggagaggaatttgttatctgttggttataagaatgtggttggatctaggagagcatcatggaggatcttgtcttccatcgagcagaaggaagaaggtagaggaaatgagcagaatgtgaagcggatccagaattaccgccaaaaagtagaggcagagctcaccgacatttgcaataatatcatgaccgtgattgatgagcatctgattccatcatgtactgctggtgaatcaactgtgttttactacaaaatgaaaggggattattatcgatatcttgcagagttcaaaacaggtgatgacaagaaagaggtttctgatctgtctttaaaagcatatcagacagctacaactactgcagaagctgaattaccaatcacccatcccattcggttgggtttggctctaaatttctctgttttctactatgagataatgaactcacctgaaagggcttgccaattggctaagcaggtttttgatgaagcaatatctgagctggatagcctcaatgaggacaactacaaagatggcaccttaattctgcagcttctgagggacaatctcaccttgtggacgtctgacattccagaggatggagaagaggctctaaagggagatgctgcaaacaaagtgggcgcaggcgaggatgcagagtgatgatccaaacgagtaaaatgtaccatgtgtatttgattaaaggaggctggtgaaacatctggtggattgtttgtcaagtgctaatagataattgtaaggcaccaacaaatgaatagatacttgtttattggatatgtgtcttgctggagattgttttcacattaattgatgaatgcatatcatttgatttgcatccccattgttatctaaaaaaaaaaaaa

SEQ ID NO: 463 - protein, 261 aa, Solanum berthaultii
MASSKERENLVYIARLAEQAERYDEMVDAMKNVANLDVELTVEERNLLSVGYKNVVGSRRASWRILSSIEQKEEGRGNEQNVKRIQNYRQKVEAELTDICNNIMTVIDEHLIPSCTAGESTVFYYKMKGDYYRYLAEFKTGDDKKEVSDLSLKAYQTATTTAEAELPITHPIRLGLALNFSVFYYEIMNSPERACQLAKQVFDEAISELDSLNEDNYKDGTLILQLLRDNLTLWTSDIPEDGEEALKGDAANKVGAGEDAE

SEQ ID NO: 464 - DNA, 1137 bp, Lilium longiflorum
  CDS (68)..(859)
gctgattgaggatcgaagcgcgagatttctagggtttcgaccttcaagaatcaactagagaggaaagatgtctccggtggagtcgtcccgggacgagagtgtgtacatggcgaagcttgcggagcaagctgagcggtacgaggagatggtggaattcatggagaaggttgctaagacagtggatgctggggaggagctcactgtggaggagcgcaacttgctgtcggttgcatacaagaatgttattggtgcccgccgggcttcgtggcgaattatctcctctattgaacagaaggaggagagccgtgggaatgaggaccatgtggttttgattaaggactatcgtggtaagatcgaggctgagcttagcaagatatgcgacgggatccttaaactgctagactcccaccttgtcccgtctgccgctactgctgagtcgaaggtcttctaccttaagatgaagggtgattatcacaggtatcttgctgagttcaagacaggggtggagaggaaggaggctgccgagaatacacttttggcatacaagtcggcccaggatattgctcttgctgacctagctccgactcatccaattcggctaggcctggcccttaacttctccgtattctattacgagatcctgagttccccagaccgtgcttgcaatctagcaaagcaagctttcgatgaggctatctctgaactggatactttaggtgaggagtcatacaaggacagtacattgatcatgcaacttttacgtgataacttgacactatggacctctgatattacggaggatgctggggatgagattaaagaggcccccccgaagcgcgattcggtcgagggtcagtgatacggtaatgcgagggtctcttaattcaaatcaagtcgggctgcattgccatgttacccaggggtgtgttgtttctgtagtatagatgttagctgtcgttcacatattcctgggaggtgttactttgaagttgctttggggtgtgtgtggttactttgaagttgctttggggtgtgtggttgtccttcaaacaagcatgctttaatggtcgattgccattataacctaataattctgttatggtttagttttataattatcattttttaagtgccagc

SEQ ID NO: 465 - protein, 263 aa, Lilium longiflorum
MSPVESSRDESVYMAKLAEQAERYEEMVEFMEKVAKTVDAGEELTVEERNLLSVAYKNVIGARRASWRIISSIEQKEESRGNEDHVVLIKDYRGKIEAELSKICDGILKLLDSHLVPSAATAESKVFYLKMKGDYHRYLAEFKTGVERKEAAENTLLAYKSAQDIALADLAPTHPIRLGLALNFSVFYYEILSSPDRACNLAKQAFDEAISELDTLGEESYKDSTLIMQLLRDNLTLWTSDITEDAGDEIKEAPPKRDSVEGQ

SEQ ID NO: 466 - DNA, 1162 bp, Lilium longiflorum
  CDS (10)..(792)
acgcggggaatggcgacggagaaggaacgggagaaccatgtctacctggccaagctcgctgagcaggctgagcgctacgatgaaatggttgagtacatgaagtatgtggctaagctggatatggaactgactgttgaggagaggaacctactctctgtgggctacaagaatgtgattggggctcgccgagcctcatggcggatcatgtcgtccatcgagcagaaggaagagtctaaagggaatgagcaaaatgttaaattaatcaaaggctatcgtcagaaggtcgaggatgagctcgctaagatatgtaatgatatattgacgatcattgatcaacatctgattccttcttctggatctggggaatccactgtgttctattacaagatgaagggtgattattatcgctacctcgcggagtttaagaatgagctggaaaggaaagatgcagctgatcaatcattgaaggcttatcaggctgcttcgaacactgccaatacagaccttccctcgactcatcccattcgacttggtcttgctctgaacttctcggttttctattatgaaatcatgaattctcctgaaagggcatgccacttggcaaaacaagcctttgatgaggcgattgcagaactggatacattgagtgaggagtcatacaaggatagcaccttgattatgcaattactgagggacaatcttactctctggacatctgatttacctgaagatggaggcgatgagggattcaagggcgaggaggctaaacctgccaatgatgcagagcattgacgatgacgatcatttttctgtaacctggagattgttagagtatggagccgtaattgctctgaggcgacaacgatcttcaaattggctacgctggtcggacaggttggattccggtgataggtggtggtattgtttttccccttgttacggggtcgttattttagatgaaatggtaactatttattgtctgaatctgtttaactgtcttttttttttttctctgttttttcttgtattccttcgaataccatgttcttgttagaacatcttatttagtggtatgttttaattttgcaaaaaaatattgctaatgttgttgccaataagatatgaaatttgtcttttgaaaaaaaaaaaaaaaaaaaaaaaa

SEQ ID NO: 467 - protein, 260 aa, Lilium longiflorum
MATEKERENHVYLAKLAEQAERYDEMVEYMKYVAKLDMELTVEERNLLSVGYKNVIGARRASWRIMSSIEQKEESKGNEQNVKLIKGYRQKVEDELAKICNDILTIIDQHLIPSSGSGESTVFYYKMKGDYYRYLAEFKNELERKDAADQSLKAYQAASNTANTDLPSTHPIRLGLALNFSVFYYEIMNSPERACHLAKQAFDEAIAELDTLSEESYKDSTLIMQLLRDNLTLWTSDLPEDGGDEGFKGEEAKPANDAEH

SEQ ID NO: 468 - DNA, 1071 bp, Lilium longiflorum
  CDS (81)..(863)
gcagagtacgcggggctttcatcctccactccccctttctctctcttccctctcatcattcctaacccgcggcggcgccaatgacgacggagaaggagagggagaatcatgtctacctcgctaagctcgccgagcaggcggagcgatacgacgaaatggttgagagcatgaagaatgttgctagacttgatttggatctgactgttgaggagaggaacctcctttcagtgggatacaagaatgttataggggctcgcagagcatcatggcgcatcatgtcctctattgagcagaaagaggagtcaaaagggaatgatcaaaatgttaaacttatcaagggctatcgccataaggttgaggaggagctctctaagatatgcaatgatatactgactgtcattgataagcatcttatcccttcttctggctctggggaagccactgtcttctactacaaaatgaagggtgattattaccgctatctggctgagtttaagaatgagcatgaaaggaaagaagctgccgatcagtcgatgaaagcttatcaggctgcttccaacacagccaacactgatcttccctcgactcatcccatccgacttgggcttgctctcaatttctcagtcttctattatgaaatcatgaattctcctgaaagggcttgccatttagcaaagcaggcctttgatgaggcaattgcagaactggacaccttgagtgaggagtcttacaaggacagcactttgattatgcagttactgagggacaatctcactctttggacttctgacttacctgaggatggaggtgatgatggtttcaagggtgaggaggccaaagctgctggtgatgatgagcactagtgatgactgttttaactcccgacttggagattcctagtagtggcggataatggctgagcaacaaacttcaagtgggtttttctggttcaatgggagggattccaatttatcaatctatggacctgtttagtgtttctcaatgttatcgtctatacaatatgttaaccttttttcgattctcaaaaaaaaaaaaaaaaaaaaaaaaaaa

SEQ ID NO: 469 - protein, 260 aa, Lilium longiflorum
MTTEKERENHVYLAKLAEQAERYDEMVESMKNVARLDLDLTVEERNLLSVGYKNVIGARRASWRIMSSIEQKEESKGNDQNVKLIKGYRHKVEEELSKICNDILTVIDKHLIPSSGSGEATVFYYKMKGDYYRYLAEFKNEHERKEAADQSMKAYQAASNTANTDLPSTHPIRLGLALNFSVFYYEIMNSPERACHLAKQAFDEAIAELDTLSEESYKDSTLIMQLLRDNLTLWTSDLPEDGGDDGFKGEEAKAAGDDEH

SEQ ID NO: 470 - DNA, 1155 bp, Hordeum vulgare
  CDS (75)..(866)
aggagaccagcggcgacgcaggcgcaaaacgcagatttggcattcagaaaaaattaaagcagtaaactgtgaagatgtcggcaccaggggagctttcccgtgaggagaatgtgtacatggctaagctcgccgagcaggctgagaggtacgaggagatggttgagttcatggagaaggtggccaagaccgtcgactccgaggaactcactgtggaggagcgcaacctcctctctgttgcatacaagaatgtgattggagcccgccgtgcctcatggcgcatcatctcctccattgaacagaaggaggagagccgtggcaacgaggaccgggtcacactcatcaaggaataccgtggcaagatcgaaactgagcttagcaagatatgtgatggcattctcaagctgcttgaaacccaccttgttccgtcttccactgcccctgagtccaaggtcttctatcttaagatgaagggtgactactacaggtatcttgcggaattcaagagtgggcctgagaggaaggatgctgctgagaataccatggtggcatacaaggctgctcaggatattgctttggctgagctggctccaacacatccgattaggcttgggctggcactaaacttctcagtgttctattatgagatcctcaactcgcctgatcgtgcttgcaatcttgcaaagcaggcattcgatgaggccatttcggagctggacacactaagcgaagaatcctacaaggacagcaccttgatcatgcaactccttcgtgataacttgaccctctggacttccgacatcacggaggacaccgcggaggaggagatcagggaggctccgaagcatgactcgagcgaggggcagtaaagccggctttgcgacgccccgcaagctactagctagtgctcgctactgtcaatgacgttgcatgcaatgtggtctggatcgtgtcgtagccgtgtgttatggttgttgttgcaagatttggggctccccgtatgtgatgttgccggggaaggttgtggtcgctgcctgtaggcggctgcctcctggtctggcttgggggggagccacatgcactgctggtggtcgtggccgttcgtattttcgttctgccttaatgttgcttcttatcgtggaaaaaaaaaaaaaaaaa

SEQ ID NO: 471 - protein, 263 aa, Hordeum vulgare
MSAPGELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 472 - DNA, 1083 bp, Fritillaria agrestis
  CDS (51)..(830)
gaacagctactcgctcccatccagggtttcaacgccttccaggtttcaggatgtcgccggcggagccatcgcgggaggagaacgtgtacatggcgaagctggcggagcaggccgagcgctacgaggagatggtggagttcatggagaaggtggcccgcacggtggacaccgaggagctcactgtcgaggagcgcaacctcctgtcagtggcgtacaagaacgtcatcggcgcccgccgcgcctcgtggcggatcatttcgtcgatcgagcagaaggaggagagccgcgggaacgaggatcatgtcgcgttgatcaaggattaccgcgggaagatcgaggccgagctgagcaagatctgtgatgggatcctcaagctgcttgactcgcatctggtgccgtcttcgacggcggcggagtcgaaggtgttttacctcaagatgaagggcgactaccacaggtaccttgcggagttcaagtctggggctgagaggaaggaggctgcggagagcacgctcttggcctacaagtcggctcaggacattgctctggcggagctggcgcctactcatccgatcaggctcgggctggcgcttaacttctcagtcttctactatgaaattctgaactctccggaccgtgcttgcaatctagcaaagcaggcctttgatgaggctatctcggagctagacactttgggtgaggaatcgtacaaggacagcacactgatcatgcagcttctccgagacaatctgactctgtggacctccgatatcaatgaggaggccggggatgagattaaggaagcctcaaaagcaggagagggacagtaatgaaccatggtaaaccgctgtgctgttggagtttttgttttttatttttgtttccgctggagttgtagttaggatatttatgctcaacaaacctattgtgtggcttttgaatttacctcccatcatttttattgtggattgttgttctagttgaacaaggtttggttcctatgcaatacttcatttcagttaatatcatgtgggctcgaaaacaagtgattttcaataattatgtagtgctgcataaaaaaaa

SEQ ID NO: 473 - protein, 259 aa, Fritillaria agrestis
MSPAEPSREENVYMAKLAEQAERYEEMVEFMEKVARTVDTEELTVEERNLLSVAYKNVIGARRASWRIISSIEQKEESRGNEDHVALIKDYRGKIEAELSKICDGILKLLDSHLVPSSTAAESKVFYLKMKGDYHRYLAEFKSGAERKEAAESTLLAYKSAQDIALAELAPTHPIRLGLALNFSVFYYEILNSPDRACNLAKQAFDEAISELDTLGEESYKDSTLIMQLLRDNLTLWTSDINEEAGDEIKEASKAGEGQ

SEQ ID NO: 474 - DNA, 1176 bp, Maackia amurensis
  CDS (31)..(816)
tcgaaaaacctaatttggaagagatcggtgatggcttcctccaaggagcgcgagaccttcgtctacgtcgccaagctcgccgagcaggccgagcgatacgaagagatggtggattcaatgaagaacgttgcgactctagatgttgagttgacagttgaagagaggaatttgctttctgttggttataagaatgtgattggtgctcgcagagcctcgtggagaatcctatcttccatagagcaaaaggaagaagcaaaaggaaatgaagtaaatgcgaaacggattaaggagtacaggcaaaaggttgaatctgagcttacaaacatctgtaacgatgttatgagagtgattgatgaacaccttataccttctgcttcagctggtgaatcaactgtgttttattataagatgaaaggagattattatcgttatcttgctgaatttaagacaggcaatgagaagaaggaggctggtgatcagtcaatgaaagcatacgagtctgctaccgctgcagctgaggctgaattaccccccacacatcccatccgtttgggtctggctttaaatttctctgttttttattatgagatcttgaattcaccagagagggcctgtcatcttgcaaagcaagcttttgatgaagctatttcagagcttgacaccttgaatgaggagtcatacaaagatagcaccttgatcatgcaacttctcagggacaaccttactttgtggacttctgacatcccagaagatggagaagatgcccagaaagcgaatggcactgccaagcttggcggaggcgaggatgcagagtgagactgattgtgggtggcaccttccttaggatttgatgcatgtgtttggaaatgaaaaaggagggctgattacccatctgtgtattagctagagatagggttccattgtttcttctttctctgtttcttgttgattggccacactcccccaatagggataaaagaaactccatttgtgctatatattatggtctgtttttatttatgtggtgtctggaaacggcctgtttcattcctaagcttttcctcctgtctgggggattgattgatgaggattgcttatggagttatggtgtatttcctgttccaatgaaatgatacaactttatatggagatactgctaaaaaaaaaaaaaaaaaa

SEQ ID NO: 475 - protein, 261 aa, Maackia amurensis
MASSKERETFVYVAKLAEQAERYEEMVDSMKNVATLDVELTVEERNLLSVGYKNVIGARRASWRILSSIEQKEEAKGNEVNAKRIKEYRQKVESELTNICNDVMRVIDEHLIPSASAGESTVFYYKMKGDYYRYLAEFKTGNEKKEAGDQSMKAYESATAAAEAELPPTHPIRLGLALNFSVFYYEILNSPERACHLAKQAFDEAISELDTLNEESYKDSTLIMQLLRDNLTLWTSDIPEDGEDAQKANGTAKLGGGEDAE

SEQ ID NO: 476 - DNA, 1107 bp, Solanum tuberosum
  CDS (25)..(789)
ggccgctcaaatattgaatccattatggcgcgtgaggagaatgtgtacatggcgaagcttgctgagcaagctgaaagatacgaagaaatggtgcagttcatggagaaagtttcaacttcattaggctcagaggaactcaccgttgaggaacggaatctcctttccgttgcttacaaaaacgttatcggggctcgtagagcctcgtggcgtattatctcttccattgaacagaaggaggagtcgaggggaaatgaggaacatgttaaatgtataaaggagtacagatctaagattgaatctgaactttctaatatttgtgatggaattctcaagctccttgattctaatctcattccttcagcttctaatggcgattctaaggtgttttaccttaaaatgaagggtgattatcatcgttatttggctgaatttaagaccggagctgaacgtaaggaagctgctgagagcactctctccgcctacaaagctgctcaggatattgcaaatactgaacttgccccaacacatccaatccgacttggactggctctcaacttctctgtgttttattatgagattttgaactctcctgaccgtgcttgcaatcttgctaaacaagcatttgatgaagcaattgccgagttggacacactgggagaagaatcttacaaggatagcactttgatcatgcaacttcttcgtgacaatctcactctctggacctctgatatgcaggatgatggtgctgatgaaattaaggaaaccaaacccgacaatgaacaacagtgagggaactggtcctcagattatcatttgacttcttcctggttgtttttattgggagaagctgcttctttttatttctttcacctgtgtttcaggtttccctttagcgttctcttatccatggcaacgaacaactttgaatattgatgttcaattgtttcatctttactttaatgtggttctttctggtgcttagtttctatgaaagcatttcagttgtatttgtgaactgaatttataaaatggtatgtcaaagtgatactcagcaatcgggtttcaatcaaaaaaaaaaaaaaaaaaaaaaaaaaaaaaaaaaaaaaa

SEQ ID NO: 477 - protein, 254 aa, Solanum tuberosum
MAREENVYMAKLAEQAERYEEMVQFMEKVSTSLGSEELTVEERNLLSVAYKNVIGARRASWRIISSIEQKEESRGNEEHVKCIKEYRSKIESELSNICDGILKLLDSNLIPSASNGDSKVFYLKMKGDYHRYLAEFKTGAERKEAAESTLSAYKAAQDIANTELAPTHPIRLGLALNFSVFYYEILNSPDRACNLAKQAFDEAIAELDTLGEESYKDSTLIMQLLRDNLTLWTSDMQDDGADEIKETKPDNEQQ

SEQ ID NO: 478 - DNA, 1163 bp, Solanum tuberosum
  CDS (174)..(953)
actctagaaataaaagtaaaaacaaaatcctaaaatctctctactcctctcaattcaaaaaaagccctctttctctcaattttaaattcaattcagaaaatcgaaaaactctctcatttcattcagatctcaaaaaacttatttccgagaacacagagaaaaaaaatctaaacatggcggtggcaccgacggcgcgtgaggagaacgtatacatggcaaagctggcggagcaggccgagaggtatgaagagatggttgaattcatggagaaggtctccaactcccttggctcggaagaactaaccgtggaggagagaaaccttctctccgtcgcatataagaatgtaatcggagcgcgtagggcatcgtggcgtatcatttcatcgatcgagcaaaaggaagagtctagaggaaatgaggaacatgttaactctatccgcgagtacagatctaagattgagaatgagctctctaagatctgtgatggcattctcaaattgcttgattctaagcttattccttctgcaacatctggtgattctaaggttttttacctgaaaatgaaaggagattaccaccgctatttggctgagttcaagaccggtgctgaacgtaaggaggctgctgagagtactctcactgcctacaaagctgctcaggatatcgcatctgctgagcttgccccaacacatcccatccgacttggactggctcttaacttctctgtgttttattatgagatcttgaactctcccgaccgtgcttgcaaccttgccaaacaggcctttgatgaagcaattgctgagttggacacattgggagaggagtcttacaaggatagcactttgatcatgcaacttcttcgtgacaatctcactctctggacctccgatatgcaggatgatggggctgatgaaatcaaggaagatcccaaacctgaagaaaaaaattgaggggaattgaaaccctctaatttgcttttcacttctcccccagttgttttaattgggagaagctgattatcataatttccttgctagtattatgattttccattaagaggttctcttcttattggcaaaaaacaacttttatattgatgttttaaaagttccatcttttaatttaatgtggttcttgaggttaaaaaaaaaaaaaaaaaa

SEQ ID NO: 479 - protein, 259 aa, Solanum tuberosum
MAVAPTAREENVYMAKLAEQAERYEEMVEFMEKVSNSLGSEELTVEERNLLSVAYKNVIGARRASWRIISSIEQKEESRGNEEHVNSIREYRSKIENELSKICDGILKLLDSKLIPSATSGDSKVFYLKMKGDYHRYLAEFKTGAERKEAAESTLTAYKAAQDIASAELAPTHPIRLGLALNFSVFYYEILNSPDRACNLAKQAFDEAIAELDTLGEESYKDSTLIMQLLRDNLTLWTSDMQDDGADEIKEDPKPEEKN

SEQ ID NO: 480 - DNA, 958 bp, Solanum tuberosum
  CDS (67)..(816)
aaacttcaaaacaccaaaaggaaaaaagggaaaaatttctccggcggaaattaccggcgaccgacgatggccttgcctgaaaatttaaccagagagcagtgtttgtacttagcgaagctagctgagcaagccgaacgatatgaggagatggtgaagttcatggacaagctcgtaatcgggtcgggttcgtcggagctgacggtggaagagcgaaacctcctttcggtggcgtataagaacgttatcggctcacttcgagcagcgtggaggattgtgtcgtcaattgagcagaaggaggaaggtaggaagaacgatgagcatgtggttctagtgaaggattacagatctaaagttgaatctgagcttagtgatgtttgtgctggaattctgaagattttggatcagtatttgattccttcagcttctgctggcgaatcgaaggtgttttatttgaagatgaaaggggattattatcgttatttagctgaattcaaagttggaaatgaacgtaaggaagctgctgaggatactatgcttgcctacaaagctgctcaggacattgctgttgcggagcttgcccccacacatccgatacgacttgggttagctctcaacttctcagtgttctactatgagattctgaatgcatcagaaaaagcatgcagcatggctaagcaggcatttgaggaagctattgctgaactggacacgttgggtgaggaatcctacaaggatagtacacttatcatgcagttgttaagggacaatctcactctctggacttctgatatgcaggagcagatggacgaggcttgacatgataccgctcctccaagagggtgagctcaaatgtcacaacaacagtgtgtaaaatctacctatgcaattagatgcttttgtaatttttatatgccctgcttactttgatgattttcttggtttcaaactttcgtttgat

SEQ ID NO: 481 - protein, 249 aa, Solanum tuberosum
MALPENLTREQCLYLAKLAEQAERYEEMVKFMDKLVIGSGSSELTVEERNLLSVAYKNVIGSLRAAWRIVSSIEQKEEGRKNDEHVVLVKDYRSKVESELSDVCAGILKILDQYLIPSASAGESKVFYLKMKGDYYRYLAEFKVGNERKEAAEDTMLAYKAAQDIAVAELAPTHPIRLGLALNFSVFYYEILNASEKACSMAKQAFEEAIAELDTLGEESYKDSTLIMQLLRDNLTLWTSDMQEQMDEA

SEQ ID NO: 482 - DNA, 702 bp, Ostreococcus tauri
  CDS (1)..(702)
atgtccggcgacggcgacgacgacgcgcgcgcgttatcgcgcgaggatctcgtgtacaaggcgaagctcgcggagcaggcggagcggtatgaagagatgatggattgcatgagcgaggtgacgctcaagtcgggcgaagaagagctgagcgtggaggagcgcaacttgctgagcgtggcgttcaagaacgtcatcggcgcgcgtcgcgcgtcgtggcgcatcgtgagctcgatcgagaccaaggaggaggcgaagcacggtaaggatagcgataagtgcaagttgatcgcttcttataaggcgaacgtcgagaaggagctcacgtccatctgcacgagaattctggatctgctcaagaaccacctggaggaccggtgttcggcgggcgagtccaaggtgttttacaagaagatgaagggcgactactggcgctacttggccgagttcaagggaggggcggaacgcaaggaagcggccgaggagactctcttggcgtacaagagcgccgagcaaaccgcgaggcggagctgcaatcctgaacgcgccggaacgcgcgtgccaaatggcgaagaaagcgtttcgatgaagcgatcagacagcaccctcatcatgcagctcttacgcgacaacttgactctgtggaccagcgacatgaacgactcgcaagctaccgggggcgccgaggaggaagatgatgaatga

SEQ ID NO: 483 - protein, 233 aa, Ostreococcus tauri
MSGDGDDDARALSREDLVYKAKLAEQAERYEEMMDCMSEVTLKSGEEELSVEERNLLSVAFKNVIGARRASWRIVSSIETKEEAKHGKDSDKCKLIASYKANVEKELTSICTRILDLLKNHLEDRCSAGESKVFYKKMKGDYWRYLAEFKGGAERKEAAEETLLAYKSAEQTARRSCNPERAGTRVPNGEESVSMKRSDSTLIMQLLRDNLTLWTSDMNDSQATGGAEEEDDE

SEQ ID NO: 484 - DNA, 1319 bp, Triticum aestivum
  CDS (86)..(871)
ccgagatccgcagcccgaagcccgtgagaaaagcgaagcgcgagaggaaaggcactgaactagtttgcaacaaagaagagggaaaatgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcaacaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctgagggagaggggcactgattggccctcgagcgtgcccaagtttatttctgagtccatttacgcagctacctgtatcattcggatcataagatgtactagggtcggttgcactatgtgaatcataagatgtggtaggatggtgctatgcgaagcgtgtcgagctgaagtacctagtggactacagtcatgagacggtcatgtgacatcgtcgcttcttagttcattagcagatttcaaactatttcctgtattgcagcacattattagtattgctgtattagcaattttcatggcttgttgatgattgatcatacttggcgtcaagcacccccaaagcttgcctttcttatgaagcaacaactgagtttttcttgtctacttccctctcaaaataattgacttctaggattcttctaattcaaaaagtttgatcattttgacatgaaattaaaaaaaaaaaaaaaaa

SEQ ID NO: 485 - protein, 261 aa, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELNKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 486 - DNA, 801 bp, Phaeosphaeria nodorum
  CDS (1)..(801)
atgggttacgaagactccgtgtacctggccaagctggctgagcaggccgagcgctatgaggagatggtcgagaacatgaaggccgttgcctctgcagaccaggagctttccgttgaggagcgaaatctcctttccgtcgcctacaagaacgtcattggtgctcgccgcgcttcgtggagaatcgtcacctcaatcgagcagaaagaggagtccaagggcaacgagacccaggttggcctcatcaaagagtaccgccagaagatcgaggccgagttggccaagatctgcgaggacattcttgagtgcctggacagccatttgattccctctgctgagagcggcgagtccaaggtcttctaccacaagatgaagggcgactaccaccgttaccttgccgaattcgccgttggtgacaagcgcaagacgtccgctgacaagtccctcgaggcctacaaggctgccacagatgtggccgcctcgaaccttgctcccactcaccccatccgcctcggtctcgcactgaacttctccgtcttttactacgagatcctcaactcgcccgaccaggcttgccaattggccaagcaggctttcgatgatgccatcgctgagctcgataccctgtctgaggagagctacaaggactctactctcatcatgcagctcctcagggacaacttgaccctctggacttcttccgaggccgagccatctgccgaggcacccgctgctgctgctgagcccgccgccgaagcgcccaaggcagaggccaccgagcccgccgctgaggccaaggcataa

SEQ ID NO: 487 - protein, 266 aa, Phaeosphaeria nodorum
MGYEDSVYLAKLAEQAERYEEMVENMKAVASADQELSVEERNLLSVAYKNVIGARRASWRIVTSIEQKEESKGNETQVGLIKEYRQKIEAELAKICEDILECLDSHLIPSAESGESKVFYHKMKGDYHRYLAEFAVGDKRKTSADKSLEAYKAATDVAASNLAPTHPIRLGLALNFSVFYYEILNSPDQACQLAKQAFDDAIAELDTLSEESYKDSTLIMQLLRDNLTLWTSSEAEPSAEAPAAAAEPAAEAPKAEATEPAAEAKA

SEQ ID NO: 488 - DNA, 959 bp, Arabidopsis thaliana
  CDS (32)..(790)
aattcgagagagaagagagaaaggagaagctatggagaacgagagagcgaagcaagtgtacttggcgaaactcaacgagcaagctgagagatacgatgagatggttgaagcaatgaagaaagttgcagctcttgatgtagagctcaccattgaagagaggaatcttttatctgttggttacaaaaatgtgattggtgctaggagagcatcgtggaggatcctttcttcgatcgagcagaaagaagaatcgaaaggaaacgaacaaaatgccaagaggattaaggattacaggacaaaagttgaagaagaactctccaagatttgttacgatattttggctgtcatcgataagcatcttgtcccattcgcaacttcgggagaatccaccgtcttctactacaaaatgaaaggaggttatttcagatacttggctgaatttaagtccggtgctgatcgcgaggaagctgcggacctatcactcaaggcgtatgaagctgcaacgagttctgctagcacggaattgtctacaacacatccaataagactcggcttggctctcaacttttctgtcttctactacgagatcttgaattctccggaaagagcatgtcatttggcaaagcgagcgtttgatgaagcaatcgctgagcttgacagtcttaacgaagattcatacaaggacagcacacttatcatgcaacttctcagagataacctcactttatggacctctgatctagaggaaggaggtgaacaatctaaaggccataatcaacaagatgagaactaatgaagtggagaacttagttacggagccatacattcatttggcaccgagcggtttcaacttctcttcttgcgaacgattgctttaaaccatcatttgttaccctctttttcttttggatttatgttttttttttttaatcgaaatgaaaacttatgtgtcaaaaaaaaaa

SEQ ID NO: 489 - protein, 252 aa, Arabidopsis thaliana
MENERAKQVYLAKLNEQAERYDEMVEAMKKVAALDVELTIEERNLLSVGYKNVIGARRASWRILSSIEQKEESKGNEQNAKRIKDYRTKVEEELSKICYDILAVIDKHLVPFATSGESTVFYYKMKGGYFRYLAEFKSGADREEAADLSLKAYEAATSSASTELSTTHPIRLGLALNFSVFYYEILNSPERACHLAKRAFDEAIAELDSLNEDSYKDSTLIMQLLRDNLTLWTSDLEEGGEQSKGHNQQDEN

SEQ ID NO: 490 - DNA, 1186 bp, Manihot esculenta
  CDS (89)..(883)
gggggacggacgagtgtgaactcttcatcaattcatcccaattccaaaacatttccaagaaattacgttttagtttgatatatcaaggatgttgcccactgaatcatcacgtgaggaaaatgtctacatggccaagttggctgaacaggctgaacgttatgaggaaatggtggagtttatggaaaaggttgcaaagacagtggatgtggaggagctaactgtggaggaaaggaatcttctctctgtcgcttacaagaacgtcattggggctagaagggcttcatggaggataatctcttccattgagcagaaggaagagagcagaggaaatgaggatcacgtgtcaataattaaggagtacagaggtaagattgaagctgagctgagcaagatttgtgatgggatcttgagcctccttgagtcgcatctcattccctctgcctcatctgctgagtctaaggtattctacctcaagatgaagggtgattatcaccggtatcttgcggagttcaagactgcagctgagaggaaggaagctgctgagagtactttgttggcatacaagtctgcccaggatattgcccttgctgatctcgctcctacccacccaataaggcttgggcttgcccttaacttctccgtgttctattatgagatcctaaactcacctgaccgtgcttgtaatctagccaagcaggcctttgatgaggctatttctgagctggatacattgggtgaggaatcttacaaggatagtacattgatcatgcaacttctccgagacaatctgacgctctggacttctgatatcacggacgaagctggggatgagatcaaggatgcatcaaaacgggaatcaggcgagggacagccgcaacagtgatgagttaaattcgtaggacgtgtaatgtgtacttctatatcttgtgacttctgagtagatgccatcatctggtggttgtagcttggattgcttgatgaatttggtaattctgagtgctgctgtgcactgaggattgaaatgttctggcaattatcaaccttctactattgattttagaatggaagttggtatttcttattgctcaagttcttccatgtgatgatgttgaaactaggaatttccataccgcataccccacacaattctttatataaaaaaaaaaaaaaaaaaaaaaaaaaaaaa

SEQ ID NO: 491 - protein, 264 aa, Manihot esculenta
MLPTESSREENVYMAKLAEQAERYEEMVEFMEKVAKTVDVEELTVEERNLLSVAYKNVIGARRASWRIISSIEQKEESRGNEDHVSIIKEYRGKIEAELSKICDGILSLLESHLIPSASSAESKVFYLKMKGDYHRYLAEFKTAAERKEAAESTLLAYKSAQDIALADLAPTHPIRLGLALNFSVFYYEILNSPDRACNLAKQAFDEAISELDTLGEESYKDSTLIMQLLRDNLTLWTSDITDEAGDEIKDASKRESGEGQPQQ

SEQ ID NO: 492 - DNA, 816 bp, Cleome spinosa
  CDS (1)..(816)
atgtcgcctgccgatttgacccgggaagagaatgtgtacatggccaaattggcggagcaagctgaacgttacgaggaaatggtggagttcatggaaaacgtagcgaagactgtggacacagaggagctcacggtcgaagagaggaacctattgtctgttgcttacaaaaatgtgattggtgcgaggagggcttcgtggaggatcatctcttccattgaacagaaagaagaaagcagggggaatgaggaccatgtttcgacaatcaaggaatacagaggcaagatcgaagctgaactcagcaagatatgtgatggcattttgaaccttcttgagactcacctcattccttgtgcatcatctgcggagtcaaaggtcttctacctcaaaatgaagggtgattaccacaggtacctcgccgagtttaagactggtaccgagaggaaggaagccgctgagaacactctgttggcctacaagtccgcacaggatattgctcttgcagaactggctcccactcacccaatcagattggggctagcgcttaacttctctgtcttctactatgaaattctcaactcacctgatcgtgcttgcaatctggctaagcaggctttcgacgaggcaatctctgagttggacacgttgggagaggaatcatacaaggacagtacattgatcatgcaactcctccgggacaacctcaccctatggacttctgacatcaatgacgaggctggcgacgagatcaaggatgcctcaaagcaggagtcagaagaggggcaggaggctcagacagcagccccaccggcacattga

SEQ ID NO: 493 - protein, 271 aa, Cleome spinosa
MSPADLTREENVYMAKLAEQAERYEEMVEFMENVAKTVDTEELTVEERNLLSVAYKNVIGARRASWRIISSIEQKEESRGNEDHVSTIKEYRGKIEAELSKICDGILNLLETHLIPCASSAESKVFYLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDINDEAGDEIKDASKQESEEGQEAQTAAPPAH

SEQ ID NO: 494 - DNA, 819 bp, Cleome spinosa
  CDS (1)..(819)
atgtcgccttctgattcgacccgggaagagaatgtttacatggccaagctggccgagcaagctgaacgctacgaggaaatggtggagttcatggaaaaggttgcaaacacaggcgacactgaggagcttactgtcgaagagaggaacctcttgtccgttgcttacaagaatgtgattggtgcgaggagggcttcgtggaggattatatcttccattgagcagaaggaagaaagcaggggaaacgaggaccacgtctcgatgatcaaggagtacagaggcaagatcgaagctgagctcagcaagatctgtgatggcattttgaaccttctcgagtctcacctcattccttctgcatcctctgccgagtccaaggtcttctacctcaaaatgaagggtgattatcacaggtacctcgccgagtttaagaccggagccgagaggaaggaagcggctgagagcactctgttggcctacaaatccgctcaggatatcgctctcactgaactggctcctactcacccgatcagattgggacttgcgcttaacttctctgtcttttactacgaaattctcaattcacctgatcgtgcttgtaaccttgctaagcaggcttttgacgaggcaatctctgagttggacacgttgggagaggaatcatacaaggacagtacattgatcatgcaactcctccgtgacaacctgaccctctggacttccgacatcaacgacgaggccggagatgagatcaaggatgcctcgaaaggggaatcggaagaggggcaacaggcggcgcaggcagcagctccaccagcgcagtga

SEQ ID NO: 495 - protein, 272 aa, Cleome spinosa
MSPSDSTREENVYMAKLAEQAERYEEMVEFMEKVANTGDTEELTVEERNLLSVAYKNVIGARRASWRIISSIEQKEESRGNEDHVSMIKEYRGKIEAELSKICDGILNLLESHLIPSASSAESKVFYLKMKGDYHRYLAEFKTGAERKEAAESTLLAYKSAQDIALTELAPTHPIRLGLALNFSVFYYEILNSPDRACNLAKQAFDEAISELDTLGEESYKDSTLIMQLLRDNLTLWTSDINDEAGDEIKDASKGESEEGQQAAQAAAPPAQ

SEQ ID NO: 496 - DNA, 792 bp, Medicago truncatula
  CDS (1)..(792)
atggcttcttccaccaacgtccgtgagaactttgtctatgttgcaaagctagcagaacaagctgaacgctatgatgaaatggtggaggcaatgaagaaactggccaagatggatgttgaactaagtgtggaagagagaaatttgttctctgttgggtacaagaatgtggtggggtctagaagagcttcatggaggatcttatcatcaattgagcagaaagaagaatcaaaagggaatgaattgaatgttaagcgtattaaggagtataggcagaaggtggaggtggagctttccagcatttgcaatgacattatgattattattgatgagcatcttattccatccactaatattgctgaatccacagtgttttattataagatgaaaggtgattattatcggtatttggcggaattcaaagctggtgatgaaaagaaagaggtggcggatctgtcacttaaagcatatcagacagcttctgcaactgctgagaatgaattacaaccaacacatcctatccgattgggtctggctctaaatttctcagtgttttattatgagataatgaattcacctgaaagggcctgtcaccttgcaaagcaagcctttgatgatggtgtctcagaactggataccctaaatgaagattcttacaaggacagtaccttgatcatgcagctgttgcgagacaaccttactttatggacttctgatatcccagaagatggtgaggatcaaaaaatggaaagcgcaactaagagcggtcaagatgaagacgaattgggacgctaa

SEQ ID NO: 497 - protein, 263 aa, Medicago truncatula
MASSTNVRENFVYVAKLAEQAERYDEMVEAMKKLAKMDVELSVEERNLFSVGYKNVVGSRRASWRILSSIEQKEESKGNELNVKRIKEYRQKVEVELSSICNDIMIIIDEHLIPSTNIAESTVFYYKMKGDYYRYLAEFKAGDEKKEVADLSLKAYQTASATAENELQPTHPIRLGLALNFSVFYYEIMNSPERACHLAKQAFDDGVSELDTLNEDSYKDSTLIMQLLRDNLTLWTSDIPEDGEDQKMESATKSGQDEDELGR

SEQ ID NO: 498 - DNA, 780 bp, Medicago truncatula
  CDS (1)..(780)
atggcttcaaccaaggaacgtgaaaacttcgtctacatcgccaagctcgctgaacaagctgaacgctatgaagaaatggtggaagcaatgaagaatgtggcgaagctagatgttgagttgacagtggaagagagaaaccttctatcagttggctacaagaacgtagtgggtgctcatagggcttcatggaggattctatcctcaattgagcataaggaagaatctaaagggtatgatgtgaatgtgaagaggataaaggagtatagacacaaggtggaatctgaattatccaatatatgcagcgatatcatgtctattattgatgatcatcttattccgtcgtcctctgctggtgaatctagtgtctttttctataaaatgaaaggggattattatcggtatttggcggaatttaagaacggtgatgaacgaaaagaggctgctgatcattccatggaagcatatcagactgcttccactgcagcagaaggggagttacctcccacgcatcccattcgattgggcttggctttgaacttctctgtcttttattatgaaattttgaactctcctgaaagggcatgtcaccttgctaagcaggcatttgatgaagcaatctctgagttggatactcttaatgaggagtcttacaaagacagcacattgattatgcagcttctaagggacaacctcacattgtggacttctgacatccctgaagatggagatgaggaacataaggtggaatcttcaggagctgttggaggtgaaaatgcatag

SEQ ID NO: 499 - protein, 259 aa, Medicago truncatula
MASTKERENFVYIAKLAEQAERYEEMVEAMKNVAKLDVELTVEERNLLSVGYKNVVGAHRASWRILSSIEHKEESKGYDVNVKRIKEYRHKVESELSNICSDIMSIIDDHLIPSSSAGESSVFFYKMKGDYYRYLAEFKNGDERKEAADHSMEAYQTASTAAEGELPPTHPIRLGLALNFSVFYYEILNSPERACHLAKQAFDEAISELDTLNEESYKDSTLIMQLLRDNLTLWTSDIPEDGDEEHKVESSGAVGGENA

SEQ ID NO: 500 - DNA, 849 bp, Medicago truncatula
  CDS (1)..(849)
atgtcgacagagaaagagcgagaaactcaggtttacatggccaagcttgctgaacaggccgaaagatacgaagaaatggttgagtgcatgaagacaatagcaaaacttgatgttgagctaactgtggaagagaggaatcttctctcggtgggatataaaaatgtcattggtgcaaggagagcctcgtggcgcattatgtcttcaattgaacagaaagaagaggctaagggaaatgagaacaacgtgaaactgatcaagagctattgccaaaaggttgaggaggaactatcgaaaatttgcagcgacattctcgaaattattgacaaacatctgattccttcttccaccacaggggaagctactgttttctactacaagatgaaaggtgactattatcgatatcttgctgagttcaagaacgatcaagataggaaggaggcagctgatcagtcactgaaggcatatgaggctgcttccgccactgcaagcacagatcttccatcaacacatccaatccgtcttggacttgcactcaacttctctgtcttctactatgagataatgaactctcctgaaagggcctgtcatttggctaaacaagctttcgatgaggcaattgcagatttagataccttgagtgaagagtcatacaaggacagtactttaatcatgcagttgttgagagacaacctaactctttggacctctgatttacctgaggatggaggtgaagaactcaaatcagaagaagtcaaacctgctgaaccagaggtatggcaacaaagcagggcggacatcttcctcgtccccaaacccaatggggttaggatatccatgtatctgtcttga

SEQ ID NO: 501 - protein, 282 aa, Medicago truncatula
MSTEKERETQVYMAKLAEQAERYEEMVECMKTIAKLDVELTVEERNLLSVGYKNVIGARRASWRIMSSIEQKEEAKGNENNVKLIKSYCQKVEEELSKICSDILEIIDKHLIPSSTTGEATVFYYKMKGDYYRYLAEFKNDQDRKEAADQSLKAYEAASATASTDLPSTHPIRLGLALNFSVFYYEIMNSPERACHLAKQAFDEAIADLDTLSEESYKDSTLIMQLLRDNLTLWTSDLPEDGGEELKSEEVKPAEPEVWQQSRADIFLVPKPNGVRISMYLS

SEQ ID NO: 502 - DNA, 1072 bp, Camellia sinensis
  CDS (68)..(850)
acgcggggaccctttttgtttcctctcccttcttcttctcagaccagatctcagccaaattcctccaatggcgacatcaaccccacgcgaagagagcgtctacatggccaaactggccgagcaagccgagcgctacgaagaaatggtggaattcatggaaaaagtctcctccaccgtcgtcgaatccgaggagctcacggtggaggagcgcaacctcctctccgtcgcctacaagaacgtgatcggcgctcgtcgtgcttcgtggcggatcatctcctcgatcgagcagaaggaggagtctcgcggcaacgccgaccatgtctccaccatcaaggactacaggtccaagattgagaacgagctctcttcgatctgcgacggcattctcaagcttctcgacaccaagttgatcccctccgccaccgccggtgactcgaaggtgttttatctgaagatgaagggtgattatcataggtatttggcggagttcaagactggttcggagaggaaggaggccgctgagaatactcttaatgcttataaggctgctcaggatatcgctaatacagagttggctccaacacatccaattcgactaggcctggctctcaacttttcggtgttttactacgaaattttgaattcacctgatcgagcatgcagtcttgcaaaacaggcctttgatgaagccattgcggagctggatacactggtggaggattcatacaaggacagcactttgataatgcaactccttcgtgataatctgactttgcggacctcagacacgcaggatgatggagcagaggagatcaaagaagcacccaagcacgaagaggagaagcagtaaactaactgattgttttcattttagtatttcacttctcttctgtttgtttttgaatggagaagttgtgtggaccctctatctatctggtgtggagcctctaggatttgatgtgattcttattgttttttaatttcggaatacgagtgtttacttttgtgatttaatgattagtgcctaaatccactttggtttcaaaaaaaaaaaaaaaaaaaaaaaaaaaaa

SEQ ID NO: 503 - protein, 260 aa, Camellia sinensis
MATSTPREESVYMAKLAEQAERYEEMVEFMEKVSSTVVESEELTVEERNLLSVAYKNVIGARRASWRIISSIEQKEESRGNADHVSTIKDYRSKIENELSSICDGILKLLDTKLIPSATAGDSKVFYLKMKGDYHRYLAEFKTGSERKEAAENTLNAYKAAQDIANTELAPTHPIRLGLALNFSVFYYEILNSPDRACSLAKQAFDEAIAELDTLVEDSYKDSTLIMQLLRDNLTLRTSDTQDDGAEEIKEAPKHEEEKQ

SEQ ID NO: 504 - DNA, 1423 bp, Chlamydomonas incerta
  CDS (23)..(802)
gttcctgagcgcggtagctgagatggcggtcgaccgggaggaatgcgtctacatggccaagctggccgagcaggctgagcgctatgacgagatggtggaggagatgaagaaggtggccaagctggtgcacgaccaggagctttcggtggaggagcgcaacctgctctcggtggcctacaagaacgtcattggcgctcgccgcgcttcctggcgcattatctcctccatagagcagaaggaggagagcaagggcaacgaggagcatgtccagcgcattcgcaagtaccgcactgtggtcgaggaggagctcagcaaaatctgcgccagcattctgcagctgttggacgaccacctgatccccactgcctccaccggcgagagcaaggtgttctacctgaagatgaagggcgactaccaccgctacctggcggagtttaagaccggcgctgaccgcaaggaggctgcggagcacaccctgctcgcctacaaggccgcgcaggacattgccctggtggacctcccgcccacgcaccccatccgcctgggcctggccctgaacttctccgtgttctactacgagattctgaactcgcccgagcgcgcgtgccacctggccaagcaggcgttcgatgaggccatcgccgagctggactcgctgggcgaggagtcctacaaggactcgacgctcatcatgcagctgctccgcgacaacctcacactgtggacctccgacatgcaggaccccgctgccggtgacgacagagagggcgctgacatgaaggttgaggacgctgagccctgaaaggagccccatgcagcagcagcagctggggccgggacggtagtctgagctcgttgaacaaggtattacgggagttccgtttttaggggttcaggggagtcagtcggtttcgaagtgcacacttccaacacggctggacgtgtggttcacgcacagtgctcatcacatgcattgttgtcgtggctacccggggtcgataaattctttgcctcaggtgactgggtccacacttaggaggagagatccggaggagagttgcgcttgtcgagtcggcgtgaagtggcgtttgagctttctcatcggagggctccagccacttgaaagagggccagcccaatgatgtgtctgcaaaacacgttgtgggggtgcgtacagggggccacttgacattgtgttggccgccacggcccaacgctcacgttgacgagtccgggtgcattccgtaaattcaatcgcaatgcgtaggttcatagacactagacgctcggtgttgggccgactccatacgttgggccagaccgtggcgacggcgctgtgagatggaacatgtgtgaagtgcgtgtggcgtgttgaagcgcactgatgcttgcaagatggattccattacgaaaaaaaaaaaaa

SEQ ID NO: 505 - protein, 259 aa, Chlamydomonas incerta
MAVDREECVYMAKLAEQAERYDEMVEEMKKVAKLVHDQELSVEERNLLSVAYKNVIGARRASWRIISSIEQKEESKGNEEHVQRIRKYRTVVEEELSKICASILQLLDDHLIPTASTGESKVFYLKMKGDYHRYLAEFKTGADRKEAAEHTLLAYKAAQDIALVDLPPTHPIRLGLALNFSVFYYEILNSPERACHLAKQAFDEAIAELDSLGEESYKDSTLIMQLLRDNLTLWTSDMQDPAAGDDREGADMKVEDAEP

SEQ ID NO: 506 - DNA, 1000 bp, Chlamydomonas incerta
  CDS (19)..(765)
tcatacggcaaacccataatggcggaggccaattctcgtgagctggcgctttacagcgccaagattgctgagcagtctgagcgttaccaggacatggttgaggagatgaagaaggtcgctgtgctggccaacgagcaggagctgtcggtggaggagcgcaacctgctctcggtctcctacaagaacctggtgggctcccgccgcgctagctggcgcattctgcagagcattgagcagagcgagcaagctaagggcaacgagaagcgcgtgggcatgatcaagaagtaccgcgcggtggtggagggcgagctggacaaaatctgccacgagatcctggacctgctcgacaagtacctggttcccagcgcctccacgaccgaggccgctgtcttctacctgaagatgaaggccgattaccaccgctacctgtccgagtacaagacggacgaggccaaagcggcggccgcggagttgacgctggccgcctacaaggtcgctcaggagaaggccgacgagctgcccacgaccaaccccatcaggctgggtctggccctcaacttctcggtcttctactacgaggtgatgaaccagcccgcgctggcctgctcgctggcgaagaaggccttcgatgaggctatctctgacctggactcgctgggcgaggattcctacaaggacagcgcgctcattatgcagctgctgcgggacaacctcaccctgtggacgtcagaaatgcaggacgacgacaagattaaccgggcatgagcgtagcacagcgcagctcagccttgggtgtcggggccggtttccagcggcgcgtggggggtcctcggcgagcgggagcagcagcacagccgctggaccgtttgcatcttgcgcaaccggagccgcccgcctggtggggcacgctattccatgattgtggagtcacggcaaggttattaggtacgctggtgacggcgtgagaccacgaggatggttcccaagagcgtggcgtgtg

SEQ ID NO: 507 - protein, 248 aa, Chlamydomonas incerta
MAEANSRELALYSAKIAEQSERYQDMVEEMKKVAVLANEQELSVEERNLLSVSYKNLVGSRRASWRILQSIEQSEQAKGNEKRVGMIKKYRAVVEGELDKICHEILDLLDKYLVPSASTTEAAVFYLKMKADYHRYLSEYKTDEAKAAAAELTLAAYKVAQEKADELPTTNPIRLGLALNFSVFYYEVMNQPALACSLAKKAFDEAISDLDSLGEDSYKDSALIMQLLRDNLTLWTSEMQDDDKINRA

SEQ ID NO: 508 - DNA, 1277 bp, Metarhizium anisopliae
  CDS (104)..(913)
ccacgtctgtcgtcccgtgttcagctccctcctcctgatccccctcctgaatactttctcgtccaactgccaactttccacattcgccaaaaccaccatcaaaatgggtcacgaagatgcagtctacctggccaagctcgccgagcaggctgagcgatacgaagagatggtcgagaacatgaagattgtcgcctctgaagaccgcgacctgactgtcgaggagcgcaaccttctgtctgtcgcctataagaacgtcattggtgcccgccgtgcctcctggaggatagtcacttctattgagcagaaggaggagtctaagggcaactcgtcccaggtcaccctcatcaaggagtaccgacagaagattgaggccgagctcgccaagatttgcgacgatattcttgatgtcctcgacaagcacctaattccttctgccaaatctggcgagtccaaggtcttctaccacaagatgaagggtgactaccaccgttacctcgccgagttcgccattggcgaccgccgcaaggactctgccgacaagtccctcgaggcttacaaggctgctactgaggttgctcagaccgagctccctcccactcacccgatccgcctgggtcttgccctcaacttctccgttttctactacgagatcttgaatgcccccgaccaggcttgccatcttgccaaacaggcctttgatgatgccattgctgaacttgacactttgagcgaggagagctacaaggactccactctcattatgcagcttctgcgtgacaatctgactttgtggacttcatccgaggccgagacctctggtgccgctggccaggccgatgctcccgccaaggaggagtctggggctgctgctgaggctcctgctgccgccgagcagactaaggcctctgagtaaaatgggtgattatgttgccaaaataaatgctttgatcactatggtatccggcgggctggtgtctacggagtggacggaagactcgttattttttttttgtgtttgatcaagagcttcggcatcttttaggtaaacgtgcgtatacaatggatggagacgtcgaatatgcccctacgggctggtactgaggcctaaaggagagcattttttcttggaagttctgcttttagacccttgatgcttgcgattgtctggacaaataaaaaatactaaaattgctttcaatacacgaaacaaatgggcccaaaaaaaaaaaaaaaaaaaaaaaaaaaaaaaaaaaaaaaaaaaaaaaaaaaaaaaaaaa

SEQ ID NO: 509 - protein, 269 aa, Metarhizium anisopliae
MGHEDAVYLAKLAEQAERYEEMVENMKIVASEDRDLTVEERNLLSVAYKNVIGARRASWRIVTSIEQKEESKGNSSQVTLIKEYRQKIEAELAKICDDILDVLDKHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSGAAGQADAPAKEESGAAAEAPAAAEQTKASE

SEQ ID NO: 510 - DNA, 884 bp, Glomus intraradices
  CDS (1)..(783)
atggaacgcgagaaccagacctccaacaaaaaggtttatatggctaagctcgctgagcaagccgaacgttatgatgaaatggtatcttatatgaaggatgttgcaaagcttggagtagaacttactgtagaagaacgcaatctcctctcagtcgcttataagaatgtaattggtgcccgtcgagcgtcttggagaattatttcatctatcgaacaaaaggaagaaaataagggtaatgaaacccaagttcagaagatcaaagcttaccgtcaaaaagttgaaaccgaactttcagaagtatgctcggatatccttgccgtattggacgagcatttgattccatctgctgaagccggtgaatctaaggtcttttattataagatgaaaggtgattatcaccgatatctcgctgaatttgcttcgggtgaaggacgaaaagaagccgccacccaggctcacgaagcttataaacacgcaacagatatcgcccaaactgaccttgctccaactcatcctattcgtcttggacttgcattaaacttttcagttttctactacgagattctcaattcacctgatcgcgcttgtcatcttgcaaaacaggcatttgatgatgctattgctgaactcgatactttaagtgaagaatcgtataaagatagcacattaattatgcaactacttagagataacttgaccctttggacttcagacttgcaagatgcagagggtgaaaaaccggaagaagctaaacaagaagttgaagctgaagaatctaagtagcaatagttagttaattttattaaaaaatatatatttcgcacttcatatatataaaaaaaaaaaaaaaaaaaaaaaaaaaaaaaaaaaaaaaaaaaaaaaaa

SEQ ID NO: 511 - protein, 260 aa, Glomus intraradices
MERENQTSNKKVYMAKLAEQAERYDEMVSYMKDVAKLGVELTVEERNLLSVAYKNVIGARRASWRIISSIEQKEENKGNETQVQKIKAYRQKVETELSEVCSDILAVLDEHLIPSAEAGESKVFYYKMKGDYHRYLAEFASGEGRKEAATQAHEAYKHATDIAQTDLAPTHPIRLGLALNFSVFYYEILNSPDRACHLAKQAFDDAIAELDTLSEESYKDSTLIMQLLRDNLTLWTSDLQDAEGEKPEEAKQEVEAEESK

SEQ ID NO: 512 - DNA, 1067 bp, Solanum tuberosum
  CDS (53)..(820)
cactttctctctctaaaacccctctttctctctctagaacacagaaccatcaatggcgtctccacgtgaagagaacgtgtacatggcgaagcttgctgagcaagctgaacgctatgaggagatggtagaattcatggagaaggtcgttgccgccttggacggcgaggaactaaccgtcgaggaacgcaatcttctctccgtggcatacaaaaacgtgatcggagctaggagagcatcctggcgtataatttcatcgatcgagcagaaagaggagagtcgtggtaacgaagatcacgttgcctccattaaaaaatacagatctcagatcgagaatgagctgacttcgatctgtaacggcatcctcaagttgcttgattcaaaactcatcgggtcagctgctaccggagactccaaagttttctatttgaaaatgaagggagattattaccggtacttggctgagttcaaaaccggaaccgagagaaaagaagctgcagagaatactctttcggcctacaagtctgctcaggatattgctaatggcgaattggccccaacacatccaatccgattgggtctagctctcaatttctcagtgttttactatgagatattgaattctcctgaccgtgcttgtaatctcgccaaacaggcctttgatgaggcaattgcggagcttgacaccctgggagaggagtcctacaaggatagcactttgattatgcaacttctgcgtgataacctcactttgtggacctcagatatgcaggatgatggaactgatgatatcaaagaaccatcaaaagctgataatgagtagtaacaacgtgagtgaaacctctttgcttaggattgaaaaccgatgatgtaattttactcattgatcaaaattggctgttcgtagtccttatcctgtgatttgtaatacctattacctaaaggcgttgtttcttgccatttgttgttttcatcaaagattactttttgtctcagtatttctgttgtatttggatgctctgatgaagctctcttatttcgtggaaatgaattcttatttttacgaagca

SEQ ID NO: 513 - protein, 255 aa, Solanum tuberosum
MASPREENVYMAKLAEQAERYEEMVEFMEKVVAALDGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDDIKEPSKADNE

SEQ ID NO: 514 - DNA, 786 bp, Aspergillus oryzae
  CDS (1)..(786)
atgggtcacgaagatgctgtttatctggccaagctcgccgagcaggccgagcgctacgaagagatggtcgagaacatgaaggttgtcgcctctgccgatgtagagcttaccgttgaggagcgcaatctcctgtccgtcgcctacaagaacgtcatcggtgcccgccgtgcttcctggagaatcgtcacctctattgagcaaaaagaagagtccaagggcaacgagtcccaggtcaccctcattaaggagtaccgtcagaagatcgagtctgagctcgctaagatctgcgatgatatcctcgaggttctcgacaagcacctgatcccctctgcccagagcggcgagtctaaggtcttctaccacaagatgaagggtgactaccaccgttatcttgccgagttcgccatcggtgaccgccgtaagggcgctgccgatgcctctcttgaggcctataaggccgccactgaagttgcccagactgaccttgctcctacccaccccatccgtcttggtctggctcttaacttctccgtcttctactacgagatcctcaactcccctgaccaggcttgccacctggccaagcttgctttcgatgatgccattgctgagcttgacaccctgagcgaggagagctacaaggactctaccctgatcatgcagcttctcagagacaacctgaccctctggacctcgtctgaggccgagccggctgctgagaacgcctccaccgagaagaaggaggaggcccccgctgctgagggcgagaagcccgccgctgagtaa

SEQ ID NO: 515 - protein, 261 aa, Aspergillus oryzae
MGHEDAVYLAKLAEQAERYEEMVENMKVVASADVELTVEERNLLSVAYKNVIGARRASWRIVTSIEQKEESKGNESQVTLIKEYRQKIESELAKICDDILEVLDKHLIPSAQSGESKVFYHKMKGDYHRYLAEFAIGDRRKGAADASLEAYKAATEVAQTDLAPTHPIRLGLALNFSVFYYEILNSPDQACHLAKLAFDDAIAELDTLSEESYKDSTLIMQLLRDNLTLWTSSEAEPAAENASTEKKEEAPAAEGEKPAAE

SEQ ID NO: 516 - DNA, 822 bp, Aspergillus oryzae
  CDS (1)..(822)
atgacttctgagacattcctcgcccgcctttgcgagcaggctgagcgctacgatgatcgcttcccccgcaccccttttcttgccttgctgaccccgcatcagattggaggcgagcttaccgtcgatgagcgtaaccttctttccgttgcctacaagaacgtggtcggcacccgccgtgcttcctggcgtatcatctcctccattgaacagaaggaggagtccaagggctctgagcaacacgtctcgatcatccgtgactaccgacagaagatcgaaaccgagctggagaaggtctgccaggatgttcttgacgttctggacgagtccctcattcccaaggccgagactggcgagtccaaggttttttactacaagatgaagggcgactaccaccgttatcttgctgaatttgcttctggcaacaagcgtaaggttgctgctactgctgcccacgaggcctacaagaacgccaccgacgttgcccagactgatctcacccccactcaccccatccgcttgggtcttgccttgaacttctccgtgttctactacgagatcctgaactctcccgatcgtgcctgccaccttgccaagcaggctttcgatgatgccatcgccgagcttgattcgctctcggaggaaagctaccgtgacagcacccttatcatgcagctcctgcgtgacaaccttaccctttggacttcttccgatggccaggagcccgagggtgctgcttctaaggaagacaagcctgaagaggagtctgcccctgcccccgaggacaagggtgaggaatccaagcctgccgcccctgagtcttaa

SEQ ID NO: 517 - protein, 273 aa, Aspergillus oryzae
MTSETFLARLCEQAERYDDRFPRTPFLALLTPHQIGGELTVDERNLLSVAYKNVVGTRRASWRIISSIEQKEESKGSEQHVSIIRDYRQKIETELEKVCQDVLDVLDESLIPKAETGESKVFYYKMKGDYHRYLAEFASGNKRKVAATAAHEAYKNATDVAQTDLTPTHPIRLGLALNFSVFYYEILNSPDRACHLAKQAFDDAIAELDSLSEESYRDSTLIMQLLRDNLTLWTSSDGQEPEGAASKEDKPEEESAPAPEDKGEESKPAAPES

SEQ ID NO: 518 - DNA, 768 bp, Solanum tuberosum
  CDS (1)..(768)
atggcgtctccacgtgaagagaacgtgtacatggcgaagcttgctgagcaagctgaacgctatgaggagatggtagaattcatggagaaggtcgttgccgccttggacggcgaggaactaaccgtcgaggaacgcaatcttctctccgtggcatacaaaaacgtgatcggagctaggagagcatcctggcgtataatttcatcgatcgagcagaaagaggagagtcgtggtaacgaagatcacgttgcctccattaaaaaatacagatctcagatcgagaatgagctgacttcgatctgtaacggcatcctcaagttgcttgattcaaaactcatcgggtcagctgctaccggagactccaaagttttctatttgaaaatgaagggagattattaccggtacttggctgagttcaaaaccggaaccgagagaaaagaagctgcagagaatactctttcggcctacaagtctgctcaggatattgctaatggcgaattggccccaacacatccaatccgattgggtctagctctcaatttctcagtgttttactatgagatattgaattctcctgaccgtgcttgtaatctcgccaaacaggcctttgatgaggcaattgcggagcttgacaccctgggagaggagtcctacaaggatagcactttgattatgcaacttctgcgtgataacctcactttgtggacctcaaatatgcaggatgatggaactgatgatatcaaagaaccatcaaaagctgataatgagtag

SEQ ID NO: 519 - protein, 255 aa, Solanum tuberosum
MASPREENVYMAKLAEQAERYEEMVEFMEKVVAALDGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSNMQDDGTDDIKEPSKADNE

SEQ ID NO: 520 - DNA, 1166 bp, Cucurbita pepo
  CDS (99)..(926)
ggcacgagaaatactccaactccttcggttccttctcctcgatttcgattccgccctcttgaactcataagatctaatcgttcctctttgtttctgcaatggcgggtcgctcttcccctcgcgaggagtttgtttaccttgctaagcttgccgagcaggccgagcgctacgaggagatggttgagtttatggaaaaggtctccgccgccgtagacaacgaggagcttaccgtcgaggagcggaaccttctctctgttgcttacaagaatgttattggagcgcgtagagcttcctggaggattatttcctccattgagcagaaggaggagagccgagggaacgatgatcatgtctcgatcatccgagattacagatccaagattgagactgagctgtctaacatctgcggattccggatccttaatcttcttgactcgcgccttattccctccgctgcgtccggagactccaaggtgttttatctcaaaatgaagggcgattatcatagatacctggctgaattcaagaccggagccgaacgaaaggaagctgccgaaagtaccctcactgcttataaatctgctcaggatattgcaaatgctgaacttcctcctactcaccccatacgacttgggctggctttgaacttctcagtgttctactatgagattctgaattcccctgatcgtgcttgcagccttgctaaacaggctttcgacgaggcaattgctgaattggatactctgggcgaagaatcatacaaagatagcactttgatcatgcaacttcttcgtgacaacctcaccctatggacttcggacatcagaggtagtagggatgacatcaaagaagcagctcccaaacgcgattgtacgaatagtagtgagcaaatcgatttgcacgtgcaggattcaacttctccttaacatgttttattctggagaagtgcttgtttggaactttggcttttccattgttatctaggtatttcttagccttataataatcatcaccacactctggaaaaaacgtgctcgtttgtctttcccccgacccctcgtttctttttcttctattgaccaatcaattccatgtctctgaattggcttttttaatccaatataaatgctacatattattaagcaaaaaaaaaaaaaaaaaactca

SEQ ID NO: 521 - protein, 275 aa, Cucurbita pepo
MAGRSSPREEFVYLAKLAEQAERYEEMVEFMEKVSAAVDNEELTVEERNLLSVAYKNVIGARRASWRIISSIEQKEESRGNDDHVSIIRDYRSKIETELSNICGFRILNLLDSRLIPSAASGDSKVFYLKMKGDYHRYLAEFKTGAERKEAAESTLTAYKSAQDIANAELPPTHPIRLGLALNFSVFYYEILNSPDRACSLAKQAFDEAIAELDTLGEESYKDSTLIMQLLRDNLTLWTSDIRGSRDDIKEAAPKRDCTNSSEQIDLHVQDSTSP

SEQ ID NO: 522 - DNA, 840 bp, Brassica rapa subsp
  CDS (1)..(840)
atggcggcggcgacactaggcagagaccagtacgtctacatggcgaagctcgccgagcaagccgagcgctacgaagaaatggtccaattcatggagcagctgctcgtcacaggcggcgccactccatcctccgaactcaccgtggaggaaagaaacctcctctcggtagcctacaagaacgtgatcggatctctacgcgccgcgtggaggatcgtgtcgtcgatcgagcagaaggaagagagcaggaagaacgaggagcacgcgacgctcgtgaagggttacagatctaaggtggagacggagctttcctccgtctgcgaagggatactaaagcttcttgattcgcatctgattccctccgcggcggcgagcgagtcgaaggtgttttatttgaagatgaagggggattatcataggtacatggcggagtttaagtctggggatgagaggaaagtggctgctgaggatactatgggtgcttataaggctgctcaggatattgcggctgctgatatggcgcctactcatccaataaggcttggtcttgctttgaatttctcggtgttttactatgagattcttaattcttcagacaaagcttgtaacatggccaaacaggcttttgaagaagctatagctgagcttgacacattgggggaagaatcctacaaagacagcactctcattatgcagttgctcagggacaatcttaccctatggacctccgatatgcagctatttctaacaggcatattaggaaagtccaacggtaacaacaccagtaatagtcacaaaactaatccaattgcacataactattctggaaacaagaggaattaa

SEQ ID NO: 523 - protein, 279 aa, Brassica rapa subsp
MAAATLGRDQYVYMAKLAEQAERYEEMVQFMEQLLVTGGATPSSELTVEERNLLSVAYKNVIGSLRAAWRIVSSIEQKEESRKNEEHATLVKGYRSKVETELSSVCEGILKLLDSHLIPSAAASESKVFYLKMKGDYHRYMAEFKSGDERKVAAEDTMGAYKAAQDIAAADMAPTHPIRLGLALNFSVFYYEILNSSDKACNMAKQAFEEAIAELDTLGEESYKDSTLIMQLLRDNLTLWTSDMQLFLTGILGKSNGNNTSNSHKTNPIAHNYSGNKRN

SEQ ID NO: 524 - DNA, 837 bp, Brassica campestris
  CDS (1)..(837)
atggcggcggcgacactaggcagagaccagtacgtctacatggccaagctctccgagcaagccgagcgctacgaagaaatggtccaattcatggagcagctcgtcacaggcggcgccactccatcctcagagctcaccgtggaggaaagaaacctcctctcggtcgcctacaagaacgtgatcggatctctgcgcgccgcgtggaggatcgtgtcgtcgatcgagcagaaggaagagagcaggaagaacgaggagcacgcgacgctcgtgaagggttacagatctaaggtggagacggagctttcctccgtctgcgaagggattctaaagcttcttgattcgcatctgattccttctgcggcggcgagcgagtcgaaggtgttttatttgaagatgaagggggattatcataggtacatggcggagtttaagtctggggatgagaggaaagtggctgctgaggatactatgggtgcttataaggctgctcaggatattgcggctgctgatatggcgcctactcatccaataaggcttggtcttgctttgaatttctcggtgttttactatgagattcttaattcttcagacaaagcttgtaacatggccaaacaggcttttgaagaagctatagctgagcttgacacattgggggaagaatcctacaaagacagcactctcattatgcagttgctcagggacaatcttaccctatggacctccgatatgcagctatttctaacaggcatattaggaaagtccaacggtaacaacaccagtaatagtcacaaaactaatccaattgcacataactattctggaaacaagaggaattaa

SEQ ID NO: 525 - protein, 278 aa, Brassica campestris
MAAATLGRDQYVYMAKLSEQAERYEEMVQFMEQLVTGGATPSSELTVEERNLLSVAYKNVIGSLRAAWRIVSSIEQKEESRKNEEHATLVKGYRSKVETELSSVCEGILKLLDSHLIPSAAASESKVFYLKMKGDYHRYMAEFKSGDERKVAAEDTMGAYKAAQDIAAADMAPTHPIRLGLALNFSVFYYEILNSSDKACNMAKQAFEEAIAELDTLGEESYKDSTLIMQLLRDNLTLWTSDMQLFLTGILGKSNGNNTSNSHKTNPIAHNYSGNKRN

SEQ ID NO: 526 - DNA, 1056 bp, Paxillus involutus
  CDS (70)..(834)
gaaaccatcatcttccccactttctctcttcacactcgtaccgtttacccctcttcaacaccacctacaatgcctgaatcgcgcgaagactccgtctaccttgccaagctcgctgaacaagctgagcgttatgaagagatggtcgagaacatgaagcgcgtggcttcgtcggaccaggagctcactgtcgaggagcgcaatctcctctcagtcgcgtacaagaatgtcattggtgcacgccgtgcatcttggcgtatcgtctcgtcgattgagcagaaggaggagtccaagggtaacgaggcccaggttgccatgatcaagggttaccgggagaagatcgagactgagctcgccaagatttgcgaggatatcctcgatgtccttgacaagcacctcatcccttccgctgcttctggcgagtccaaggtcttctaccacaagatgatgggtgactaccaccgctacctcgccgagttcgcgactggtgacaagcgcaaggacagcgctgacaaatctttggccgcctacaaggatgcctccgacgttgccgtcactgagctcccaccgacgcaccctatccgtctcggtctggcattgaacttctccgtgttctactacgaaatcctcaacagccccgaccgcgcttgccaccttgccaagcaggcattcgatgatgctattgctgagctcgacaccctctcggaggagagttacaaagactcaacgctcatcatgcaactactacgggacaaccttaccctctggacgtcggacatgcaagacactgacaagacagactcgaaagatgagggtgagaatgctggggatgactaaatggtctcgtcgtgcatcttggctctgctcttccgcttctacacacatcgactgatgtgcaacgactgcacacgttccttgggtgcttgcctccattacatatcatttgcatcgtctcacctcccgcatcctttccttacctttcccacctttgttgttattataccgtagtatgctgcggtggctcgttgtctctggtgccatagaggcgaatacaaagaa

SEQ ID NO: 527 - protein, 254 aa, Paxillus involutus
MPESREDSVYLAKLAEQAERYEEMVENMKRVASSDQELTVEERNLLSVAYKNVIGARRASWRIVSSIEQKEESKGNEAQVAMIKGYREKIETELAKICEDILDVLDKHLIPSAASGESKVFYHKMMGDYHRYLAEFATGDKRKDSADKSLAAYKDASDVAVTELPPTHPIRLGLALNFSVFYYEILNSPDRACHLAKQAFDDAIAELDTLSEESYKDSTLIMQLLRDNLTLWTSDMQDTDKTDSKDEGENAGDD

SEQ ID NO: 528 - DNA, 1020 bp, Haematococcus pluvialis
  CDS (49)..(783)
cacctagcgtgccaagtagcaagagctagagcaaactagacaccaacaatggcgacagaacgcgagcttgccctgtactcggcaaaactatccgagcaggcagaacgctacccagatatggtgtcagaaatgaagaagattgctgctggcgctcaagaccaagagctgtcagtggaggagcgtaacctgctatccgtggcttacaagaacctcgttggagctcgccgtgcttcctggcgcattcttcagagcgtggagcaaagcgagctggccaaaggcaacgagaagcgggtaaaactcattcagaaataccgcactgtcgtggagaaggagttggacgaggtctgcggcgagatcctcagcctgcttgacacttaccttgtgccatcagctagcagtgttgaggcatccgtcttctacctgaagatgaaggctgactaccaccggtacctcgctgaattcaaggtggacgaggatagaaggagtgcagcagagaagacactggaggcctacaaggcggcacagaacaaggccacgtctgagcttccctccaccaaccccatccgtttaggcctggcactcaacttctctgtgttctactatgaagtgctgaaccagcctgatcaggcatgctctttggcaaagcaggcctttgatgaggccatctctgacctggacaccctgggcgaggattcttacaaggattcagccctgatcatgcagctgcttcgtgacaacctgaccctgtggacatcagaaatgcaggactctaagccagagtagctggagccgctcatgcagcacatgagagcaagcagcatccgtggcgctgcatactagcgcacatgaatggcactcgctcttgctatctgttgtgaggcatgctagaagtggcatggtagcacagaacttgatgtgacatagcaacagggtgtgttgcactctgcaaactggcatagcaagtaggataacctgatggagttcatctgtcagtgttgtctggatctaaaaaaaaaaaaa

SEQ ID NO: 529 - protein, 244 aa, Haematococcus pluvialis
MATERELALYSAKLSEQAERYPDMVSEMKKIAAGAQDQELSVEERNLLSVAYKNLVGARRASWRILQSVEQSELAKGNEKRVKLIQKYRTVVEKELDEVCGEILSLLDTYLVPSASSVEASVFYLKMKADYHRYLAEFKVDEDRRSAAEKTLEAYKAAQNKATSELPSTNPIRLGLALNFSVFYYEVLNQPDQACSLAKQAFDEAISDLDTLGEDSYKDSALIMQLLRDNLTLWTSEMQDSKPE

SEQ ID NO: 530 - DNA, 1081 bp, Phanerochaete chrysosporium
  CDS (1)..(768)
atggcccagtcgcgtgaagactctgtctacctcgccaagctcgctgagcaggctgagcggtatgaggagatggttgagaacatgaagcgcgttgcctcgtccgaccaggagctcactgtcgaggagcgtaaccttctttccgccgcatacaagaacgtcatcggcgcgcgccgtgcgtcgtggcgcatcgtctcctccattgagcagaaggaggagtccaagggcaacgaggcccaggttgccatgattaagggctaccgggagaagattgagagcgagcttgcgaagatctgcgaggacatcctcgacgttcttgagaagcacctcatcccctcggcggcatctggcgagtcgaaggtcttctaccacaagatgatgggtgactaccaccgttacctcgccgagttcgccaccggtgacaagcgcaaggagagcgccgacaagtccctggaggcttacaaggcggcgtccgatgttgctgtcactgagctcccaccaacacaccccatccgcctcggtctcgccctcaacttctccgtcttctactatgagatcctcaacagccccgaccgcgcctgccacttggcgaagcaggcgttcgacgacgcgattgctgagctcgacacactatcggaggagagctacaaggactcgacgctcatcatgcagctcccccgtgacaacctcacactctggacctcagacatgcaggactctgacaagcctgctgatgagaagccctcggatgaggccgacaacgagtcttaaaggcttcgttgtttctgcttgtccggtctgaacggttcacgatgaaccggaggacgttgtcgcccgtcgctgtcgtctttctcattgtttcccagtaatcatctgcattctctcgcatctcgtaccatatcgcatccgtaacgaccgcatatttcttcaggccgattctcctccttgtcgtccatgccgttctctgttgagttttcttatcttgatacttaatagtctggggcagtggctgtgtcgtacaagaggaagtgtgaacaaataaacatcagaatatctgaaaaaaaaaaaaaaaaaaaaaaaaaaa

SEQ ID NO: 531 - protein, 255 aa, Phanerochaete chrysosporium
MAQSREDSVYLAKLAEQAERYEEMVENMKRVASSDQELTVEERNLLSAAYKNVIGARRASWRIVSSIEQKEESKGNEAQVAMIKGYREKIESELAKICEDILDVLEKHLIPSAASGESKVFYHKMMGDYHRYLAEFATGDKRKESADKSLEAYKAASDVAVTELPPTHPIRLGLALNFSVFYYEILNSPDRACHLAKQAFDDAIAELDTLSEESYKDSTLIMQLPRDNLTLWTSDMQDSDKPADEKPSDEADNES

SEQ ID NO: 532 - DNA, 1485 bp, Dunaliella salina
  CDS (86)..(862)
ctttactctagagggtctgacctcacacaaagccgctccacaccagtctcagcaggtcagcccacaccagctcacacagcgcaccatggctgaggcgagagaggagtgcacctacctggccaagttggcggagcaggcggagcggtacgatgagatggtggaggagatgaagaaggtcggccgcatggtgcacgaccaggagctgtccgtggaggagcgcaacctgctgtcggtggcgtacaagaacgttattggcgcacggcgtgcctcctggcgcatcatctccagcatagagcagaaggaggagagcaaaggcaacgaggagcatgtgcagcgcatcaggagctaccgcaagatggtggagaaggagctgagcgacatctgcagcagcatcctgcagctactggatgagcacctcatccccacagcgtccaccggcgagtcgaaggtgttctacctgaagatgaagggcgactaccaccgctacctggccgagttcaagaccggctccgaccgcaaggaggccgcggagcacacgctgctggcttacaaggccgcccaggacatcgcgctggttgacctgccccccacgcaccccatccgcctgggcctggcgctcaacttctccgtcttctactacgagatcctcaactcgcccgagcgtgcctgccacctggccaagcaggccttcgatgaggccattgcagagctggacaccctgggcgaggagagctacaaggacagcacccttatcatgcagctgctgcgggacaacctgacgctgtggacctcagacatgcagggacctgacgctgagggtggtggcggtggtgagatgaaggttgaggaggccgatgcctaagccactgtcgcaaggtgaagcaagtgctctggagggctctctgttgtgcagaacctcttctgagctggcttctcgcgtttgcttctggcccctccagcgtctgccaggccgcgggtggcaacagcgtgattcggggtggctcgctgtcagctcgcccgtttgtttggcactccaccatcaaagttgctttcaggcttcgcctggtctatcgagtttaacccccttgctgcatgcaagacagcccctgcgtttgtgtgttataccagatgcctggttgtgtgagaaatggtttgggacgcctgcgttccccacccaacttctggatctgccatttatcgggacagaggagggttacttccatgagaaaattaggaggttcatcaggcttggtaggcttagcacctgcacgttcaattgtatactcagcaggccccaaggatatggcctgcctgtgtctctttcattcttagctgtgcgattacagtgtgtgctgatgggtgtttgactcaagtgtgtgacaggctgctgtgcctgaaactgtatgacctattggattcaagtaactggatgctgctgaatgctgttaatgctccctacatgaaaaaaaaaaaaaaaaaaaaaaa

SEQ ID NO: 533 - protein, 258 aa, Dunaliella salina
MAEAREECTYLAKLAEQAERYDEMVEEMKKVGRMVHDQELSVEERNLLSVAYKNVIGARRASWRIISSIEQKEESKGNEEHVQRIRSYRKMVEKELSDICSSILQLLDEHLIPTASTGESKVFYLKMKGDYHRYLAEFKTGSDRKEAAEHTLLAYKAAQDIALVDLPPTHPIRLGLALNFSVFYYEILNSPERACHLAKQAFDEAIAELDTLGEESYKDSTLIMQLLRDNLTLWTSDMQGPDAEGGGGGEMKVEEADA

SEQ ID NO: 534 - DNA, 762 bp, Aspergillus flavus
  CDS (1)..(762)
atgggtcacgaagatgctgtttatctggccaagctcgccgagcaggccgagcgctacgaaatggtcgagaacatgaaggttgtcgcctctgccgatgtagagcttaccgttgaggagcgcaatctcctgtccgtcgtctacaagaacgtcatcggtgcccgccgtgcttcctggagaatcgtcacctctattgagcaaaaagaagagtccaagggcaacgagtcccaggtcacacttattaaggagtaccggcagaagatcgagtctgagcttgctaagatctgcgatgatatccttgagggtcttgacaagcacctgatcccctctggccagagcggcgagtctaagggcttctaccacaagataggtgactaccaccgttatcttgccgagttcgccatcggtgaccgccgtaagggcgctgccgatgcctctcttgaggcctataaggccgccactgaagttgcccagactgaccttactcctacccaccccatccgtcttggtctggctcttaacttctccgtcttctactacgagatcctcaactcccctggccaggcttgccacctggccaagcttgctttcgatgatgccattgctgagcttgacaccctgagcgaggagagctacaaggactctaccctgatcatgcagcttctcagagacaacctgcttgacaccctgagcgaggagagctacaaggactctaccctgatcatgcagcttctcagagacaaccaccctctggacctcgtctga

SEQ ID NO: 535 - protein, 253 aa, Aspergillus flavus
MGHEDAVYLAKLAEQAERYEMVENMKVVASADVELTVEERNLLSVVYKNVIGARRASWRIVTSIEQKEESKGNESQVTLIKEYRQKIESELAKICDDILEGLDKHLIPSGQSGESKGFYHKIGDYHRYLAEFAIGDRRKGAADASLEAYKAATEVAQTDLTPTHPIRLGLALNFSVFYYEILNSPGQACHLAKLAFDDAIAELDTLSEESYKDSTLIMQLLRDNLLDTLSEESYKDSTLIMQLLRDNHPLDLV

SEQ ID NO: 536 - DNA, 789 bp, Malus domestica
  CDS (1)..(789)
atgtcgccaactgattcttcacgcgaggagaatgtgtacatggccaagttggccgaacaggctgagagatatgaggagatggtcgagtttatggagaaagttgccaagactgttgatgttgaggagctaacagtggaggaaagaaatctcctctctgtggcttataagaatgtgattggagcgaggagagcttcgtggaggatcatatcttccattgagcagaaggaggagagcagagggaatgaggatcatgttgcgattatcaaggaatacaggagcaagattgagactgagctcagcaagatctgtgatgggatcttgaaccttcttgagtcgcacctcattccatctgcctcatctgccgagtccaaggtgttttacctcaagatgaaaggtgattaccacaggtaccttgctgagtttaagactggaggtgaaagaaaggaagcagctgagagcactttgttggcttacaagtctgctcaggatattgccctggctgagctggctccaacccacccgataaggcttggacttgcacttaacttctcagtcttctactatgaaatccttaactcaccagatcgtgcttgcaatctggcaaaacaggcttttgatgaggctatttctgagcttgacacattgggtgaggaatcctacaaggatagcactttgatcatgcagctcctccgagacaatctgacactctggacttctgatatcacggatgatgctggggacgaaatcaaggaagcatcaaagcgcgaatccagtgaaacacagcagtaa

SEQ ID NO: 537 - protein, 262 aa, Malus domestica
MSPTDSSREENVYMAKLAEQAERYEEMVEFMEKVAKTVDVEELTVEERNLLSVAYKNVIGARRASWRIISSIEQKEESRGNEDHVAIIKEYRSKIETELSKICDGILNLLESHLIPSASSAESKVFYLKMKGDYHRYLAEFKTGGERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKRESSETQQ

SEQ ID NO: 538 - DNA, 1156 bp, Zea mays
  CDS (130)..(903)
  misc_feature (979)..(979): n is a, g, c or t
  misc_feature (1007)..(1007): n is a, g, c or t
cccctcgtctccgccctagcgccactgagacactcaacgtcgagatcgaaacgacccgagtccgccgcgcccgtgcaccaccgaccgtcgaactcccgaaagtaactctatttcttgatcaacatcaacatgtcgcgggaggataatgtttacatggccaagctggctgagcaagcagaacggtacgaggaaatggttgagtacatggagaaggtggctaagaccgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggacacgcttggtgaggattcatacaaagatagcaccttgatcatgcagctcctgagggacaacctaaccctatggaccgctgacagcgcaacggaggacggcatcgaggagggcaatgaggcctcgaagggtgatgctggtgagggtcagtagtctggtaaaacctcgattgatggttcggcatgtttttgaagtccactgtgttggaaaccatgttctaatagaaggngtctcccgctccatgcattccaagattntgtcctccccctccctcccctcatgttgtaggctggtagtggtcaaattagttggccctgggtccatttggactgatacattgtttactgctattgaagtcattcgttctcgttttgctctaaaaaaaaaaaaaaaaaaaaaaaaaaaa

SEQ ID NO: 539 - protein, 257 aa, Zea mays
MSREDNVYMAKLAEQAERYEEMVEYMEKVAKTVDVEELTVEERNLLSVAYKNVIGARRASWRIISSIEHKEESRKNEEHVIQIKEYRGKIEAELSNICDGILKLIDSHLVPSSTAAESKVFYLKMKGDYHRYLAEFKTGAERKEAAESTMIAYKAAQDIALAELASTHPIRLGLALNFSVFYYEILNSPDKACNLARQAFDEAISQLDTLGEDSYKDSTLIMQLLRDNLTLWTADSATEDGIEEGNEASKGDAGEGQ

SEQ ID NO: 540 - DNA, 804 bp, Triticum aestivum
  CDS (4)..(795)
aagatgacggcaccagcggagctttcccgtgaggagaatgtgtacatggctaagctcgccgagcaggctgagaggtacgaggagatggttgagttcatggagaaggtggccaagactgtcgactccgaggagctcactgtggaggagcgcaacctcctctctgttgcatacaagaatgtgattggagcccgccgtgcctcatggcgcatcatctcctccattgagcagaaggaggagagccgtggcaatgaggaccgggtcacgctcatcaaggaataccgtggcaagatcgaaactgagcttagcaagatctgtgatggcatcctcaagctgctcgaaacccaccttgtcccgtcctccactgcccctgagtccaaggtcttctatcttaagatgaagggtgactactacaggtatcttgcggaattcaagagtgggcctgagaggaaggatgctgctgaggataccatggtggcatacaaggctgctcaggatattgctttggctgagctggctccaactcatccgattaggcttgggctggcactaaacttctcggtgttctattatgggatcctcaactcgcctgatcgtgcttgcaatctcgcagagcaggcattcgatgaggccatttcggagctggacaccctgagcgaagaatcttacaaggacagcaccttgatcatgcaactccttcgtgataacttgaccctctggactcctgacatcacggaggacaccgctgaggaggagatcagggaggctccaaagaacgactcgagcgaggggcagtaaagccggctt

SEQ ID NO: 541 - protein, 263 aa, Triticum aestivum
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAEDTMVAYKAAQDIALAELAPTHPIRLGLALNFSVFYYGILNSPDRACNLAEQAFDEAISELDTLSEESYKDSTLIMQLLRDNLTLWTPDITEDTAEEEIREAPKNDSSEGQ

SEQ ID NO: 542 - DNA, 1054 bp, Tropaeolum majus
  CDS (90)..(869)
acgggggatctccttcttccctctttctttccatctccatttttgttcttcttcaacttttcaaacaaatccacaatctctaacaacccatggcgtcagctcgtgaggagagcgtttacatggctaagcttgccgagcaagctgagcggtacgaggagatggttgagtttatggaaaaggtttctgcatctgctgaaggtgaggaactcaccgtcgaggaacgaaacttgctctctgttgcttacaagaacgtgattggtgctaggcgtgcctcgtggcgtactatctcttccatcgagcagaaggaggaaggacgcggtaacgaggatcatgttactgtgatccgtgactataggtctaagatcgagtctgagctctcgaatatctgcgatgggatcttgaaattgcttgacactaggcttatcccgtctgcatcttctggtgattccaaggtgttttaccttaagatgaagggagattaccataggtacttggctgagtttaagactggcgcagagagaaaggaagctgctgagagtactctaactgcttacaaagctgctcaggatattgctaactcagaattggccccaactcatcccatccgtcttggattagctctcaacttctctgtcttttactatgagatcctcaattcccctgatcgtgcctgcaaccttgccaaacaggcatttgatgaggccattgctgagttggatactctcggcgaggaatcatacaaggacagcaccttgatcatgcagcttctgcgtgacaatctcactctgtggacctcagacatgcaggatgatggagcggatgagattaaggaagcagcagcacctaagcctgctgaagaacagcagtgagactggtttggctccaaaaattaggactgaactttctcctctatatgtttttgataggagaggttgtttgtttctattttccatgattatcatcgccaagttttctatctttaggcattcttgttgtggtttactgaatcatgaatgtactgtttattttttccttacaaaaaaaaaaaaaaaaa

SEQ ID NO: 543 - protein, 259 aa, Tropaeolum majus
MASAREESVYMAKLAEQAERYEEMVEFMEKVSASAEGEELTVEERNLLSVAYKNVIGARRASWRTISSIEQKEEGRGNEDHVTVIRDYRSKIESELSNICDGILKLLDTRLIPSASSGDSKVFYLKMKGDYHRYLAEFKTGAERKEAAESTLTAYKAAQDIANSELAPTHPIRLGLALNFSVFYYEILNSPDRACNLAKQAFDEAIAELDTLGEESYKDSTLIMQLLRDNLTLWTSDMQDDGADEIKEAAAPKPAEEQQ

SEQ ID NO: 544 - DNA, 1107 bp, Zea mays
  CDS (75)..(845)
  misc_feature (590)..(590): k is g or t
  misc_feature (593)..(593): r is g or a
  misc_feature (605)..(605): y is t or c
  misc_feature (608)..(608): y is t or c
  misc_feature (659)..(659): k is g or t
agttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcctgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctkggrcttgctcttaayttytcagtgttctattatgagattctgaactccccagacaaagcttgcaacctkgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaagggacagtaatcttgggagagcgcatattgttcgagcccattgttttagatgctctatgctgtcgaagctgaagctgtgccgtgctattattgtagctgatttcctgttccctcactttttttttatattagtaggctggtagtgttcgaattagttccccattgctttgtgttgccgctagctgtcactaagtccgtgtggactggtattattcactggatttgagcacgtaaaaaaaaaaaaaaaaaaaaaaaaaaaaaa

SEQ ID NO: 545 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 546 - DNA, 1079 bp, Solanum chacoense
  CDS (54)..(821)
caactttctctctctaaaacccctctttctctctctagaacacagaaccatcaatggcgtctccacgtgaagagaacgtgtacatggcgaagcttgctgagcaagctgaacgctatgaggagatggtagaattcatggagaaggttgtcgccgccttggacggcgaggaactaaccgtcgaggaacgcaaccttctctccgtcgcatacaaaaacgtgatcggagctaggagagcatcctggcgtataatttcatcgatcgagcagaaagaggagagtcgtggtaacgaagatcacgttgcctccattaaaaaatacagatctcagatcgagaatgagctgacttcgatctgtaacggcatcctcaagttgcttgattcaaaactcatcgggtcagctgctaccggagactccaaagttttctatttgaaaatgaagggagattattaccggtacttggctgagttcaaaaccggaactgagagaaaagaagctgcagagaatactctttcggcctacaagtctgctcaggatattgctaatggcgaattggccccaacacatcccatccgattgggtctagctctcaatttctcagtgttttactatgaaatattgaattctcctgaccgtgcttgtaatctcgccaaacaggcctttgatgaggcaattgcggagcttgacaccctgggagaggagtcctacaaggatagcactttgattatgcaacttctgcgtgataacctcactttgtggacctcggatatgcaggatgatggaactgatgagatcaaagaaccatcaaaagctgataatgagtagtaacaacgtgagtgaaacctctttgcttaggattgaaaaccgatgatgtaattttactcattgatcaaaattggctgtttgtagtccttatcctgtgatttgtaatacctattacctaaaggcgttgtttcttgccatttgttgttttcatcaaagattactttttgtctcagtatttctcttgtatttggatgctctgatgaagctctcttatttcgtggaaatgaattcttatttttaaaaaaaaaaaaaaaaaaa

SEQ ID NO: 547 - protein, 255 aa, Solanum chacoense
MASPREENVYMAKLAEQAERYEEMVEFMEKVVAALDGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 548 - DNA, 768 bp, Solanum tuberosum
  CDS (1)..(768)
atggcgtctccacgtgaagagaacgtgtacatggcgaagcttgctgagcaagctgaacgctatgaggagatggtagaattcatggagaaggtcgtcgccgccttggacggcgaggaactaaccgtcgaggaacgcaatcttctctccgtcgcatacaaaaacgtgatcggagctaggagagcatcctggcgtataatttcatcgatcgagcagaaagaggagagtcgtggtaacgaagatcacgttgcctccattaaaaaatacagatctcagatcgagaatgagctgacttcgatctgtaacggcatcctcaagttgcttgattcaaaactcatcgggtcagctgctaccggagactccaaagttttctatttgaaaatgaagggagattattaccggtacttggctgagttcaaaaccggaaccgagagaaaagaagctgcagagaatactctttcggcctacaagtctgctcaggatattgctaatggcgaattggccccaacacatccaatccgattgggtctagctctcaatttctcagtgttttactatgagatattgaattctcctgaccgtgcttgtaatctcgccaaacaggcgtttgatgaggcaattgcggagcttgacaccctaggagaggagtcctacaaggatagcactttaattatgcaacttctgcgtgataacctcactttgtggacctctgatatgcaggatgatggagctgatgagatcaaagaaccatcaaaagctgataatgagtag

SEQ ID NO: 549 - protein, 255 aa, Solanum tuberosum
MASPREENVYMAKLAEQAERYEEMVEFMEKVVAALDGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGADEIKEPSKADNE

SEQ ID NO: 550 - DNA, 798 bp, Paracoccidioides brasiliensis
  CDS (1)..(798)
atgggttacgaagatgctgtatatctcgccaagctcgccgagcaggccgagcgctacgaagaaatggtggaaaacatgaagattgtggcttctgcagacaaggagctatccgtcgaggagcgcaatctgctttccgttgcctataagaacgtgattggcgcccgacgtgcctcgtggagaatcgttacttcgatcgaacaaaaggaggagtcgaaaggcaacgaggcgcaggttgctcttatcaaggagtaccgccaaaacatcgagactgagttggccaagatctgtgaggatatcttggatgtgcttgacaagcaccttatcgcctctgcggaaactggagaatccaaggttttctaccacaagatgaagggggactaccaccgttatctcgccgagttcgctcttggagacaagcgcaaggactccgctgacaagtcgctggaggcttacaagaacgcaactgaggttgctcagaccgatcttgcccctacccaccccatccgtctgggtcttgctctcaacttctccgtcttctactatgaaatcctgaattctccagaccaggcttgccacctcgccaaacaagctttcgatgacgctattgctgaacttgacacacttagcgaggagagctacaaggactccactcttattatgcaactcttgagagacaacctgactctctggacatcatctgaggctgaacccgcccccgaggtggcccctgccccatctgagcaaaaggatgaagcccctgctgctactagcgaggatgctcctaaggccgctgagtag

SEQ ID NO: 551 - protein, 265 aa, Paracoccidioides brasiliensis
MGYEDAVYLAKLAEQAERYEEMVENMKIVASADKELSVEERNLLSVAYKNVIGARRASWRIVTSIEQKEESKGNEAQVALIKEYRQNIETELAKICEDILDVLDKHLIASAETGESKVFYHKMKGDYHRYLAEFALGDKRKDSADKSLEAYKNATEVAQTDLAPTHPIRLGLALNFSVFYYEILNSPDQACHLAKQAFDDAIAELDTLSEESYKDSTLIMQLLRDNLTLWTSSEAEPAPEVAPAPSEQKDEAPAATSEDAPKAAE

SEQ ID NO: 552 - DNA, 771 bp, Saccharum hybrid cultivar CP65
  CDS (1)..(771)
atgtcgagggaggagaatgtttacatggccaagctggctgagcaggccgaaaggtatgaggagatggttgagtatatggagaaggtggctaagactgtagatgttgaagagctcactgtggaggagcgtaacctcctgtctgtcgcatacaagaatgtgattggggctcgccgtgcttcatggcgcattgtctcttccattgaacagaaggaggagtcccgtaagaacgaagagcatgtgaaccttatcaaggaataccgcgggaagattgaggctgaactgagcaacatctgtgatggcatcctgaaactgcttgactcccacctagtgccttcctctactgctgctgaatcaaaggtcttctacctcaagatgaagggtgactatcacaggtatcttgcggaatttaagactggtgctgagaggaaggaatctgctgagagcacaatggtagcctacaaggctgctcaggacattgctctggctgagctggcacctacacatccgataaggcttgggcttgctcttaacttctcagtgttctattatgagattctgaactccccagacaaagcttgcaaccttgcaaagcaggcgtttgatgaagctatctctgagttagacacccttggggaggagtcatacaaagatagcactctgatcatgcagctcctgagggacaacttgaccctttggacctctgacctcacggaggatggtgctgatgagggcaaagaagcctcaaaaggtgatgctggcgagggacagtaa

SEQ ID NO: 553 - protein, 256 aa, Saccharum hybrid cultivar CP65
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGADEGKEASKGDAGEGQ

SEQ ID NO: 554 - DNA, 1021 bp, Nicotiana tabacum
  CDS (22)..(804)
gttttttcacaaacaacaaatatggccgagtcatcgcgtgaagaaaatgtgtacatggccaagctagctgagcaggccgagcgatatgaggaaatgattgagtttatggaaaaggttgcaaagacaggtgatgtcgaggagctgactgttgaggaaaggaatcttctttctgtggcatacaaaaatgtgattggcgcaagaagggcctcgtggaggataatctcttcaattgagcagaaagaggagagtcgtggaaatgaagatcatgtcaaaactattaaagaatacagagccaaaattgaggctgaactcagcaagatatgtgatgggattttgggtctccttgagtcccatttaataccatcagcctccacagctgagtccaaagttttttacttgaagatgaaaggtgattaccacaggtacctggctgagtttaaaacaggttcagagaggaaagaagctgctgagaacaccttattggcatacaagtctgctcaggatattgctttgactgagctggctcctactcacccaatcaggctgggacttgcccttaacttttctgtgttctattatgagattcttaattcacctgatcgtgcttgtaaccttgcgaaacaggcctttgatgaagctatctcagagttggatacgctgggcgaggaatcttacaaggacagtacattgatcatgcaacttctcagagacaatcttacactttggacttcagataatgcggaggatgctgaggatgatatcaaggaagctccaaagcatgagtcaggcgaggggcagcagtgatgagttagtagcatagtcttttagtctttattttatagggtgctgcttgaggatatagccagatcgtgaattagatacttcaatggctgtgtgtgtcactgtctaaatggttcaatataaaacatgtcgtagtgtgatagaatatgtggtcaagatagtcgcttagtgctatggtgattaaaatttgacatggtggcattaaaaaaaaaaaaaaaaa

SEQ ID NO: 555 - protein, 260 aa, Nicotiana tabacum
MAESSREENVYMAKLAEQAERYEEMIEFMEKVAKTGDVEELTVEERNLLSVAYKNVIGARRASWRIISSIEQKEESRGNEDHVKTIKEYRAKIEAELSKICDGILGLLESHLIPSASTAESKVFYLKMKGDYHRYLAEFKTGSERKEAAENTLLAYKSAQDIALTELAPTHPIRLGLALNFSVFYYEILNSPDRACNLAKQAFDEAISELDTLGEESYKDSTLIMQLLRDNLTLWTSDNAEDAEDDIKEAPKHESGEGQQ

SEQ ID NO: 556 - DNA, 1145 bp, Nicotiana tabacum
  CDS (50)..(832)
atcagaaaccacccgctgcataaccctaggtttttcacaaacaacaaacatggccgattcatcgcgtgaagaaaatgtgtacatggccaagctagctgagcaggccgagcgatatgaggaaatgattgagtttatggagaaggttgcaaagacaggtgatgtcgaggagctgactgttgaggaaaggaatcttctttctgtggcctacaaaaatgtgattggtgcaagaagggcctcgtggaggataatctcttcaattgagcagaaagaggagagtcgtggaaatgaagatcatgtcaaaactattaaagaatacagagccaaaattgaggctgaactcagcaagatctgtgatgggattttgggtctccttgagtcccatttaataccatcagcctcagcagctgagtccaaagttttttacttgaagatgaaaggtgattaccacaggtacctggctgagtttaaaacagggtcagagaggaaagaagctgctgagaacaccttattggcatacaagtctgctcaggatattgctttgactgagctggctcctactcacccaatcaggctgggacttgcccttaacttttctgtgttctattatgaaattcttaattcacctgatcgtgcttgtaaccttgcaaaacaggcctttgatgaagctatctcagagttggatacacttggcgaggaatcttacaaggacagtacattgatcatgcaacttctccgagacaatcttacactttggacttcagataatgcggaggatgctggggatgatatcaaggaagctccaaaacatgagtcaagcgaggggcagcagtgatgagttagtagcatagtcttgtagtctttattttatagggtgctgcatggggatatagcaagatcgtgaattagatacttcaatggctgtgtgtgtcactgtcgaaatggtttaatataaaacatgtagtgtgatagaatgtggtcaagctagtcgcatagtgctatggtgattaaaatttgatatggtggcagtatttgcttgtgttggtgactttgctcgtatttatagtcttatttgcatgttgcgtaatcatctttgtattttcaaattctttgaaatccttgaattaattgttaacatctaaaaaaaa

SEQ ID NO: 557 - protein, 260 aa, Nicotiana tabacum
MADSSREENVYMAKLAEQAERYEEMIEFMEKVAKTGDVEELTVEERNLLSVAYKNVIGARRASWRIISSIEQKEESRGNEDHVKTIKEYRAKIEAELSKICDGILGLLESHLIPSASAAESKVFYLKMKGDYHRYLAEFKTGSERKEAAENTLLAYKSAQDIALTELAPTHPIRLGLALNFSVFYYEILNSPDRACNLAKQAFDEAISELDTLGEESYKDSTLIMQLLRDNLTLWTSDNAEDAGDDIKEAPKHESSEGQQ

SEQ ID NO: 558 - DNA, 1047 bp, Nicotiana tabacum
  CDS (65)..(841)
tttctctccatttttctctttctacaaaattccctctctcatttcctctctcacagaaacatcaatggcgtcgccacgcgaagagaacgtgtacatggcaaagcttgccgagcaagccgagcgttacgaggagatggttgagttcatggagaaagtcgtcgccgccgccgacggcgctgaggaactaaccgtcgaagaacggaacctcctctccgtcgcatacaaaaatgttatcggagcacgacgagcctcgtggcgtatcatctcctccattgagcaaaaagaggagagccgcggtaacgaggatcacgttgcctccatcaaggagtacagatctaagatcgagaccgaactcacctcgatctgtaacggcattctcaagctcctcgattctaagctcattggcgccgctgctaccggcgattctaaggtgttttacttgaaaatgaaaggagattatcatcgttatttggccgagtttaagaccggtgccgagcgaaaggaagctgccgaaaacactctctcggcttacaaatccgctcaggatattgcaaataccgagcttgctcctacgcatccaattcgattgggacttgctctcaatttctctgtattctactacgagattttgaattcacctgatcgtgcttgtaatctcgccaaacaggcctttgatgaggccattgctgagctggacaccttgggcgaagagtcctacaaggatagcactctgatcatgcagcttcttcgcgataacctcactttatggacttcagatatgcaggatgatggaactgatgagatcaaagaagcagcaaaaccagataatgagcagcagtaaactggtgacatttctttaggattgaactgccatgttgtaactttttatttttcaattgtctgagttcagctcttttagttctagatcttatgatttgtaacacctaaaacaactgtttcttgttatttgttgcttttgtttgtttctttgtggatttatcttgtatttggataatttcctttttctcaaaggaatgacttattggg

SEQ ID NO: 559 - protein, 258 aa, Nicotiana tabacum
MASPREENVYMAKLAEQAERYEEMVEFMEKVVAAADGAEELTVEERNLLSVAYKNVIGARRASWRIISSIEQKEESRGNEDHVASIKEYRSKIETELTSICNGILKLLDSKLIGAAATGDSKVFYLKMKGDYHRYLAEFKTGAERKEAAENTLSAYKSAQDIANTELAPTHPIRLGLALNFSVFYYEILNSPDRACNLAKQAFDEAIAELDTLGEESYKDSTLIMQLLRDNLTLWTSDMQDDGTDEIKEAAKPDNEQQ

SEQ ID NO: 560 - DNA, 1131 bp, Nicotiana tabacum
  CDS (20)..(796)
cctctcccttcaaacatcgatgtcgtcgtcgcgcgatgagttcgtgtacatggcgaagcttgcggagcaagccgagcggtacggggagatggtagagttcatggagaaggtcgtaaccaccgcggacggcggcgaggaactaaccatcgaagaacgtaaccttctctccgtagcttacaaaaacgtgatcggagcacgacgagcctcgtggcggatcatttcctctattgagcaaaaagaagagagccgaggcaacgaagatcacgtgacctctattaaaacttacagatctaagatcgagtcggagttgacatcgatctgtaacggtatactcaagctgctcgattcgaatctcatcggcgctgcttctaccggagattctaaggtgttttatttgaaaatgaaaggagattatcatcggtatttggccgagtttaagaccggagctgagagaaaagaagctgctgagaatactctttcggcttacaagtccgctcaggaaattgcaaatgcggaactggcacctacacatcccattcgattggggctagctctcaatttctctgtattttactatgagatattgaattctcctgatcgtgcttgtaatctcgccaaacaggcctttgatgaggcgatcgctgagcttgacacgttgggggaggagtcctacaaggatagtacgttgataatgcagcttcttcgcgataatctgactttgtggacctccgacatgcaggacgagggaactgaagagatgaaagaagtagcaaaaccggataatgaggagcactaaaagtggtgaaaatcttttattcaggatttgaatgccaggttaaaccttgctcattggtttaattaagatctttgcagttctaattcccctatgatttgtgagacctaaaaattgtaagctgtcattctttaaagaaaggtccagtgctgcgcatctctggcgttttgtttgtatggagaggaatatggggaagtaggacgctttcacttgtgttcagttctgatataggatttcaacttgtttgctttgggtcatgagttaaaagatcattgtttatctctgcaactctcctgtatttggatgcttctttttcctgattggaatgaccaattgag

SEQ ID NO: 561 - protein, 258 aa, Nicotiana tabacum
MSSSRDEFVYMAKLAEQAERYGEMVEFMEKVVTTADGGEELTIEERNLLSVAYKNVIGARRASWRIISSIEQKEESRGNEDHVTSIKTYRSKIESELTSICNGILKLLDSNLIGAASTGDSKVFYLKMKGDYHRYLAEFKTGAERKEAAENTLSAYKSAQEIANAELAPTHPIRLGLALNFSVFYYEILNSPDRACNLAKQAFDEAIAELDTLGEESYKDSTLIMQLLRDNLTLWTSDMQDEGTEEMKEVAKPDNEEH

SEQ ID NO: 562 - DNA, 1038 bp, Nicotiana tabacum
  CDS (50)..(832)
aatcagaggaccattagctatacgtcaatcagataactagacaacaaacatggccgagtcaacacgtgaagaaaatgtgtacatggccaagctggctgagcaggctgagcggtatgaagaaatggttgagtttatggagaaggttgcaaagacggtagatgttgaagaactgaccgtggaggaaaggaatcttctttctgtggcttacaagaatgtgattggtgcaagaagggcttcatggaggataatctcatcaattgagcagaaggaagagagccgtggaaatgaagaccatgttagcagcattaaagaatacagaggcaaaattgaggctgaactcagcaagatatgtgatgggattttgaacctcctcgagtcccatttaataccagttgcctcaacagccgagtccaaagtcttttacttgaagatgaaaggtgattaccacaggtacttggctgagtttaagacaggggcagaaaggaaagaagccgcagagaacactttattagcctacaagtctgctcaggatattgctttggctgagctggctcctactcacccaatcaggctgggacttgcccttaacttttcagtgttctattatgaaattctcaactcatcggatcgtgcttgtaaccttgcaaagcaggcttttgatgatgccattgccgagctggatacactgggtgaggaatcttacaaggacagtacattgattatgcagcttcttcgagacaatcttacactttggacgtctgattccacggatgatgccggggatgagatcaaggaagcttcaaaacgcgagtcaggtgacggagagcagtaactgcatagcagcatagtcttgtactttactttgtgattttactataggactgctgtgtgaaagctagactggatttaggcatttcgatgactctttgtatcactgctgaattggtttgatataaaaacatgttttagtatattgagaaatatagttatgccattgatgtgttggcttgtaaaaaaaaaaaaaaaaaaaaaaaaaaa

SEQ ID NO: 563 - protein, 260 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDSTDDAGDEIKEASKRESGDGEQ

SEQ ID NO: 564 - DNA, 989 bp, Nicotiana tabacum
  CDS (50)..(832)
caatcagagaccattagctatacatcaatcagataactagacaacaaacatggccgagtcaacacgtgaagaaaatgtgtacatggccaagctggctgagcaggctgagcggtatgaagaaatggttgagtttatggagaaggtcgcaaagacagtagatgttgaagaactgaccgtggaggaaaggaatcttctttctgtggcttacaagaatgtgattggtgcaagaagggcttcatggaggataatctcttcaattgagcagaaagaggaaagccgtggaaatgaagaccatgttagcagcattaaagaatacagaggcaaaattgaggctgaactcagcaagatatgtgatgggattttgaacctccttgagtcccatttaataccagttgcctcaacagccgagtctaaagtgttttacttgaagatgaaaggtgattatcacaggtacttggctgagtttaagacaggggcagaaaggaaagaagccgcagagaacactttattagcctacaagtctgctcaggatattgctttggctgaactagctcctactcacccaatcaggctgggacttgcccttaacttttcagtgttctattatgaaattctcaactcgtcggatcgtgcttgtaaccttgcaaagcaggcctttgacgatgccatcgcggagctggatactctgggtgaggaatcttacaaggacagtacattgattatgcaacttctccgagacaatcttacactttggacttctgataccacggatgatgccggggatgagatcaaggaagcttcaaaacgcgaatcaggcgaaggagagcagtaacgacatagcatcatagtcttttactctttattttgtttgaatttaatataggactactgtgtgaaagctagactggatatggatatttctatgattcttcgtatcactgctgaaatggtttgatataaaaacatgttttagtacgaaaaaaaaaaaa

SEQ ID NO: 565 - protein, 260 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDTTDDAGDEIKEASKRESGEGEQ

SEQ ID NO: 566 - DNA, 1258 bp, Nicotiana tabacum
  CDS (36)..(782)
caagaaaaaaaaaaaactccggcgaatctccgacgatggccgtgccggaaaatttaaccagagagcagtgcctatacttagcaaagctcgccgagcaagccgagcgttacgaggagatggtaaaattcatggaccgcctcgtagtcgtctccggttcctctgaactaaccgttgaagagcgaaacctcctctcagtagcgtataagaacgtaatcggctcacttcgagccgcgtggaggatagtatcgtcaattgagcaaaaggaagaagggaggaagaacgaggaacacgtggttctagtgaaggattatagatctaaggttgaatctgagcttagtgatgtttgtgctggaattttgaagattttggatcaatatttgattccttcggcttcggctggtgaatcgaaggtgttttacttgaagatgaagggagattattatcgttatttggctgaatttaaagttggtaatgaacgtaaggaagctgctgaggatactatgcttgcctacaaagctgctcaggacatcgcccttgctgagcttgccccaacacatcctatacgacttgggctagctctgaactattcagtgttctactatgagattctgaatgcatcagaaaaagcatgcagcatggctaaacaggcctttgaggaagctattgccgaactggacactttgggggaggaatcctataaggatagcacccttatcatgcagttattgagggacaatctcaccctctggacttccgatatgcaggtaagtcatttttcctaattagaaaagttcattgaattatacaagtagtatagggattatatgtttcttcctgttcttctccaactatgactacacaatgcaaatattaaagcacgacaataatatttcgtgcataactgaattcccatcgaatggactccgataaattccattcacactgcatttcaagtgtacagatttcctaccgatatccattcccaatattgagaatagtagccagttgctttcggctcgttttatactcctagtccttttgcttaatagagaactaaaacatgagtatattatggctaatgcaggagcagatggacgaggcttgacattaaactgctcctccaggaggtgggcaatgtcacacagcaactctgtaatctacatatgcaactgataacttttgtaattttatttctcatgcctactttgataattatcttattcaaactctggtttgaaacttaatgcttttagtttta

SEQ ID NO: 567 - protein, 248 aa, Nicotiana tabacum
MAVPENLTREQCLYLAKLAEQAERYEEMVKFMDRLVVVSGSSELTVEERNLLSVAYKNVIGSLRAAWRIVSSIEQKEEGRKNEEHVVLVKDYRSKVESELSDVCAGILKILDQYLIPSASAGESKVFYLKMKGDYYRYLAEFKVGNERKEAAEDTMLAYKAAQDIALAELAPTHPIRLGLALNYSVFYYEILNASEKACSMAKQAFEEAIAELDTLGEESYKDSTLIMQLLRDNLTLWTSDMQVSHFS

SEQ ID NO: 568 - DNA, 980 bp, Nicotiana tabacum
  CDS (61)..(810)
aaaaaaacctctctctgaaaaacaccaagaaaaaaaaaaaactccggcgaatctccgacgatggccgtgccggaaaatttaaccagagagcagtgcctatacttagcaaagctcgccgagcaagccgagcgttacgaggagatggtaaaattcatggaccgcctcgtagtcgtctccggttcctctgaactaaccgttgaagagcgaaacctcctctcagtagcgtataagaacgtaatcggctcacttcgagccgcgtggaggatagtatcgtcaattgagcaaaaggaagaagggaggaagaacgaggaacacgtggttctagtgaaggattatagatctaaggttgaatctgagcttagtgatgtttgtgctggaattttgaagattttggatcaatatttgattccttcggcttcggctggtgaatcgaaggtgttttacttgaagatgaagggagattattatcgttatttggctgaatttaaagttggtaatgaacgtaaggaagctgctgaggatactatgcttgcctacaaagctgctcaggacatcgcccttgctgagcttgccccaacacatcctatacgacttgggctagctctgaactattcagtgttctactatgagattctgaatgcatcagaaaaagcatgcagcatggctaaacaggcctttgaggaagctattgccgaactggacactttgggggaggaatcctataaggatagcacccttatcatgcagttattgagggacaatctcaccctctggacttccgatatgcaggagcagatggacgaggcttgacattaaactgctcctccaggaggtgggcaatgtcacacagcaactctgtaatctacatatgcaactgataacttttgtaattttatttctcatgcctactttgataattatcttattcaaactctggtttgaaacttaatgcttttagttttatttctcgaaaaaaaaaa

SEQ ID NO: 569 - protein, 249 aa, Nicotiana tabacum
MAVPENLTREQCLYLAKLAEQAERYEEMVKFMDRLVVVSGSSELTVEERNLLSVAYKNVIGSLRAAWRIVSSIEQKEEGRKNEEHVVLVKDYRSKVESELSDVCAGILKILDQYLIPSASAGESKVFYLKMKGDYYRYLAEFKVGNERKEAAEDTMLAYKAAQDIALAELAPTHPIRLGLALNYSVFYYEILNASEKACSMAKQAFEEAIAELDTLGEESYKDSTLIMQLLRDNLTLWTSDMQEQMDEA

SEQ ID NO: 570 - DNA, 1134 bp, Nicotiana tabacum
  CDS (62)..(844)
gaaaatcgaaaaactccctcattcagatctccaaagaaaatacagagaaacaaatctaaacatggcggtggcaccgacggcgcgtgaggagaacgtgtatatggcaaagcttgcagagcaagctgagaggtacgaagaaatggttgaattcatggagaaggtctccaactccctgggctcagaagaactcaccgtggaagaacgaaacctcctctccgtggcgtataagaacgtgatcggagcgcgtagggcatcgtggcgtattatctcatcgattgagcaaaaggaagagtccagagggaacgaggaacacgtgaactctatccgcgagtacagatctaagattgagaatgagctctctaagatctgtgatggcattctgaaattgctcgatgcaaagcttatcccttctgcagcatctggtgattctaaggtgttttacctgaaaatgaaaggagattaccaccgctatttggctgagttcaagaccggtgctgaacgtaaggaggctgctgagagcactctcactgcctacaaagctgctcaggacattgctactactgaacttgccccaacacatcccatccgacttggactggctcttaacttctctgtgttttactatgagatcttgaactctcctgaccgcgcttgcaatcttgctaaacaggcctttgatgaagcaattgctgagttggatacattgggcgaggagtcttacaaggatagcactttgatcatgcaacttcttcgtgacaatctcactctctggacatctgatatgcaggatgatggggctgatgaaatcaaggaagatcccaaacctgatgaatccaaaaattgaaggaattgaaactctctaatttgcttttcacttcttcctggttgtttttattggaagaagctgattatcgttatttccttactattatggttttcaactagggggttgtcttcttattggaaatgaacaactttaatattgatgtttcagaagttccatctttaatttaatgtggttttctggtggttagttttcttctaaagcgtttgacttgttattgtgcactggatatatcaaatacatctgaagtgaaacccaacaatggtaatcaagctttcaaaaaaaaaaaa

SEQ ID NO: 571 - protein, 260 aa, Nicotiana tabacum
MAVAPTAREENVYMAKLAEQAERYEEMVEFMEKVSNSLGSEELTVEERNLLSVAYKNVIGARRASWRIISSIEQKEESRGNEEHVNSIREYRSKIENELSKICDGILKLLDAKLIPSAASGDSKVFYLKMKGDYHRYLAEFKTGAERKEAAESTLTAYKAAQDIATTELAPTHPIRLGLALNFSVFYYEILNSPDRACNLAKQAFDEAIAELDTLGEESYKDSTLIMQLLRDNLTLWTSDMQDDGADEIKEDPKPDESKN

SEQ ID NO: 572 - DNA, 1068 bp, Nicotiana tabacum
  CDS (78)..(845)
ccacgcgtccgctttccacattctctcaactttctctttctaaaactcttcctctttttctagcacacagaccttcaatggcatcgccgcgcgaggagaacgtgtacctggcgaagcttgctgagcaagccgaacgctacgaggagatggtagagttcatggagaaagtcgtcggcgccggcgacgacgaactcaccgtcgaggaacgcaacctcctctccgtcgcgtacaaaaatgtgatcggagcgaggcgagcgtcgtggcgcataatctcatcgatcgagcagaaagaagagagtcgcggtaacgaagatcacgtggcctccattaaaacctacagatctaagatcgaatctgaattgacttcgatctgcaatggtatccttaagttgctcgattcaaaactcattggcaccgctgctaccggtgactctaaggttttctatttgaaaatgaagggagattattacaggtacttggctgagttcaaaaccggagctgagagaaaagaagccgccgagaatactctttcggcttacaagtcggctcaggatattgctaatgttgaattagcccctacacatccaatccgattggggctagctctcaatttctcagtgttttactatgagatattgaactctcctgaccgtgcttgtaatctcgccaaacaggcatttgatgaggctattgcggagcttgacaccctgggagaggagtcctacaaggatagcactttgattatgcaacttcttcgtgataacctcactttgtggacctcggatatgcaggatgatggaactgatgagatcaaagaaccatcaaaagcggaggagcagcagtaatgtgagtgaagcctctttgcttaggattgaatcctatggcataactttgctcattgatcgaaatttgctgtttgtgtagttctgaattccctgaattgtaatacctaaaagcactgtttcttgccatttgttgttttcagcaaagattactttttctctcggtatttcccttgtatttggatgctccagtgaaactctcttatttcgtggaaatgaatgcttg

SEQ ID NO: 573 - protein, 255 aa, Nicotiana tabacum
MASPREENVYLAKLAEQAERYEEMVEFMEKVVGAGDDELTVEERNLLSVAYKNVIGARRASWRIISSIEQKEESRGNEDHVASIKTYRSKIESELTSICNGILKLLDSKLIGTAATGDSKVFYLKMKGDYYRYLAEFKTGAERKEAAENTLSAYKSAQDIANVELAPTHPIRLGLALNFSVFYYEILNSPDRACNLAKQAFDEAIAELDTLGEESYKDSTLIMQLLRDNLTLWTSDMQDDGTDEIKEPSKAEEQQ

SEQ ID NO: 574 - DNA, 1200 bp, Nicotiana tabacum
  CDS (117)..(875)
ccacgcgtccggggcagaaaaagcacataaaagtctctctctctctcacgcacacacacactctgtcgagaatccattctctttcgcctaaactttctctctctacaacaacaacaatggcggctctgctcacagacaatctcagccgcgaacaatacctctacttagccaaactcgccgaacaagccgaacgctatgaagaaatggtccagtacatggacaaactagtcctcagttccactcccgccgccgaactcaccgtcgaggaacgaaacctcctttccgtcgcttacaaaaacgtgatcggctctcttcgtgccgcgtggcgtatcgtatcctccattgaacagaaagaggaatcgcgtaagaacgaagaacacgtgtcgctcgttaaggagtacagaggtaaagttgagaatgagttaacggaggtttgtgctggtatactcaagttgctcgagtcgaatctcgtgccgtctgcttctacgggtgaatcgagggtgttttacctcaaaatgcccggtgattattaccggtatctagcggagtttaaggttggagatgagcggaagcaagctgctgaagacactatgaattcttataaggctgctcaggaaattgcactagcagatctgcctccaacacatcctataaggctgggtcttgcacttaatttttcagtcttctactttgagattctgaactcatctgacaaagcttgtagtatggcaaaacaggcttttgaggaagccatagctgagctggacactttaggtgaagaatcttacaaggatagcaccctcataatgcaactcctacgagacaatctcacactttggacctcagatgctcaggatcagttggatgagtcttgattgtatgccgactcatcatctcttttaaggggtgggctccaaatgtcatttgccttttgctgacttattgtataagaaaaaggacagctcctcttgtctcttgacattatgtattcgatattttacttatggtggtatggaacttggaaaagctaggagttaaattgccatattttctgcatttcttttatgttggtatcagttgctggcgttagaatttccttttcctttttttagccgcgaacagtcaaacctggtattgtgtaagcttgagttattataagaaaatttaaatgggtgtgctttttatgagttttttaaaaaa

SEQ ID NO: 575 - protein, 252 aa, Nicotiana tabacum
MAALLTDNLSREQYLYLAKLAEQAERYEEMVQYMDKLVLSSTPAAELTVEERNLLSVAYKNVIGSLRAAWRIVSSIEQKEESRKNEEHVSLVKEYRGKVENELTEVCAGILKLLESNLVPSASTGESRVFYLKMPGDYYRYLAEFKVGDERKQAAEDTMNSYKAAQEIALADLPPTHPIRLGLALNFSVFYFEILNSSDKACSMAKQAFEEAIAELDTLGEESYKDSTLIMQLLRDNLTLWTSDAQDQLDES

SEQ ID NO: 576 - DNA, 991 bp, Nicotiana tabacum
  CDS (19)..(777)
cccacgcgtccgagagaaatggagaaggaaagagagaaacaggtttacttggctaggctggctgagcaagctgagagatatgatgaaatggtagaagcaatgaagacggttgctaagatggatgttgaactgactgttgaggagaggaatttggtgtcagttgggtataagaatgttattggagcaagaagggcttcatggcggatattgtcttcaatcgaacaaaaggaggagagtaagggtcatgaccagaatgttaagagaataaagacttaccaacagagggttgaagatgagcttacaaaaatatgcattgacattttgtcggtgattgatgagcaccttgttccttcttccactaccggagaatctactgtcttctactataagatgaagggagattactatcgctatttagcagagttcaaatcaggggatgatcgtaaagaggcagctgatcagtcacttaaagcttatgaggctgctactgccacagctagcgcagatcttgctcctactcacccaattagacttggacttgcattgaacttctcagtcttctactatgagattctgaattcacccgagagggcatgccacttggccaagcaagcatttgatgaagctattgcggaacttgatagccttagtgaagaatcctacaaggacagcacccttatcatgcagctcctaagggataatctcactttgtggacctcagaccttgaagagggaggtgaacattctaagggtgatgagcgtcaaggggagaactagctgaagtataataggagacaaatctttgtgatgctggctggtcggagacatgtcaagcttgtggaaaatcttggttttcatataatgttcagagattcatgcctattggcttgtatttcatcctgcatacataaacattcccagagtacttttcattttcagttaaaaattgattctccttttgcatgaaaaaaaaaaaaaaaaaaaaaaaaaa

SEQ ID NO: 577 - protein, 252 aa, Nicotiana tabacum
MEKEREKQVYLARLAEQAERYDEMVEAMKTVAKMDVELTVEERNLVSVGYKNVIGARRASWRILSSIEQKEESKGHDQNVKRIKTYQQRVEDELTKICIDILSVIDEHLVPSSTTGESTVFYYKMKGDYYRYLAEFKSGDDRKEAADQSLKAYEAATATASADLAPTHPIRLGLALNFSVFYYEILNSPERACHLAKQAFDEAIAELDSLSEESYKDSTLIMQLLRDNLTLWTSDLEEGGEHSKGDERQGEN

SEQ ID NO: 578 - DNA, 726 bp, Arabidopsis thaliana
  CDS (1)..(726)
atggagaatgaacaatcaacgcacgttcacttcgcgagtctctcttcgtcaagcgagcgctacaatgaaacatttgaagagataaagaaagcgatgaagaaaagtgttcagcttaaagcggagctatcagcaaaggagagaaatcttgtatcagtggggtacaagaatgtgattagcgcaaggagagcttcattggaaatactatcatccattgtgcaaaaggaagagtcaaaaggaaatgaggaaaatgtcaagaagcttaagaattatcgaaacaaggttgaagatgagcttgccaaaatttgtaatgacatcctgtccgtcatcaataagcaactcattccatcgtctaccactgtggactcctctgttcttttctacaatatgctggcagacttcagttctaatgctgaaagcaaggaagctactgatcagtctcttgatgcatataagagactggtttggtaccaacagttccagctatacatgactttgaattggacttctgttttcttaaactctcctgaaagtgcataccaattggcaaagcaagcgttcgatgatgcaattaatgaatttgacataagtgatgaatcaaacaaggacatgactcttattatacagctactcagagacaatctcaacatgtggactttagacctcacagaaagagaggaggtaatctttttatttccctatctgcctcctctgatgatagatagatag

SEQ ID NO: 579 - protein, 241 aa, Arabidopsis thaliana
MENEQSTHVHFASLSSSSERYNETFEEIKKAMKKSVQLKAELSAKERNLVSVGYKNVISARRASLEILSSIVQKEESKGNEENVKKLKNYRNKVEDELAKICNDILSVINKQLIPSSTTVDSSVLFYNMLADFSSNAESKEATDQSLDAYKRLVWYQQFQLYMTLNWTSVFLNSPESAYQLAKQAFDDAINEFDISDESNKDMTLIIQLLRDNLNMWTLDLTEREEVIFLFPYLPPLMIDR

SEQ ID NO: 580 - DNA, 1286 bp, Chlamydomonas reinhardtii
  CDS (42)..(785)
gcaccaggtgctctaggcgcacatacgcaaacataggaacaatggcggaggctaactcgcgcgagctcgcgctttacagcgccaagattgctgagcagtctgagcgttaccaggacatggttgaggagatgaagaaggttgctgtgctggctaatgagcaggagctgtcggtggaggagcgcaacctgctctcggtctcctacaagaaccttgtgggctcccgccgcgctagctggcgcattctgcagagcattgagcagtcggagcaagctaagggcaacgagaagcgcgtgggcatgatcaagaggtaccgcgcggtggtggagggcgagctcgacaaaatctgccatgagatcctggacctgctcgacaagtacctggtgcccagcgcctctaccaccgaggccgctgtcttctacctgaagatgaaggccgattaccaccgctacctgtctgagtacaagacggacgaggccaaagcggcggccgcggagttgacgctggccgcctacaaggtcgcccaggagaaggccgacgagctgcccacgaccaaccccatcaggctgggtctggcgctcaacttctcggtcttctactacgaggtgatgaaccagcccgcgctggcctgctcgctggcgaagaaggccttcgatgaggctatctctgacctggactcgctcggcgaggattcctacaaggacagcgcgctcattatgcagctgctgcgggacaacctcaccctgtggacgtcagaaatgcaggacgacgacaagaatcgggcatgagcgtagcgcagcgcagccttgggtgtcggagccccggtttccagcggctcatggggggtcctcggcgagcaggcgctggactgtttgcatcttgcgcaactctgagccgcccgcctgttggggcacgctattccataattgtggagtcacggcacggttattaggtacgctgatgacggcgtgagacccagaggagggtttcgaggagcgtggcgtgtgttttccgatggggtgccggccgtgtttgaccggacagtacggtgatgcacggtgccggcttgtgtttgtattgagttttgtttcagcactggtgtcagcattctcggtcacggggccgcatgcggcttcacgatgcggccaaacataggtagaagtgtggtccccgagtgggcgcgcttgagaagcgccaagcagactcactgcggacgagcgtccatgatggccatggcgctcacacattatgtaaagactagcgcgcgaaaaaaaaaaaaaaaaaaaaaa

SEQ ID NO: 581 - protein, 247 aa, Chlamydomonas reinhardtii
MAEANSRELALYSAKIAEQSERYQDMVEEMKKVAVLANEQELSVEERNLLSVSYKNLVGSRRASWRILQSIEQSEQAKGNEKRVGMIKRYRAVVEGELDKICHEILDLLDKYLVPSASTTEAAVFYLKMKADYHRYLSEYKTDEAKAAAAELTLAAYKVAQEKADELPTTNPIRLGLALNFSVFYYEVMNQPALACSLAKKAFDEAISDLDSLGEDSYKDSALIMQLLRDNLTLWTSEMQDDDKNRA

SEQ ID NO: 582 - DNA, 750 bp, Triticum aestivum
  CDS (1)..(750)
atggctaagctcgccgagcaggctgagaggtacgaggagatggttgagttcatggagaaggtggccaagaccgtcgactccgaggaactcactgtggaggagcgcaacctgctctctgttgcatacaagaatgtgattggagcccgccgtgcctcatggcgcatcatctcctccattgagcagaaggaggagagccgtggcaacgaggaccgggtcacgctcatcaaggagtaccgtggcaagatcgagactgagcttagcaagatctgtgatggcatcctcaagctgctcgaaacccaccttgtcccgtcttccactgcccctgagtccaaggtcttctatcttaagatgaagggtgactactacagatatcttgccgaattcaagagtgggcctgagaggaaggatgctgctgagaataccatggtggcatacaaggctgctcaggatattgctttggctgagctggctccaactcatccgattaggcttgggctggcactaaacttctcggtgttctattatgagatcctcaactcgcctgatcgtgcttgcaatctcgcaaaacaggcattcgatgaggccatttcggagctggacaccttgagcgaagaatcctacaaggacagcaccttgatcatgcaactccttcgtgataacttgaccctctggacttccgacatcacggaggacaccgcggaggaggagatcagggaggctccgaagcatgactccagcgaggggcagtaa

SEQ ID NO: 583 - protein, 249 aa, Triticum aestivum
MAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 584 - DNA, 738 bp, Arabidopsis thaliana
  CDS (1)..(738)
atggagaatgagagagaaaagctgatttacttggctaagctcggttgccaagctggaagatatgatgatgtgatgaaatcaatgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgaaaggagattattttcgatatatggcagagtttggttctgatgctgaacgtaaagaaaatgcagataattctctagatgcatataaggttgcaatggaaatggcagagaatagtttagtacccaccaatatggttagacttggattggctttaaatttctcgatattcaactatgagatccataaatctattgaaagcgcatgtaaattggttaagaaagcttacgatgaagcaatcactgaactcgatggccttgacaagaatatatgcgaagagagcatgtatatcatagagatgcttaaattcaatctttctacgtggacttcaggcgatggtaatggtaataagacagacggttag

SEQ ID NO: 585 - protein, 245 aa, Arabidopsis thaliana
MENEREKLIYLAKLGCQAGRYDDVMKSMRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLVPTNMVRLGLALNFSIFNYEIHKSIESACKLVKKAYDEAITELDGLDKNICEESMYIIEMLKFNLSTWTSGDGNGNKTDG

SEQ ID NO: 586 - DNA, 1579 bp, Paracoccidioides brasiliensis
  CDS (79)..(987)
cgcttccgcttcttccactcccacgctgtttagatcccaccatcccacaccgtctcccgttatccccctactgccaccatgacttcagaacgtgaaagcaagacgtttctcgccaggctctgcgagcaggctgaacgctacgatgaaatggttacatacatgaaggaagttgccaatttgggaggcgaactcaccgtcgacgaacgcaatcttctctctgttgcttacaaaaacgtcgttggtacccgtcgtgcttcttggcgcattatctcctccatcgagcagaaggaggactccaaaggctctgagaagcatgttgctatcatcagcgagtaccgccagaagatcgaaactgagctcgagcgcgtctgccaggatgttcttgatgttttggaccagtctttgattcccaaggcggagtctggtgaatccaaggttttctaccacaaaatgaagggggactatcaccgttatctcgctgagtttgcttcaggtaacaagcgcaaggttgccgccactgccgcccacgaggcttacaagaacgccaccgacgtcgcccaaactgaactgacaccaacccacccaatccgtctcggactcgccctcaacttctcagtcttctattacgagatcctcaactctcctgatcgcgcttgccacctggctaagcaggcgttcgatgatgctattgctgaactcgactcactctctgaagagtcttaccgcgatagcacgttgatcatgcagctgctgcgagacaacttgacgttgtggacgtcgtcggatggcgcagaacctgagccagttgctgctggtgatggaaaagatgataagacggctgagggtgaggaaggaccggcgactgcgactactactgatgcccctgctcctgaagaagtggctgcaccagctgctgcagatgaggagccaaaaaaggagggcacaaacggagtcttaaagtatgggtttaaaaagaatttattttaaaatgttttctattcccctgcttatgattcctgcttgctcctaaggttgtgtgtgtgtgcgagatataccatttgtgtgtgagagcgggaggaaaggggagcagggatgtccctgttgaaaacaaaaaaaattaaaccaaactaaccaacctaaagcaaaacaaacacacccaaaaaattgttttattttttcacatcaaatggggacgggaaaagcggaaagaaagcagagcgggcagaacaaggtcgatttgaaaatgggaatctgatgttgttatttggcgtgcgggcttgggtttctcagcggaatgccttctctcccaaggcgtgtgtctttgagcttttcactcaaataagggtttttttcaattggtacaagacaccagacaccagaggggtggatggagttttgcgattatttttttcttaaattatttatttgcaagagcgatgagaatgaacgggtggcggagatattatttcttttctttcttttcttccagtctccccccagtttatttctttcactgattaaatgtgtgttgattggtggtccctagatcaagggaaattctaacactcaaaaaaaaaaa

SEQ ID NO: 587 - protein, 302 aa, Paracoccidioides brasiliensis
MTSERESKTFLARLCEQAERYDEMVTYMKEVANLGGELTVDERNLLSVAYKNVVGTRRASWRIISSIEQKEDSKGSEKHVAIISEYRQKIETELERVCQDVLDVLDQSLIPKAESGESKVFYHKMKGDYHRYLAEFASGNKRKVAATAAHEAYKNATDVAQTELTPTHPIRLGLALNFSVFYYEILNSPDRACHLAKQAFDDAIAELDSLSEESYRDSTLIMQLLRDNLTLWTSSDGAEPEPVAAGDGKDDKTAEGEEGPATATTTDAPAPEEVAAPAAADEEPKKEGTNGVLKYGFKKNLF

SEQ ID NO: 588 - DNA, 807 bp, Arabidopsis thaliana
  CDS (46)..(807)
atgtcatcatcaggatccgacaaagagagagagacttttgtctatatggctaagctctccgaacaagccgagcgatacgacgagatggtggagacgatgaagaaagtggcgagggttaatagcgagctgactgtggaagagaggaatctgttgtcggttggttacaagaacgtgatcggagcaagaagagcttcgtggaggataatgtcgtccatcgagcagaaagaagagtctaaaggcaatgaatcaaacgtgaaacaaatcaagggttatcgccaaaaggtagaagatgagctcgctaacatttgccaagacattctcaccatcattgatcagcatctcatccctcacgctacctcaggggaagctaccgtcttctactacaagatgaaaggagattattaccgttacttggctgagtttaagaccgagcaagagaggaaggaagctgctgaacagtctctcaaaggctatgaggctgcaacacaagctgcaagcactgagcttccttcgacccatccaattcgtcttggccttgctcttaacttctctgttttctactatgagatcatgaactctcctgaaagagcttgccatttggctaagcaagccttcgatgaggcgattgcagagttagatactctaagtgaggagtcgtacaaggacagcactttgatcatgcagctcctgagagacaacctcaccctctggacttctgatcttcctgaagatggaggagaagacaacatcaagactgaagaatccaagcaagaacaggccaagcctgccgatgccactgagaactga

SEQ ID NO: 589 - protein, 253 aa, Arabidopsis thaliana
MAKLSEQAERYDEMVETMKKVARVNSELTVEERNLLSVGYKNVIGARRASWRIMSSIEQKEESKGNESNVKQIKGYRQKVEDELANICQDILTIIDQHLIPHATSGEATVFYYKMKGDYYRYLAEFKTEQERKEAAEQSLKGYEAATQAASTELPSTHPIRLGLALNFSVFYYEIMNSPERACHLAKQAFDEAIAELDTLSEESYKDSTLIMQLLRDNLTLWTSDLPEDGGEDNIKTEESKQEQAKPADATEN

SEQ ID NO: 590 - DNA, 777 bp, Nicotiana tabacum
  CDS (1)..(777)
atggcgtcgccacgcgaggagaacgtgtacatggcaaagcttgccgagcaagccgagcgttacgaggagatggttgagttcatggagaaagtcgtcgctgctgccgacggcgccgaggaacttaccgtcgaagaacgcaacctcctctccgtcgcgtacaaaaacgtaatcggagcacggcgagcctcgtggcgtatcatctcctccattgagcaaaaagaggagagccgcggcaacgaagatcacgttgcctccattaaggagtacagatctaagatcgagaccgaactcacctcgatctgtaacggcattctcaagctcctcgattctaagctcattggcgccgctgctaccggtgactctaaggtgttttacttgaaaatgaaaggagattatcatcgctatttggctgagtttaaaaccggtgccgagcgaaaggaagccgccgaaaacactctctcggcttacaaatccgctcaggatattgcaaataccgagctcgctcctacacatccaatccgattgggacttgctctcaatttctctgtattttactacgagattttgaattcttctgatcgtgcttgtaatctcgccaaacaggcctttgatgaggcaattgccgagctggacacattgggcgaagagtcctacaaggatagcactctgatcatgcagcttcttcgtgataacctcactttatggacttcagatatgcaggatgatggaactgatgagatcaaagaagcagcaaaaccagacaatgagcagcagtaa

SEQ ID NO: 591 - protein, 258 aa, Nicotiana tabacum
MASPREENVYMAKLAEQAERYEEMVEFMEKVVAAADGAEELTVEERNLLSVAYKNVIGARRASWRIISSIEQKEESRGNEDHVASIKEYRSKIETELTSICNGILKLLDSKLIGAAATGDSKVFYLKMKGDYHRYLAEFKTGAERKEAAENTLSAYKSAQDIANTELAPTHPIRLGLALNFSVFYYEILNSSDRACNLAKQAFDEAIAELDTLGEESYKDSTLIMQLLRDNLTLWTSDMQDDGTDEIKEAAKPDNEQQ

SEQ ID NO: 592 - DNA, 1154 bp, Thellungiella halophila
  CDS (16)..(834)
ctcgatctaaaaacaatggcgacacaaccaccatcttcatcctcagccagggaagaattcgtctacatggcgaaactcgcggagcaagccgagcgttacgaagaaatggtcgaattcatggagaaagtcgcaaaagccgtcgacaaagaagaactcaccgtcgaagaacgtaacctcctctccgtcgcctacaaaaacgtgatcggagctcgccgtgcctcgtggcgaatcatctcctcgatcgagcaaaaggaagagagccgaggaaacaacgaccacgtctccctgatccgtgactacagaaccaaaatcgaaaccgagctctccggcatctgcgacggtatcctcaaattgctcgatactatgcttattcccgctgctgcttctggagattcaaaggttttctacctgaagatgaaaggagattatcataggtacttggctgagtttaaaactagccaagagaggaaagacgctgcagaacatacactcaatgcctacaaagctgctcaggatattgctaatgccgaattggctccaacacacccgattcgtctcggtcttgcgttgaatttctctgtgttttactacgagattctcaattctccagaccgtgcttgcaatctcgctaagcaggcttttgatgatgcaattgctgaattggatactcttggtgaagaatcgtacaaggacagtactttgatcatgcagcttcttcgtgacaacctcactctctggacctctgatatgcaggacgatgatgatgtaattaaagaagcagcagcagcagcgccagcagcgccgaagcctgctgaagaacagcagcaatcctaagctttctcgcgacttcattgttgtttcagtatcaaaaatttctccattattatgtttttccttggagaagtttctttgtgtgttggtttctgatttttccgttttcctaatcccgaagcttctaaggccgtctaattcctgtccttgtttgctcttttcaaattgtggattcttattattttcttgtgatttgacttcgtctttgttttctctgtttgtattgaaattcaccttcttctcttatcaatggcttggcttttatctaattattcattttaatgtcacgaaagatcttggattaaaaaaaaaaaaaaaaaaaa

SEQ ID NO: 593 - protein, 272 aa, Thellungiella halophila
MATQPPSSSSAREEFVYMAKLAEQAERYEEMVEFMEKVAKAVDKEELTVEERNLLSVAYKNVIGARRASWRIISSIEQKEESRGNNDHVSLIRDYRTKIETELSGICDGILKLLDTMLIPAAASGDSKVFYLKMKGDYHRYLAEFKTSQERKDAAEHTLNAYKAAQDIANAELAPTHPIRLGLALNFSVFYYEILNSPDRACNLAKQAFDDAIAELDTLGEESYKDSTLIMQLLRDNLTLWTSDMQDDDDVIKEAAAAAPAAPKPAEEQQQS

SEQ ID NO: 594 - DNA, 1094 bp, Phaseolus angularis
  CDS (60)..(839)
tctctctttgtccctctttaatccctaaccagatctcgctctctctccaagattcgacaatggcggccgctcctacgcctcgcgaagagaacgtgtacatggcgaagctcgctgagcaggccgagcgctacgaagagatggtggagttcatggagaaggtgtccgctgccgcagacaacgaggaactcaacgtcgaagagaggaatctcctctctgtagcctacaagaacgtgatcggagcgcgccgcgcctcgtggcgcatcatctcctcgatcgagcagaaggaagagagccgcggcaacgaggatcacgtcaccgtcatccgcgactaccgatccaagatcgagtccgagctctccaacatctgcgacggtattctcaagctcctcgactctcgccttattccctcggcttcctccggcgattctaaggtattctacctcaagatgaagggcgattaccacaggtacctcgccgagttcaagaccggcgctgagcgcaaggaggctgccgagagcactctcgctgcatacaaatcggctcaggacattgcaaatgccgaactgcctccaactcatccaattaggctcggccttgctctgaacttctccgtattttactatgaaatccttaactctcctgatcgcgcctgcaaccttgcaaaacaggcttttgatgaagcgattgctgaattggatacactgggagaggaatcatacaaggatagcactttgatcatgcaactgcttcgtgataacctcaccctttggacctcggacatgcaggatgatggagcagatgaaattaaagaagcagcaccgaaacaggatgatcagtagagatgttttactgctaattagaattgaacttctcctctatatctttttgaagggaggtgtttgttgctatatctttgatgctggaattttaggcattcatgtctgttatgaattgtggatgtactgggccgttttagtttgtccttccattttcaagtgttttccaaattgcctattttattaaggacgctgaagtttttattttacggaattggaattttaagattctcttctatctaaaaaaaaaaaaaaaaa

SEQ ID NO: 595 - protein, 259 aa, Phaseolus angularis
MAAAPTPREENVYMAKLAEQAERYEEMVEFMEKVSAAADNEELNVEERNLLSVAYKNVIGARRASWRIISSIEQKEESRGNEDHVTVIRDYRSKIESELSNICDGILKLLDSRLIPSASSGDSKVFYLKMKGDYHRYLAEFKTGAERKEAAESTLAAYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 596 - DNA, 978 bp, Phaseolus angularis
  CDS (11)..(757)
agagaagagaatggcggaagggctgaacagagaacagtacgtgtaccttgccaagctctcggagcaggcggacgggtacgaggagatggtggagttcatgcagaaggtggtggtggggtggactccagcgacggagcttagcgtggaggagcgcaacctactctcggtcgcttacaagaacgtcatcggctccctgcgtgcggcgtggcggatcgtttcttcgatcgagcagaaggaagagggtcgcaagaacgaggaacacgtggcgctcgtcaagcaatacagatccaaggtggagacggagctctcgaacgtgtgcgccagcatcctaaacctcttggactccaacctcgtcgcctctgcctccaacaccgagtccaaggtcttctatttgaagatgaagggcgattatcaccgctatctcgctgaatttaaggttggggatgagcgaaaggctgcagctgaggataccatgttgtcttacaaggctgcccaggacgttgcttatgcggatcttccacccacccaccctataagattgggccttgctctcaatttctcggtcttctactatgaaatcctcaaccaatctgataaagcgtgtggcatggctaaacaggcttttgaggaagcaattgctgagctggacacattgggagaagaatcctacaaagacagcacgctcataatgcagcttttaagagacaaccttaccctttggacttctgatgtccaggaccagctagatgagccctgataaggttgatgggttgtattcttcctctcatggaggtgggctttgaatgtcatcatttctttgtgctaaattaagaatcgccctagtttatataacatgattggcaatctgtgatataatgctgtatgaacagagaccatgcttcttttttatgtgtcatatgatatgaaaattggaaatgatactgtataatgggatatcgaattaattaaaaaaaaaaa

SEQ ID NO: 597 - protein, 248 aa, Phaseolus angularis
MAEGLNREQYVYLAKLSEQADGYEEMVEFMQKVVVGWTPATELSVEERNLLSVAYKNVIGSLRAAWRIVSSIEQKEEGRKNEEHVALVKQYRSKVETELSNVCASILNLLDSNLVASASNTESKVFYLKMKGDYHRYLAEFKVGDERKAAAEDTMLSYKAAQDVAYADLPPTHPIRLGLALNFSVFYYEILNQSDKACGMAKQAFEEAIAELDTLGEESYKDSTLIMQLLRDNLTLWTSDVQDQLDEP

SEQ ID NO: 598 - DNA, 1133 bp, Fritillaria cirrhosa
  CDS (29)..(817)
aacagatatcgaactcggccattcgactatgtcttctgcggagtcccgggaagagaatgtgtacttggccaagttagccgagcaagctgagcgttacgaggaaatggttgagttcatggagaaagttgcaaagaccgtggagaccgaggaacttactgttgaagagaggaatctcttgtctgttgcttacaagaacgttattggggctcgcagagcatcatggcgcatcatgtcctctattgagcagaaagaggagtccaaagggaatgatcaaaatgttaaacttatcaagggttatcgccataaggttgaggaggagctcgctaagatatgcaatgatatactgactgtcattgataagcatcttattccttcttctggctctggggaagccactgtcttctactacaaaatgaagggtgattattaccgctatctggctgagtttaagaatgaacatgaaaggaaagaagctgctgatcagtcgatgaaagcttatcaggccgcttccaacacagccaacactgatcttccctcgactcatcccattcgacttgggcttgctcttaatttctcagtcttctattatgaaatcatgaattctcctgaaagggcgtgccatttagcaaagcaggcctttgatgaggcaattgcagaactggacaccttgagtgaggagtcgtacaaggacagcactttgattatgcagttactgagggacaatctcactctttggacttctgacttgcccgaggatggaggtgatgagggtttcaagggtgaggaggccaaagccgctggtgatgatgagcactagtgatgactgtttttaactccggacttggaggattcctagtagtggcagataattgctgagcaacaagtgggtttttccggttcaactggagggattccatttttataaatctatggacctgtttagtgtttctcaatgttctcgtctatacaatatgttaacctttttcccgattctccaggctgttgtagtttatctagcaaagtgtttggtgatgaccaagcgttcttgatggtaggcagctagttgtttgttctatggataattggtcttttattttgtttggaaaaaaaaaaaaaaaaaaaaaaaaaaaaaa

SEQ ID NO: 599 - protein, 262 aa, Fritillaria cirrhosa
MSSAESREENVYLAKLAEQAERYEEMVEFMEKVAKTVETEELTVEERNLLSVAYKNVIGARRASWRIMSSIEQKEESKGNDQNVKLIKGYRHKVEEELAKICNDILTVIDKHLIPSSGSGEATVFYYKMKGDYYRYLAEFKNEHERKEAADQSMKAYQAASNTANTDLPSTHPIRLGLALNFSVFYYEIMNSPERACHLAKQAFDEAIAELDTLSEESYKDSTLIMQLLRDNLTLWTSDLPEDGGDEGFKGEEAKAAGDDEH

SEQ ID NO: 600 - DNA, 984 bp, Nicotiana tabacum
  CDS (37)..(795)
tctctttcgcctaaactttctctctctacaacaacaatggcggctctgctcacagacaatctcagccgcgaacaatacctctacttagccaagctcgccgaacaagccgaacgctatgaagaaatggtccagtacatggacaaactagtcctcagttccactcccgccgccgaactcaccgtcgaggaacgaaacctcctttccgtcgcttacaaaaacgtgatcggctctcttcgtgccgcgtggcgtatcgtatcctccattgagcagaaagaggaatcgcgtaagaacgaagaacacgtgtcgctcgtcaaggagtacagaggtaaagttgagaatgagttaacggaggtttgtgctggtattctcaagttgctcgagtcgaatctcgtgccatctgcttctacgggtgaatcgagggtgttttacctcaaaatgaaaggtgattattaccggtatctagcggagtttaaggttggagatgagcggaagcaggctgctgaagacactatgaattcttataaggctgctcaggaaattgcactagcagatctgcctccaacacatcctataaggctgggtcttgcacttaatttctcagtcttctactttgagattctgaactcatctgacaaagcttgtagtatggcaaaacaggcttttgaggaagccatagctgagctggacactttaggtgaagaatcttataaggatagcaccctcataatgcaactcctacgagacaatctcacactttggacctcagatgctcaggatcagttggatgagtcttgattgtatgctgactcatcatctcttttaaggggtgggctccaaatgtgcatttgccttttgctgacttattgtataagaaaaaggacagcttcccttgacattatgtattcgatatttgacttatggtggtatggaacttcgaaaagcgaggagttaaattgccatatttctgcaaaaaaaaaaaaaaaa

SEQ ID NO: 601 - protein, 252 aa, Nicotiana tabacum
MAALLTDNLSREQYLYLAKLAEQAERYEEMVQYMDKLVLSSTPAAELTVEERNLLSVAYKNVIGSLRAAWRIVSSIEQKEESRKNEEHVSLVKEYRGKVENELTEVCAGILKLLESNLVPSASTGESRVFYLKMKGDYYRYLAEFKVGDERKQAAEDTMNSYKAAQEIALADLPPTHPIRLGLALNFSVFYFEILNSSDKACSMAKQAFEEAIAELDTLGEESYKDSTLIMQLLRDNLTLWTSDAQDQLDES

SEQ ID NO: 602 - DNA, 979 bp, Solanum lycopersicum
  CDS (17)..(787)
gaatacagaactatcaatggcgtctccacgtgaagagaacgtgtacatggcgaagtttgctgagcaagctgaacgatcctatgaggagatggtagaattcatggagaaggtcgtcttttccttgaacggtgaggaacttaccgtcgaggaacgcaaccttctctccgtcccatacgggggcctgatcggagctaggagagcatcgtggcgtataatttcatcgatcgagcagaaagaggagagtcgtggtaacgaagatcacgttgcctccattaagaaatacagatctcagatcgagaatgagctgacttcgatctgtaacggcatcctcaagttgcttgattccaaactcatcgggtcagctgctaccggagactccaaggttttctatttgaaaatgaagggagattactaccggtacttggctgagttcaaaaccggaaccgagagaaaagaagctgcagagaatactctttcggcctacaagtctgctcaggatatcgctaatggcgaattggccccaacacatccaatccgattgggtctagctctcaatttctcagtgttttactatgagatattgaattctcctgatcgtgcttgtaatctcgccaaacaggcctttgatgaggcaattgcggagcttgacaccctgggagaggagtcctacaaggatagcactttgattatgcaacttctgcgtgataacctcactttgtggacctcggatatgcaggatgatggaactgatgagatcaaagaaccatcaaaagctgataatgagtagtaacatcgtgagtgaaacttctttgcttagaattgacaaccgatgatgtaattttactcattgatcaaaattggctgtttgtagtccttatcctgtgatttgtaatacctattacctaaaggcgctgtttcttgccatttgttgttttcatcaaagattaccttttgtctaaaaaaaaaaaaaaaaaaaaaa

SEQ ID NO: 603 - protein, 256 aa, Solanum lycopersicum
MASPREENVYMAKFAEQAERSYEEMVEFMEKVVFSLNGEELTVEERNLLSVPYGGLIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 604 - DNA, 1141 bp, Nicotiana tabacum
  CDS (5)..(790)
ggaaatggcttcctccaaagaacgcgagaacttcgtctacgtcgctaagcttgctgagcaagccgaacgctacgatgaaatggttgatgcgatgaagagtgtagcaaatatggatgttgaattgagtgttgaggaaaggaatctgctttctgttggttataagaatgtggtaggttccaggagagcatcttggaggatcttatcctctattgagcagaaggaagaatctagaggaaacgagcaaaatgtcaagcgaatcaaggagtaccgacaaaaggtggagactgagctcaccagcatttgcaatgatatcatggtggtcattgatcagcatctaattccttcatgcactgcaggcgaatcaactgtgttttaccacaagatgaagggagactattatcgttatcttgcagaatttaaatctggcaatgacaagaaagaggttgcagagctttcgttgaaagcatatcagtcagctacaactgctgcagaagcggaattaccacccactcatcccattcggttgggattggctttgaatttctctgttttctattatgagatcatgaattcacctgaaagggcatgccatctggcaaagcaggcctttgatgaagcaatatctgagttggatagcctgaatgaggattcctacaaagacagcaccttgattatgcagcttctaagggacaatctcaccttgtggacttctgatcttccagaggatgcagaagatgcccaaaagggagatgccacaaacaaagcaggtggaggtgaagatgcagagtgaatgggcctaatggttagaactgccttgtgtatttggagctgtgaggacggcgatataccaaggggatgtgtgtttgttaagtcctagtagatacttatcttatgggcatgtcgtgtcagtttctttaatctttacatgttaattgggtgttgcaattcagcatgtgtgtgatttgtatccctgtgctatttcctctccgtaaagtgagttgtttcagtctttagatgattggtttggtccataggtggttttatttttcagatgactgccccagccaaatgggaggacatcagctctttgtttgatctctcaaacttattatcttaaatcaccaattttatatgcggccgc

SEQ ID NO: 605 - protein, 261 aa, Nicotiana tabacum
MASSKERENFVYVAKLAEQAERYDEMVDAMKSVANMDVELSVEERNLLSVGYKNVVGSRRASWRILSSIEQKEESRGNEQNVKRIKEYRQKVETELTSICNDIMVVIDQHLIPSCTAGESTVFYHKMKGDYYRYLAEFKSGNDKKEVAELSLKAYQSATTAAEAELPPTHPIRLGLALNFSVFYYEIMNSPERACHLAKQAFDEAISELDSLNEDSYKDSTLIMQLLRDNLTLWTSDLPEDAEDAQKGDATNKAGGGEDAE

SEQ ID NO: 606 - DNA, 1061 bp, Nicotiana tabacum
  CDS (15)..(782)
aattagaatccattatggcgcgtgaggagaacgtgtacatggctaagcttgccgagcaagccgagagatacgaggaaatggtatcgttcatggagaaagtctcgacatccctagggacgtcagaggaactcacggtagaggagagaaatctcctctccgtggcgtacaagaacgttatcggggctcgtagagcctcgtggcgtataatctcctccatcgaacagaaggaggagtcgaggggaaacgaggaccacgtcaaatgcattcaggagtacagatctaagattgaatctgaactctccaatatctgtgatggcattctcaagctccttgattcttgtcttattccttcggcttcagctggtgattctaaggtgttttaccttaaaatgaagggtgattatcatcgttatttggctgagtttaagactggcgctgaacgtaaggaagccgctgagagtactctctccgcttacaaagccgctcaggatattgcaaatgctgaacttgccccaactcacccaatccgacttggactggctctcaacttctctgtgttttattatgagattttgaactctcctgatcgtgcttgcaatcttgctaaacaggcctttgacgaagcaattgctgagttggacacactgggagaggagtcttacaaggatagcactttgatcatgcaactgcttcgtgacaatcttactctctggacctctgatatgcaggatgatggcgcagatgaaattaaggaaaccaaagctgacaatgaacaacagtgagggaactgcccctcaaattgtcttttgacttcttcgaagttgtttctttttatttcctttctactgtgggttccctctagcgttctcttgtccgtcgcaataacaactttgattattgatgttcaatgttcatctttaatttgatctggttctggtgctttgtttctagtaaagcatttcagttgtatttgtgaactggatttattaaaatggtacaccgaagtgatactcagcaatcaaatttcaatcaagctttctttttaaaaaaaaaaaaaaaaa

SEQ ID NO: 607 - protein, 255 aa, Nicotiana tabacum
MAREENVYMAKLAEQAERYEEMVSFMEKVSTSLGTSEELTVEERNLLSVAYKNVIGARRASWRIISSIEQKEESRGNEDHVKCIQEYRSKIESELSNICDGILKLLDSCLIPSASAGDSKVFYLKMKGDYHRYLAEFKTGAERKEAAESTLSAYKAAQDIANAELAPTHPIRLGLALNFSVFYYEILNSPDRACNLAKQAFDEAIAELDTLGEESYKDSTLIMQLLRDNLTLWTSDMQDDGADEIKETKADNEQQ

SEQ ID NO: 608 - DNA, 804 bp, Arabidopsis thaliana
  CDS (1)..(804)
atggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggtcaagagaggaaagatgctgctgaacatactctcaccgcttacaaagctgctcaggatattgctaatgctgaattggctccaacgcatccgattcgtcttggtttggctttgaatttctctgtgttttactatgagattcttaattctccagatcgtgcttgtaatctcgctaagcaggcgtttgatgaagccattgctgagttagatactcttggagaggagtcatacaaggatagtaccttgatcatgcagcttcttcgtgacaatcttactctctggacttctgacatgcaggacgaaagtccggaggagattaaagaagcagcagcaccaaagcctgctgaagaactgaaggagatctaa

SEQ ID NO: 609 - protein, 267 aa, Arabidopsis thaliana
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEELKEI

SEQ ID NO: 610 - DNA, 1126 bp, Pneumocystis carinii
  CDS (151)..(957)
aagaggtcctcctttttttctaggacttatttatatttgggttaagcaaatcaatttagaaaagaattagggaaattattaaagaataatattaggagatcaatataaaggtcaagtcaatatattttaaagtaagaagatttatacgtaatgacaagtcgtgagaatttagtttatcttgcaaaactcgccgaacaggcggagcgatatgaagaaatggttgaaagcatgaagaaagtagcgtcatcagaccaagaacttacggttgaggaaaggaatcttctttcagtagcgtataaaaatgtaattggtgcacgtcgtgcatcatggcgtattgtatcatctattgagcagaaagaagaaaataagggaaatctttctcaggctggtttgattaaagaatatcgttctaaaatcgaatcggagttaactagcatatgcaatgatattttggccgttctggacgctcatttgatcgcctctgcaagtacgggagaaagtaaagtattttattacaaaatgaagggtgattattatcgttatttggctgaatttgcagttggagataagcgcaaagcaccttctgatgcttctttggcagcatataaggaagcatcagatattgcaggtacggatcttccaccaacacatcctattcgtcttgggttggctcttaatttctctgttttttactacgagatattaaattcacccgattgtgcttgtcacttagctaaacaagcattcgacgatgctattgctgagttagatacattatctgaggagtcttataaagattctacgttgattatgcaacttttaagagataatcttacgttgtggacatctgacatgcaggattccaatgagaaaaatgactctaaagaggctgtttcagaagttcctgatccaggaaaaccttctgaaactgaagcttcaaaaacagatgacatttgagttcattatttgtttttaagtataaaatataaaattaactatttaacaattattgattaaaattgtatttatgtatacaagagtgtatcgttttcggattttttaaacattttttacttttattcttactcaaaaaaaaaaaaaaaaaaaaaaaaaaaaaaaaaaaaaa

SEQ ID NO: 611 - protein, 268 aa, Pneumocystis carinii
MTSRENLVYLAKLAEQAERYEEMVESMKKVASSDQELTVEERNLLSVAYKNVIGARRASWRIVSSIEQKEENKGNLSQAGLIKEYRSKIESELTSICNDILAVLDAHLIASASTGESKVFYYKMKGDYYRYLAEFAVGDKRKAPSDASLAAYKEASDIAGTDLPPTHPIRLGLALNFSVFYYEILNSPDCACHLAKQAFDDAIAELDTLSEESYKDSTLIMQLLRDNLTLWTSDMQDSNEKNDSKEAVSEVPDPGKPSETEASKTDDI

SEQ ID NO: 612 - DNA, 1129 bp, Brassica napus
  CDS (75)..(857)
aattcggcacgaggattcgtcaagaataatcaatcacataagatcagatctcagatctctgaagaaggaagaagatggcggtttctgcgcgtgaggagttcgtgtacatggccaagctcgccgagcaagcggagaggtacgaggaaatggtagagttcatggagaaagtctccgccgccgtcgacggcgatgaactcaccgtcgaggagcgaaatctcctctccgtcgcttacaaaaacgtgatcggcgcccgccgtgcctcgtggcgcatcatttcgtcgatcgagcagaaggaagagagccgcggcaacgacgaccacgtcacggcgatccgcgattacagatctaagatcgagacggagctctctggaatctgcgacgggatccttaagctcctcgattcgaggctcgtccccgccgctgcttccggcgattccaaggtgttttacctcaagatgaaaggtgattaccacaggtacttggctgagttcaagactggtcaggagaggaaagacgccgctgagaatactctctccgcttacaaagctgctcaggatattgcgaatgcagagctagctccaactcacccaatccgtctaggtctggcattgaacttctctgtgttctactacgagatccttaactctcctgatcgtgcctgcagcctcgccaaacaggcctttgatgacgcgatagccgagttggacactctaggtgaagggtcgtacaaagacagcaccttgatcatgcagcttctccgtgacaacctcactctctggacatccgacatgcaggatgatgctgcggatgagatcaaggaagcatcagctccaaaaccaacagaggaacagcagtaacaatcttttgagtgaactgctaagtttctagggggtttgaaactttgttttctctttcgtccatatgtttcctaggtcgtcgcttgcccattcgcttttattcattcatcatgatttctggcaagtctgaaccatcaatcatcttctatctcagttgcttgaatgtgggttaatgatttcagtgtctgccatcgaaccttgctttgtgtgtttctcatcaatttgaagatacttttgtccgtcttaaaaaaaaaaaaaaaaaaaaaaaaaaa

SEQ ID NO: 613 - protein, 260 aa, Brassica napus
MAVSAREEFVYMAKLAEQAERYEEMVEFMEKVSAAVDGDELTVEERNLLSVAYKNVIGARRASWRIISSIEQKEESRGNDDHVTAIRDYRSKIETELSGICDGILKLLDSRLVPAAASGDSKVFYLKMKGDYHRYLAEFKTGQERKDAAENTLSAYKAAQDIANAELAPTHPIRLGLALNFSVFYYEILNSPDRACSLAKQAFDDAIAELDTLGEGSYKDSTLIMQLLRDNLTLWTSDMQDDAADEIKEASAPKPTEEQQ

SEQ ID NO: 614 - DNA, 1066 bp, Schizophyllum commune
  CDS (99)..(872)
ggcacgagctcgtgccgaattcggcacgagtcaacatcgaccatctccagccactcttcatcgtcgccccacctccttccacctaaacaccatccataatgcctgaatcgcgtgaggactctgtctaccttgccaagctcgctgagcaggctgagcgctatgaggagatggtcgagaacatgaagcgcgttgcgtcttccgaccaggagctcaccgttgaggagcgcaacctcttgtctgtcgcgtacaagaacgtcatcggcgcgcgccgcgcgtcctggagaatcgtctcctccatcgagcagaaggaggagtcgaagggcaacgaggcccaggtctccatgatcaagggctaccgggagaagatcgagggcgagctcgcaaagatctgcgaggacatcctcgacgtcctcgagaagcatctcatcccgtcggccgcgtctggcgagtcgaaggtcttctaccacaagatgatgggtgactaccaccgctacctcgccgagttcgcgactggcgacaagcgtaaagacagcgccgacaagtccctggaggcttacaaggctgcgtctgacgttgccgtcaccgagctcccgcccacacatcccatccgcctcggcctcgccctcaacttctccgtcttctactacgagatcctcaacagccccgaccgtgcttgccacctcgccaagcaggcgttcgacgatgccatcgccgagctcgacaccttgtccgaggagagctacaaggactcgaccttgatcatgcagctcttgagggacaacctcaccctatggacctcggacatgcaggactctggcgagaagcccgccgactccaaggatgaggcccccgaagcgccgggcgacgagtaaacgctttttacccgtcatgtatatcccgtcgtcgcatcgcacttgcatgtcctccattcattggaacgttgtcacgatcgctctgttgcattgaccttctttccatctgagtttacctattttttatttccttcgtagttgtggctcgcggtttatcaatcaaagaatcagaagtcaaaaaaaaaaaaaaaaaa

SEQ ID NO: 615 - protein, 257 aa, Schizophyllum commune
MPESREDSVYLAKLAEQAERYEEMVENMKRVASSDQELTVEERNLLSVAYKNVIGARRASWRIVSSIEQKEESKGNEAQVSMIKGYREKIEGELAKICEDILDVLEKHLIPSAASGESKVFYHKMMGDYHRYLAEFATGDKRKDSADKSLEAYKAASDVAVTELPPTHPIRLGLALNFSVFYYEILNSPDRACHLAKQAFDDAIAELDTLSEESYKDSTLIMQLLRDNLTLWTSDMQDSGEKPADSKDEAPEAPGDE

SEQ ID NO: 616 - DNA, 786 bp, Emericella nidulans
  CDS (1)..(786)
atgggtcacgaagatgctgtttacctggccaagctcgccgagcaggctgaacgctatgaggaaatggttgagaacatgaaggttgtcgccgcctctgacgtagagctcactgtggaagagcggaatctgctttctgttgcctacaagaacgtcatcggcgcccgccgtgcgtcctggagaattgttacctccatcgaacaaaaagaggagtccaagggcaacaagtcccaagttgctctcattaaggagtaccgccagaagattgagggcgagctcgccaaaatctgccaggacatcctggacgttctcgaccagcacctgatcaagtccgctcagagcggcgagtccaaggtcttctaccacaagatgaagggtgactaccaccgttaccttgccgagttcgctgttggcgacaaccgcaaggctgcggccgacgcctccctggaggcctacaagtctgccaccgaagtcgctcagaccgaccttgcccctactcaccccatccgtctcggcttggcccttaacttctctgtcttctactacgagattctcaactctcccgaccaggcttgccacctcgccaagcttgctttcgacgatgctattgccgagcttgacaccctgagcgaagagagctacaaggactccactcttattatgcagcttctcagggataacctgactctctggacctcctctgaggccgaacccgctgcagagaatgcccccgccgaaaagaaggaggaagcccccgccgctgagggcgaggagaagcccgctgaataa

SEQ ID NO: 617 - protein, 261 aa, Emericella nidulans
MGHEDAVYLAKLAEQAERYEEMVENMKVVAASDVELTVEERNLLSVAYKNVIGARRASWRIVTSIEQKEESKGNKSQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 618 - DNA, 1214 bp, Vicia faba
  CDS (77)..(850)
  misc_feature (8)..(8): n is a, g, c or t
  misc_feature (11)..(11): w is a or t
gggggggntgwttcatcaccaccctcacatcaaacaaccaaaaccgtttcgcaaattccaacctcccagatccgccatggcatcctccaaagaaaccttcgtctacaccgccaagctcgccgagcaagccgaacgctacgaagaaatggttgaagcgatgaagaatgtcgctaagcttgacgttgaattgacggtggaagagcggaatcttctgtctgttgcgtataagaatgttgtgggaggacgtagggcctcgtggaggattctttcctcgattgagcaaagggaggagacgaaagggaatgaggtgaatgtgaatcggattaaggagtataggaagaaggttgaatcggagttgtctgatatctgtactgatatcatggctgtgattgatgaacatcttattccgaattcgtctggtgaatcgaatgtgttttactacaaaatgaaaggtgactattatcgttatttggctgagtttaagagtggggatgacaggaaagaggctgctgatcagtccttgaaagcatatcaggaagcttccactgctgcagagaccgagttgcctcccactcatcctgtcagattgggtttggctttgaacttctctgtcttctattatgaaatcttgaactctcctgaaagggcctgtcaccttgccaagcaggcatttgatgtagcaattgctgagttggattctctcaatgaggaatcttacaaagacagcacactgatcatgcagcttctgagggacaacctgacattgtggacttctgatattcctgaggaaggagttgaggaacaaaaggcggagtctgccagagctcctgtaggagataatgcagagtaaagtgacaggttttaaaaggggtttgtggtgttatgtgtgaatacaaaagattagcctccatgcaagttctggtggttttctctttccatgttttctagttctaggaagtttatagctgattgaagagttagtgagtctctataggaaaattataaatcctaagctcctcttcatttgacaatggaatacatcatcgtcaatgttgctttaggttctgttttagctattgataaaaaaagaggatctgttttagctacaggaaacaatagatccatggttggctgtaatttcgttggtgctctggttttacttatgcactattcaaaatgatgccttgtagattcaaaaaaaaaaaaaaaaaaaa

SEQ ID NO: 619 - protein, 257 aa, Vicia faba
MASSKETFVYTAKLAEQAERYEEMVEAMKNVAKLDVELTVEERNLLSVAYKNVVGGRRASWRILSSIEQREETKGNEVNVNRIKEYRKKVESELSDICTDIMAVIDEHLIPNSSGESNVFYYKMKGDYYRYLAEFKSGDDRKEAADQSLKAYQEASTAAETELPPTHPVRLGLALNFSVFYYEILNSPERACHLAKQAFDVAIAELDSLNEESYKDSTLIMQLLRDNLTLWTSDIPEEGVEEQKAESARAPVGDNAE

SEQ ID NO: 620 - DNA, 1102 bp, Vicia faba
  CDS (88)..(879)
atatcggtatcgtctcaaagacagtcaaacacaaacctcagaaaaacaccacacacagaacacacacaaaaaaaccgaacaacaaaaatgggtatcacggttccagaaaacctaacaaaactgggtgtcgcggttccagaaaacctaaacagagaacagtacgtgtacctcgcaaagctcgcagagcaagcagagcgttatgaagagatggtatccttcatgcagaagctagtgctagtgtccacaccatcctctgagctcagcgtcgaagagaggaacctgatatccgtcgcttacaagaacgtgatcgggtcgctacgtgcggcgtggaggattgtctcgtcgattgagcagaaggaggaaggtagaaagaatgatgaccatgttgtgcttgttaaggattatagatctaaggttgaagcggagttgtcgaatgtttgtgctagtattttggagctgttggacaagaatttgattccttcggggtcttcgagtgagagtaaggttttttattataagatgaaaggggattatcataggtatttggctgagtttaagattggggaggagaggaaatctgctgctgaggatactatgttgtcgtacaaggctgcacaggatattgctgctgctgatcttccatctactcatcctataagattgggtttggctctcaatttctctgtgttctattatgagattcttaaccagtctgacaaagcttgtgccatggccaaacaggcttttgaggaagcaattgctgagctggacacattgggagaagaatcttacaaagacagcacgcttataatgcaacttttgagagacaacctcaccctttggacttctgatgtccaggatcagctagatgagccctgatttctctcataggttgacgagtcgtattcttccctctgaaggaggtgggctatgaatgtcatttatatgtgttgattaagaatcgcctagtttataaatttaccagcaatctgtggtatagtgtcatatgaacctgtcttgttttttatgtctgatatgctttgaatctgttatcctaatgggagatcaaactaaattatattcgttgcaaaaaaaaaaaaaa

SEQ ID NO: 621 - protein, 263 aa, Vicia faba
MGITVPENLTKLGVAVPENLNREQYVYLAKLAEQAERYEEMVSFMQKLVLVSTPSSELSVEERNLISVAYKNVIGSLRAAWRIVSSIEQKEEGRKNDDHVVLVKDYRSKVEAELSNVCASILELLDKNLIPSGSSSESKVFYYKMKGDYHRYLAEFKIGEERKSAAEDTMLSYKAAQDIAAADLPSTHPIRLGLALNFSVFYYEILNQSDKACAMAKQAFEEAIAELDTLGEESYKDSTLIMQLLRDNLTLWTSDVQDQLDEP

SEQ ID NO: 622 - DNA, 984 bp, Triticum aestivum
  CDS (11)..(790)
gtcgacagcgatggcaaaggcagcggcaacgagggaggagatggtctacttggcgaagctggcggagcaggccgagcggtacgaggagatggtcgagttcatggagaaggtcgtggcggcggcggggaccgtcgagctcaccatcgaggagaggaacctgctctcagtcgcgtacaagaacgtcatcggggcgcgtcgtgcttcctggcgcatcgtgtcctccatcgagcagaaggaggaagggcgtggagcggcggggcacgccgccgcggcgcgcgggtaccgcgcacttgtcgaggccgagctctccaacatctgcgcggggatcctccgtctcctcgacgaacgcctagtccccgccgctgccgccgtcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgccaaacaggccttcgatgaagccatcgctgagctggattccctcggagaagattcctacaaggacagcaccctgatcatgcaacttctccgtgacaatctcactttgtggacctctgatatgcaggatgacgctggcgatgaaatgagggattcaagcaagcctgaggatgagcagtagtgaagggtcctagctactgccctctttctctcttaaccttcgggtagttatgatgcttgtacaaggaccattttcgtgtgtcctttgttgctgggtcttttatctaccctttctttcgttatattgttatacatcgccgtcctcgtgcattattttactttacaacttgaatccaaaaaaaaaaaaaaaaaaaa

SEQ ID NO: 623 - protein, 259 aa, Triticum aestivum
MAKAAATREEMVYLAKLAEQAERYEEMVEFMEKVVAAAGTVELTIEERNLLSVAYKNVIGARRASWRIVSSIEQKEEGRGAAGHAAAARGYRALVEAELSNICAGILRLLDERLVPAAAAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 624 - DNA, 1094 bp, Triticum aestivum
  CDS (38)..(838)
cgttgccacacgcccttgcacaagcgagcgagcaaccatgtcgccagcagagccgacgcgagacgagagcgtctacatggccaagcttgcggagcaggccgagcgctacgaggagatggtggagttcatggagcgcgtcgcgaaggccaccggcggggcagggcccggggaggagctatccgtcgaggagcgcaacctgctctctgtggcttacaagaatgtcatcggggcccggcgcgcgtcctggaggatcatctcctccatcgagcagaaggaggaaggtcggggcaacgacgcgcacgccgccaccatccgctcctaccgcagcaagatcgaggccgagctcgcaaagatctgcgacggcatcctcgccctgcttgattcccacctcgtgccatccgccggagctgccgagtccaaagtcttctatctcaagatgaagggcgactaccacaggtaccttgcagagtttaagtccggtggggagaggaaggaagccgccgagagcaccatgaacgcgtacaaagctgctcaggatatcgccctagcagatttggctccaacccaccccatcaggcttgggcttgcactcaacttttctgtgttctactatgagatcttgaactcccctgaccgcgcctgcaaccttgcaaaacaagcctttgatgaggctatatcagagctggacagcttaggcgaggaatcctacaaggacagcactttaatcatgcagctcctgcgtgacaatttgactctatggacatccgacaccaatgaggatgacgttgatgagattaaggaagccccagctccaaaagaatctggagacggacagtgaggtgaatgaaaacaacagtctgtgcattgttgggggcaatggaagtcggtcttggttctagtgctcatactgttgtcatcactacctctgtttaattatgcacttaagaagtttctgggctatgtttttctggtgctgataaatgctggctggattcgtgttttctttttaaatctcgccacaagcaaaagacctgctctttttcaccattagaatgtttgctatatctaaaaaaaaaaaaaaaaaaaaaaaaaaa

SEQ ID NO: 625 - protein, 266 aa, Triticum aestivum
MSPAEPTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGGERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 626 - DNA, 819 bp, Trichoderma reesei
  CDS (1)..(819)
atggccaccgagcgtgaaagcaagaccttcctggcccgcctctgcgagcaggccgagcgctacgatgagatggtcacctacatgaaggaggtggcccagctcggcggtgagctcagcgtcgacgagcgcaacctcctcagcgtcgcctacaagaacgtcgtcggcacccgccgtgcctcgtggcgcatcatctcctccatcgagcagaaggaggagtccaagggctccgacaagcacgttgccaccatcaaggagtaccgcagcaagatcgagctcgagctcgagaaggtctgcgaggatgtcctcaacgtcctggacactagcctcatccccaacgccgccactggcgagtccaaggtcttttaccacaagatgaagggtgactaccaccgctaccttgccgagttcgcctctggcgagaagcgcaaggtcgctgccactgccgctcacgaggcctacaagaacgctaccgacgttgcccagaccgagctgactcccactcaccccatccgcctgggtctcgccctcaacttctccgtgttctactacgagatcctcaactcccccgaccgtgcttgccaccttgccaagcaggccttcgatgatgccatcgccgagctcgactccctctctgaggagtcctaccgcgacagcactctcatcatgcagctcctgcgtgacaacctgaccctgtggacttcatccgacagcggtgaggccgagcaggccggcgaggccaagaaggacgagggtgaagcggccaagcctgccgaggaagaacccaaggctgaggagcccgctcccgaggctacttcctaa

SEQ ID NO: 627 - protein, 272 aa, Trichoderma reesei
MATERESKTFLARLCEQAERYDEMVTYMKEVAQLGGELSVDERNLLSVAYKNVVGTRRASWRIISSIEQKEESKGSDKHVATIKEYRSKIELELEKVCEDVLNVLDTSLIPNAATGESKVFYHKMKGDYHRYLAEFASGEKRKVAATAAHEAYKNATDVAQTELTPTHPIRLGLALNFSVFYYEILNSPDRACHLAKQAFDDAIAELDSLSEESYRDSTLIMQLLRDNLTLWTSSDSGEAEQAGEAKKDEGEAAKPAEEEPKAEEPAPEATS

SEQ ID NO: 628 - DNA, 795 bp, Trichoderma reesei
  CDS (1)..(795)
atgggtcacgaagatgctgtttacctggccaagctcgccgagcaggctgagcgatatgaggagatggttgagaacatgaagattgtcgcctccgaggaccgcgacctcaccgtcgaggagcgcaacctgctctccgtcgcctacaagaacgtcattggcgcccgccgtgcctcttggagaatagtcacctctatcgagcagaaggaggagtctaagggcaactcttcccaggtcgcccttatcaaggagtaccgccagaagatcgaggccgagctcgccaagatctgcgacgacatcctcgaggtcctcgaccagcacctgattccctctgccaagtccggagagtccaaggtcttctaccacaagatgaagggtgactaccaccgttaccttgccgagttcgccattggcgaccgccgcaaggactctgccgacaagtccctcgaggcctacaaggcggccaccgaggttgcccagaccgagctgcctcccacccaccccatccgcctgggtctcgccctcaacttctccgtcttctactacgagatcctcaacgcccccgaccaggcttgccaccttgccaagcaggcctttgacgatgccattgccgagctcgacaccctcagcgaggagagctacaaggactcgactctcatcatgcagctcctccgcgacaaccttactctctggacctcttctgaggctgagacctctgccggccaagttgaggctccccctaaggaggacacccctgccgaggccgctgctcctgctgaggagcccaaggctgagtaa

SEQ ID NO: 629 - protein, 264 aa, Trichoderma reesei
MGHEDAVYLAKLAEQAERYEEMVENMKIVASEDRDLTVEERNLLSVAYKNVIGARRASWRIVTSIEQKEESKGNSSQVALIKEYRQKIEAELAKICDDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAGQVEAPPKEDTPAEAAAPAEEPKAE

SEQ ID NO: 630 - DNA, 1000 bp, Populus tremula x Populus alba
  CDS (19)..(801)
gataaatcagcaatagccatggattcttcaaaagatcgtgagaacttcgtctacgtcgccaagctcgccgagcaagctgaacgctacgacgaaatggtggatgcgatgaagaaagtagcaaagcttgatgttgaactaacggtggaggagagaaacttactctctgtgggctacaagaatgtgatcggtgcgagaagggcgtcgtggagaatcttgtcatctattgagcagaaggaggagtcgaaagggaatgagacgaatgtgaagaggatcaaggagtataggcagaaggtggaagcagagttaactggcatttgccatgatatcatgacagtgattgatgagcatcttattccatcatgtacagctggggaatccactgtgttttactacaagatgaaaggtgattattaccggtatctagcagagttcaagagtggtaacgagaggaaagaggcagctgatcagtcacttaaggcatatgagactgctacaacaactgcagccagtgatctttctcccacccatcctattagactgggcctggctcttaatttctctgtgttctattatgagattatgaactctcctgaacgggcctgccatcttgcaaagcaagcatttgatgaagctatttcagaactggataccctgagtgaagagtcttacaaggacagcactttgattatgcagctgttgagggacaacctcactttgtggacttctgatattcctgaggatggagaagatcagaagatggaaacctctgctagaactggtgagggtgaagatgccgagtgaccgtgctaatagagaaccttctggtccttgaaggcgtgaatgggagtaggatgatttcccctagtgttgttctattgctttatttcaagaggatttttgtagtaccttatctcagttggtgttgatccctgtttcattcagctatgtattagcagaaatatttgttgggttataaaatattggtagccaacgactattg

SEQ ID NO: 631 - protein, 260 aa, Populus tremula x Populus alba
MDSSKDRENFVYVAKLAEQAERYDEMVDAMKKVAKLDVELTVEERNLLSVGYKNVIGARRASWRILSSIEQKEESKGNETNVKRIKEYRQKVEAELTGICHDIMTVIDEHLIPSCTAGESTVFYYKMKGDYYRYLAEFKSGNERKEAADQSLKAYETATTTAASDLSPTHPIRLGLALNFSVFYYEIMNSPERACHLAKQAFDEAISELDTLSEESYKDSTLIMQLLRDNLTLWTSDIPEDGEDQKMETSARTGEGEDAE

SEQ ID NO: 632 - DNA, 1014 bp, Populus tremula x Populus alba
  CDS (78)..(866)
ggagagatagagagagagagagatccgtctctgcaaatctctgtccacgaagtaacttttagtttgatatataaaggatgtctccaactgaatcatcacgtgaagagaatgtttacatggccaagttggctgaacaggccgaacgttatgaagaaatggtggagtttatggagaaagttgcaaagacagtcgataatgaggagctaaccatggaggaaaggaacttgctctccgtggcctacaaaaatgtgattggagctaggagggcttcatggaggatcatctcttccattgagcagaaggaagagagtaggggaaatgaagatcatgtcacaatcatcaaggagtataggggaaagatcgaagctgagctctgcaagatctgtgacggaatcttgagcctccttgagacacatcttgttccctctgcctcagctgctgagtccaaggtattttacctcaagatgaagggtgattatcacaggtatcttgccgagtttaagaccggggctgagaggaaggaagctgctgagagcactttgttgtcgtacaagtctgctcaggatattgctctttctgaactggctcctacccacccaataaggctggggcttgcacttaacttctctgtcttctactatgagatccttaactctcctgatcgtgcttgcagtcttgctaagcaggcttttgatgaggctatttccgagctggatactttgggtgaggagtcttacaaggacagcacattgatcatgcaacttctccgtgacaatctgacactctggacttctgatatcacggatgatgctggggatgagatcaaggaagcatcaaaacgtgaatcaggcgatgggccgcagtgatgaaattcagctcataggatatgcactctgtacttctatctcgtgacatttacagacgccatttgggttattgtagctggatgttttaatgaattttatagccttgagtgtcctgctaaaaaaaaaaaaaaaaaaaaaaaaaaaaaaa

SEQ ID NO: 633 - protein, 262 aa, Populus tremula x Populus alba
MSPTESSREENVYMAKLAEQAERYEEMVEFMEKVAKTVDNEELTMEERNLLSVAYKNVIGARRASWRIISSIEQKEESRGNEDHVTIIKEYRGKIEAELCKICDGILSLLETHLVPSASAAESKVFYLKMKGDYHRYLAEFKTGAERKEAAESTLLSYKSAQDIALSELAPTHPIRLGLALNFSVFYYEILNSPDRACSLAKQAFDEAISELDTLGEESYKDSTLIMQLLRDNLTLWTSDITDDAGDEIKEASKRESGDGPQ

SEQ ID NO: 634 - DNA, 1286 bp, Glycine max
  CDS (98)..(889)
tttcacttcacttgtggttcctcactctctctctctccacaccacactgaggagggagacagtggaaggaaggaacactcaaatcactgaaccagccatggctaccttctccaaggaacgcgagaactttgtatacgttgccaagttagctgaacaagctgaacgctatgatgaaatggtggatgccatgaagaaggtggcgaagctggacgttgagttgagtgtggaagagaggaacctgttctctgttgggtacaagaatgtggtggggtcacggagagcttcatggagaatcttgtcatcgatagagcagaaagaggattccaaagggaatgagttgcatgttaagcatatcagggattacaggaacaaggtggagttggagctgtccaacatttgcagtgacattatgataattttagatgagcatcttattccatccactaatattgcggagtccacagtgttttattataagatgaaaggagactattaccggtatttggcagaatttaaagctggcaatgaaaagaaagaggtggcagatcagtcacttaaagcatatcagacagcttctaccactgctgagagtgaactacaacctacacatcctattcgtttgggtctggctctaaatttctcagtgttttattatgagatattaaattcacctgaaagggcctgccatcttgcaaagcaagcctttgatgatgctgtctcggagctggataccctgaatgaggattcttacaaggacagtaccttgattatgcagctgttgagggataaccttactttatggacttctgatatccccgaagagggtgaggacctaaaaatggaaagcgcagccagggttgatcaaggagaagatgagttaggccgctaacccatcattctgtcatatgtctaagatttgatgcattaatttttctcaatcatattttctccattgtagtgaagcctctatctgaatggtgcactgcacctcatcaactttgagtcattcttatttttgagtgatggcctatttgagtcatctacttcatttttatgctattgttgagtagttttattcatgtgtttgtgacacaaaaacaccattggtttgcaatgcataatttccctatttgtatcctgttatggttaagatctgttcttgggttggcctttcaagaactgatcacatgtgagccactgtaatattgcaatatttagacttttgttaagtctcattttattaagacagacaaattaggttaaaaaaaaaaaaaaaaaaaaaaaaa

SEQ ID NO: 635 - protein, 263 aa, Glycine max
MATFSKERENFVYVAKLAEQAERYDEMVDAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 636 - DNA, 1098 bp, Euphorbia esula
  CDS (76)..(855)
gctctctctctctcctcacttgctcaactgagtcaattttagctctgtacacagaagattctactaagatctgccatggattcttctaaagatcgcgaaaccttcgtctatctcgccaagcttgccgagcaagccgagcgctacgatgaaatggtagagtcgatgaagaaagtagcgaatctcgatgttgaattgacagtagaggagaggaatcttctatctgttggttacaagaatgtagtgggctcacggcgggcctcttggaggatcttgtcctcgattgaacagaaggaggagtcgaaagggaacgaaattaatgctaagaggattaaggagtacaggaacaaagtggaatcggagctgtctactatttgcagcgacattatgactgtgatcgatgagcatctcattccatcttgtaacgctggggaatccactgtgttctactataagatgaaaggtgattattatcgttatctagctgagttcaaggctggtaatgacaagaaagaggcagctgatcagtcccttaaggcataccagactgcctcaaccactgcagagactgatttacctcccacccatcccattcgattgggtttagcgctcaacttttctgtcttctattacgagattatgaactcgcctgaaagggcctgccacctggcaaagcaagcttttgatgaagctatttcagagctggatacattgagcgaagaatcttacaaggacagcaccttgatcatgcagctattgagggacaacttgactttgtggacctctgacatcccagaggatggagaccagaaaatggaaacctctggaaaagctagtgggggagaagatgcagagtgaagcagaagctagtaggagtttgttagtgttcaatgtgtggaagggagaagtatgatttcccctcaactttatactattgttgtttgagagaggattttggagattttctcttgtgttgttgtatccttgttgttgttgttgttttctggtgtaatctgtttgtaggaaaatttgggatgttgtagaggtgtttgtgattattttggtttctcaaaatacctactaaaaaaaaaaaaaaaaaaa

SEQ ID NO: 637 - protein, 259 aa, Euphorbia esula
MDSSKDRETFVYLAKLAEQAERYDEMVESMKKVANLDVELTVEERNLLSVGYKNVVGSRRASWRILSSIEQKEESKGNEINAKRIKEYRNKVESELSTICSDIMTVIDEHLIPSCNAGESTVFYYKMKGDYYRYLAEFKAGNDKKEAADQSLKAYQTASTTAETDLPPTHPIRLGLALNFSVFYYEIMNSPERACHLAKQAFDEAISELDTLSEESYKDSTLIMQLLRDNLTLWTSDIPEDGDQKMETSGKASGGEDAE

SEQ ID NO: 638 - DNA, 869 bp, Pisum sativum
  CDS (68)..(850)
tctcaatcgctttctctctctaaactccctaaaaccagatctcgctttctctctctaggtttcaacaatggcggccgctcatactcctcgggaagagaacgtctacatggctaagctcgccgagcaagccgagcgctacgaagaaatggtggagttcatggaaaaggtttccgctaacgccgatagcgaagaactcaccgtggaggagaggaatcttctctccgtggcttacaaaaacgtgatcggagctagacgtgcctcgtggcgtatcatttcgtcgatcgagcagaaggaagagagccgcggcaacgaggatcacgtcgacgtcatccgtgattaccgatctaaaatcgagtctgagctctctaacatctgcgacggtatcctcaagctcctcgatactcgtctcattccatcagcttcctctggcgattctaaggttttctaccttaagatgaagggagattaccacaggtacctcgctgagtttaagaccggagccgagcgtaaggaggctgcagagagcactcttgccgcttacaaatctgctcaggacattgcaaatgctgaattaccaccaactcatccaattaggcttggccttgctctgaacttctccgttttttactatgaaatccttaactctcctgatcgtgcctgcaatcttgcaaaacaggcttttgatgaagctattgctgaattggatacccttggagaggaatcatacaaggatagcactttgatcatgcaacttcttcgtgataatctcaccctatggacctctgacatgcaggatgatggtgctgatgaaattaaagaagcagccccaaaagcagatgaacagcagtaaacaaattcaactgccaatt

SEQ ID NO: 639 - protein, 260 aa, Pisum sativum
MAAAHTPREENVYMAKLAEQAERYEEMVEFMEKVSANADSEELTVEERNLLSVAYKNVIGARRASWRIISSIEQKEESRGNEDHVDVIRDYRSKIESELSNICDGILKLLDTRLIPSASSGDSKVFYLKMKGDYHRYLAEFKTGAERKEAAESTLAAYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKADEQQ

SEQ ID NO: 640 - DNA, 1108 bp, Lentinula edodes
  CDS (65)..(835)
ccatcatctcctcatcgtatccaacaatcaccaccctcccaatcttataacattatctctcatcatgcctgaaactcgtgaagactctgtctacctcgccaagctcgctgagcaagccgagcgctacgaagagatggtcgagaacatgaaacgcgttgcctcgtcagaccaagagcttactgttgaggagagaaatttgttatctgtcgcgtacaagaatgttatcggagctcgtcgtgcttcgtggagaattgtatcgtcgatcgagcaaaaggaggaatccaagggcaatgaggcccaagtctccatgattaagggctaccgggagaagatcgaaaccgaactcgcagagatttgcgaggacattctcgatgttcttgacaagcaccttattccttccgccgcttcgggcgagtcgaaggttttctaccacaagatgatgggtgactaccaccgttatctcgccgaatttgccactggcgacaaacggaaagagagtgctgacaagtccctcgaggcatacaaagcggcctctgacgttgctgtcactgaactccctcccacgcaccctatccgtctcggtctcgcattgaacttctccgtgttctactacgagatcctcaacagccccgaccgtgcatgtcatcttgccaagcaggcattcgatgatgctattgcagagcttgacaccctctcggaagaaagctacaaggactctactctcatcatgcagctcctcagggacaatctcactctctggacttctgacatgcaggattctgccgacaaacctgcagaaaaagatgaagccgccgacgcacctgctgatgagtagattcgagttttttattgatcaaattgtattccttgtgttatatcgctctcgcatccctccaccaccatcatgcttatatccggaacgccgtcctcccttccccgggctcctcaccacgttgatctcgccttcgcactcattcctcatatccgtacttgacgtccaataactctacacttattatggctacatactacatagtatttgacttttcttttgcatggtctcctgtgatgaattaaaagcgtaaaacatgataaaaaaaaaaaaaaa

SEQ ID NO: 641 - protein, 256 aa, Lentinula edodes
MPETREDSVYLAKLAEQAERYEEMVENMKRVASSDQELTVEERNLLSVAYKNVIGARRASWRIVSSIEQKEESKGNEAQVSMIKGYREKIETELAEICEDILDVLDKHLIPSAASGESKVFYHKMMGDYHRYLAEFATGDKRKESADKSLEAYKAASDVAVTELPPTHPIRLGLALNFSVFYYEILNSPDRACHLAKQAFDDAIAELDTLSEESYKDSTLIMQLLRDNLTLWTSDMQDSADKPAEKDEAADAPADE

SEQ ID NO: 642 - DNA, 1051 bp, Populus tremula x Populus alba
  CDS (9)..(794)
ctaaaacaatggcggccacaccatcagctcgcgaggaaagtgtttacatggcaaaactcgccgagcaagccgaacgttacgaagaaatggtggagtacatggagaaagtctctgcctccctcgagaacgaggaactcaccgtggaagagcgaaacctcctctccgtggcttacaaaaacgtgatcggagctagacgtgcttcgtggaggattatttcctcgatcgagcagaaagaagagagtcgtggtaacgaagaccacgtgtctgtgatccgtgactacagggccaagattgagaccgaactgtcttcgatctgtgacgggatcttgaagttgctcgattcgaggttgattccaacggcctcggctggtgattcgaaggtgttctatttgaagatgaagggagattatcacaggtacttggccgagtttaaaactggtgctgaaaggaaagaggctgctgagagcactctcactgcttacaaagccgctcaggacattgcaaatgcagagctagctcccactcacccaatccgtctaggattggctcttaacttctctgtcttttactatgaaattctcaactctccagatcgtgcttgcagtctcgctaaacaggcttttgacgaggccattgcggagctggatacgttgggtgaggagtcatacaaggacagcactttgatcatgcaactccttcgtgacaatcttactctttggacctctgacatgcaggacgacggtgctgatgagattaaagaagcagcacccaaacctggtgatgaacagcagtgaaggtgctctactgcaaattagggttgaacttctcctctatatgtttttaataggagaaggtgcttgttgctaatttgcttgttattctgatcttttaggcattcttgtcttggttatgaatcatggacgcgccaagcttttctttcttattttcttttagtttgtcatatcaatttgtgtttctggatggcccttgttttcgtaatgatatctggttttgccattaaaaaaaaaaaaaaaaaaaaaaaaaaaaaaaa

SEQ ID NO: 643 - protein, 261 aa, Populus tremula x Populus alba
MAATPSAREESVYMAKLAEQAERYEEMVEYMEKVSASLENEELTVEERNLLSVAYKNVIGARRASWRIISSIEQKEESRGNEDHVSVIRDYRAKIETELSSICDGILKLLDSRLIPTASAGDSKVFYLKMKGDYHRYLAEFKTGAERKEAAESTLTAYKAAQDIANAELAPTHPIRLGLALNFSVFYYEILNSPDRACSLAKQAFDEAIAELDTLGEESYKDSTLIMQLLRDNLTLWTSDMQDDGADEIKEAAPKPGDEQQ

SEQ ID NO: 644 - DNA, 1102 bp, Populus tremula x Populus alba
  CDS (51)..(833)
ggagtgtgtttgtttgtgtgtgattttctagagatagatcagagatagccatggattcgtcaaaggatcgcgagaacttcgtctacgtcgctaagctcgccgagcaagctgaacgctacgacgaaatggtggatgccatgaagaaagtggcgaaacttgatgttgaattaacagtggaggagagaaacttgctctctgtgggatacaagaatgtgattggtgcgaggagggcatcatggagaatcttgtcatcaattgagcagaaggaggagtcaaaagggaatgaaacaaatgtgaagaggatcaaagagtataggaagaaggtggaggcagagttaactggcgtttgcaatgatatcatgactgtgattgatgagcatctcattccatcatctatacctggggaatccgctgtgttctactataagatgaaaggtgattattaccggtatctagcagagttcaagagtggtaatgagaggaaagaggcagctgatcagtcacttaaggcatatgagactgctacatcaactgcagcaagagatctatctcccacccatcccattcgattgggtttggctcttaatttctctgtgttctactatgagattatgaactcaccagaacgggcctgccatcttgcgaagcaatcatttgatgaagctatttcagagctggataccctgagtgaagagtcttacaaggatagcactttgattatgcaactgttgagggacaacctcactctgtggacttctgatattcctgaggatggagaagaccagaagatggaaacctctgcaaaagctggtgggggtgaagatgctgagtgatgatgcgaccggaactctgatgagtgaatgggaggaggatgattttctcacattgttgtgtcattgctatactttaagagaggtttttgagattttctcatttgctgtaccttactattgtcacttggtgttagtctctttgtccgtcaactatgaattagcaggaatatttgttgggttgtaatatggatggcctacgattattgctggtttttcatatttccttgcaggccaattatatttcaattggttattttgggtaaagaatt

SEQ ID NO: 645 - protein, 260 aa, Populus tremula x Populus alba
MDSSKDRENFVYVAKLAEQAERYDEMVDAMKKVAKLDVELTVEERNLLSVGYKNVIGARRASWRILSSIEQKEESKGNETNVKRIKEYRKKVEAELTGVCNDIMTVIDEHLIPSSIPGESAVFYYKMKGDYYRYLAEFKSGNERKEAADQSLKAYETATSTAARDLSPTHPIRLGLALNFSVFYYEIMNSPERACHLAKQSFDEAISELDTLSEESYKDSTLIMQLLRDNLTLWTSDIPEDGEDQKMETSAKAGGGEDAE

SEQ ID NO: 646 - DNA, 1081 bp, Picea glauca
  CDS (180)..(959)
acgaggcactgcccttcattgtctcgctgtgcttctttcacagaaaatccattcacagttcacagtccttggtttggtttcgccattttagtgtacttcttccttttagtggccgtttgttgaagatccagaggtaaagttgggcgtttaagatctgtgcagagatggcggcagcggcgatggtggagtcatcgcgggaggagaatgtatacatggcgaagctggctgagcaggcggagcgctacgaggagatggtggagttcatggagaaagttaccaaaggcgtggaggtggaggagctcacagtcgaggagcgcaaccttctctctgtggcctacaagaacgtgatcggtgcccgccgggcctcctggaggatcatttcctccattgagcagaaggaggagagcaggggcaacgacgaacacgtggtcaccatccgggagtacaggtccaaggtggaatcggagctttccaagatctgcgagggcattctccgcctcctcgactcccatctcatcccttcttccaccgccgcggagtccaaggtcttctatctcaagatgaagggcgattaccatcgataccttgccgagtttaaaacaggcgccgagaggaaggaggccgctgagaacactttgcttgcttacaagtctgcccaggatattgctgcggcagagttggctccaacgcatcctattaggctagggctggctcttaacttctctgtattttactatgagattttgaattcgccagatagagcctgtaatcttgcaaaacaggcatttggtgaggcaattgcggaattagatactttaggtgaagattcttacaaggatagcactctcatcatgcagctgcttcgtgacaatttgacattgtggacctcagacatgcaggaggatgctggggatgagatcaaagagacttctaagcgtgatgaaggagaggagcaatagtgaaatatgatgatctattagtatattaggattagattagcaggctatcctgcattgtttggtaaaggaggctatgtgcacgaatgtgtttattagatctcatgctctgcagtatttagttg

SEQ ID NO: 647 - protein, 259 aa, Picea glauca
MVESSREENVYMAKLAEQAERYEEMVEFMEKVTKGVEVEELTVEERNLLSVAYKNVIGARRASWRIISSIEQKEESRGNDEHVVTIREYRSKVESELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFGEAIAELDTLGEDSYKDSTLIMQLLRDNLTLWTSDMQEDAGDEIKETSKRDEGEEQ

SEQ ID NO: 648 - DNA, 832 bp, Pisum sativum
  CDS (45)..(830)
tttctctcactctctctcctccgattccgaaactagattctccgatggccaccgcaccaacaccgcgtgaagagttcgtctacatggcgaaactcgccgaacaagccgaacgttacgaagagatggtggagttcatggaaaaagtaaccgccgccgtcgaaagcgaggaactcaccgtcgaggaaaggaacctcctctccgtcgcttacaaaaacgtgatcggagcacgacgcgcttcgtggaggatcatctcctccatcgaacagaaggaagaaagcagaggcaacgacgaacacgtgacggtcatccgtgattacagatctaagatcgagactgaactttccaacatctgtaacggtattctcaaacttcttgactcacgcctcatcccttctgctgcgctaggtgactccaaggttttctaccttaagatgaaaggtgattatcataggtatcttgctgagtttaagagcggcgctgagcgtaaagatgccgctgaaagcactctcactgcttataaatctgctcaggacattgcaaacactgagctgcctccaactcaccctatcaggcttggtcttgctctgaacttctccgtgttttactatgagattcttaactctcctgacagggcttgtggccttgcaaaacaggcttttgatgaggctattgctgagttggatacattgggagaggagtcatacaaggatagcaccttgattatgcaacttctccgcgataaccttaccctttggacctctgatatgcaggatgatggtgctgatgaaatcaaagaagctgcacctaaaggcaatgatgaaccacagtaaaa

SEQ ID NO: 649 - protein, 261 aa, Pisum sativum
MATAPTPREEFVYMAKLAEQAERYEEMVEFMEKVTAAVESEELTVEERNLLSVAYKNVIGARRASWRIISSIEQKEESRGNDEHVTVIRDYRSKIETELSNICNGILKLLDSRLIPSAALGDSKVFYLKMKGDYHRYLAEFKSGAERKDAAESTLTAYKSAQDIANTELPPTHPIRLGLALNFSVFYYEILNSPDRACGLAKQAFDEAIAELDTLGEESYKDSTLIMQLLRDNLTLWTSDMQDDGADEIKEAAPKGNDEPQ

SEQ ID NO: 650 - DNA, 1043 bp, Solanum lycopersicum
  CDS (11)..(769)
tacttcatccatggcggctctaatccctgaaaatctcagccgtgaacagtgtctttacttagcaaaactcgctgaacaagccgagcgctatgaagaaatggttcagttcatggacaaactagttctcaactccacgccggccggcgaactcaccgttgaggaaaggaatctcctctctgtcgcttacaaaaacgtgatcggatctcttcgtgctgcctggcgtattgtttcctctattgaacagaaggaggaatcgcggaagaacgaagaacatgtgcatcttgttaaggagtacagaggtaaagtcgagaatgaactttcgcaggtttgtgctggtatactcaagttgcttgagtcaaatcttgttccctctgctactaccagtgaatcgaaggtgttttaccttaagatgaaaggtgattattaccggtatcttgctgagtttaagattggtgatgagaggaagcaggctgctgaagacactatgaattcttataaggctgctcaggaaattgcactgacagatctgcctccaacacatcccataaggcttggtcttgcactcaacttctctgtcttttactttgagatactgaactcatctgacaaagcttgcagtatggcaaaacaggcatttgaggaagcgatagctgagctggacactttaggtgaagaatcatacaaggatagcaccctcataatgcaactcctacgagacaatctcacactttggacctcagatgctcaggatcagttggatgaatcttgattggcatggtctctatttaggaatgggctataaatgttgtttgctttgttgtgctgacttattgtataagaaaaaagacagcttcgggttgacctatgttatgtttgataatttgacttgtggtggtttggtacttggaaatctagttgttagattatttatctcttattgcaatggaaccctagtactgtgtattagaaaaaacttaaattaatgcttgtgtctttgagaatgatgtttcaaaaggtatcatgaaaaaaaaaaaaaaaaaaaa

SEQ ID NO: 651 - protein, 252 aa, Solanum lycopersicum
MAALIPENLSREQCLYLAKLAEQAERYEEMVQFMDKLVLNSTPAGELTVEERNLLSVAYKNVIGSLRAAWRIVSSIEQKEESRKNEEHVHLVKEYRGKVENELSQVCAGILKLLESNLVPSATTSESKVFYLKMKGDYYRYLAEFKIGDERKQAAEDTMNSYKAAQEIALTDLPPTHPIRLGLALNFSVFYFEILNSSDKACSMAKQAFEEAIAELDTLGEESYKDSTLIMQLLRDNLTLWTSDAQDQLDES

SEQ ID NO: 652 - DNA, 726 bp, Arabidopsis thaliana
  CDS (1)..(726)
atggagaacgagagagcgaagcaagtgtacttggcgaaactcaacgagcaagctgagagatacgatgagatggttgaagcaatgaagaaagttgcagctcttgatgtagagctcaccattgaagagaggaatcttttatctgttggttacaaaaatgtgattggtgctaggagagcatcgtggaggatcctttcttcgatcgagcagaaagaagaatcgaaaggaaacgaacaaaatgccaagaggattaaggattacaggacaaaagttgaagaagaactctccaagatttgttacgatattttggctgtcatcgataagcatcttgtcccattcgcaacttcgggagaatccaccgtcttctactacaaaatgaaaggagattatttcagatacttggctgaatttaagtccggtgctgatcgcgaggaagctgcggacctatcactcaaggcgtatgaagctgcaacgagttctgctagcacggaattgtctacaacacatccaataagactcggcttggctctcaacttttctgtcttctactacgagatcttgaattctccggaaagagcatgtcatttggcaaagcgagcgtttgatgaagcaatcgctgagcttgacagtcttaacgaagattcatacaaggacagcacacttatcatgcaacttctcagagataacctcactttatggacctctgatctagaggaaggaggtaagtaa

SEQ ID NO: 653 - protein, 241 aa, Arabidopsis thaliana
MENERAKQVYLAKLNEQAERYDEMVEAMKKVAALDVELTIEERNLLSVGYKNVIGARRASWRILSSIEQKEESKGNEQNAKRIKDYRTKVEEELSKICYDILAVIDKHLVPFATSGESTVFYYKMKGDYFRYLAEFKSGADREEAADLSLKAYEAATSSASTELSTTHPIRLGLALNFSVFYYEILNSPERACHLAKRAFDEAIAELDSLNEDSYKDSTLIMQLLRDNLTLWTSDLEEGGK

SEQ ID NO: 654 - DNA, 807 bp, Arabidopsis thaliana; identical to SEQ ID NO: 588
  CDS (1)..(807)

SEQ ID NO: 655 - protein, 268 aa, Arabidopsis thaliana
MSSSGSDKERETFVYMAKLSEQAERYDEMVETMKKVARVNSELTVEERNLLSVGYKNVIGARRASWRIMSSIEQKEESKGNESNVKQIKGYRQKVEDELANICQDILTIIDQHLIPHATSGEATVFYYKMKGDYYRYLAEFKTEQERKEAAEQSLKGYEAATQAASTELPSTHPIRLGLALNFSVFYYEIMNSPERACHLAKQAFDEAIAELDTLSEESYKDSTLIMQLLRDNLTLWTSDLPEDGGEDNIKTEESKQEQAKPADATEN

SEQ ID NO: 656 - DNA, 804 bp, Arabidopsis thaliana
  CDS (1)..(804)
atggcgacaccaggagcttcctcagcaagagatgaattcgtatacatggcgaaactcgccgaacaagcagagcgttacgaagaaatggttgaattcatggagaaagtcgcgaaagctgttgacaaagacgaactcaccgtcgaagaacgtaatctcctctccgtcgcttacaaaaacgtcatcggagctcgtcgtgcttcgtggagaatcatttcatcgatcgaacaaaaggaggagtctcgcggtaacgatgaccacgtttcgttgatccgtgactacagaagcaaaatcgaaacggaactttctgatatctgtgacggaatccttaagcttctcgatacgattctcgttcccgctgctgcttctggagattcgaaggtgttttatctgaagatgaaaggtgattatcataggtacttggctgagttcaaatctggtcaagagaggaaagatgctgctgaacatactcttactgcttacaaagctgctcaggatattgctaattctgaattggctccaacgcatccgattcgtcttggtcttgcgttgaacttctctgtgttttactatgagattctcaattctccagatcgtgcttgtaatctcgctaagcaggcgtttgatgaagcaattgctgaattggatactcttggtgaagagtcatacaaggacagtactttgattatgcagcttcttcgtgataacctcactctctggacttctgatatgcaggacgatgttgctgatgacatcaaagaagcagcaccagcagcagcaaaacccgctgacgagcaacaatcctaa

SEQ ID NO: 657 - protein, 267 aa, Arabidopsis thaliana
MATPGASSARDEFVYMAKLAEQAERYEEMVEFMEKVAKAVDKDELTVEERNLLSVAYKNVIGARRASWRIISSIEQKEESRGNDDHVSLIRDYRSKIETELSDICDGILKLLDTILVPAAASGDSKVFYLKMKGDYHRYLAEFKSGQERKDAAEHTLTAYKAAQDIANSELAPTHPIRLGLALNFSVFYYEILNSPDRACNLAKQAFDEAIAELDTLGEESYKDSTLIMQLLRDNLTLWTSDMQDDVADDIKEAAPAAAKPADEQQS

SEQ ID NO: 658 - DNA, 1189 bp, Zea mays
  CDS (93)..(878)
tgggtaccgggccccccccgtagctcgcaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaaaaaacctcgtgc

SEQ ID NO: 659 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 660 - DNA, 1127 bp, Solanum lycopersicum
  CDS (57)..(806)
  misc_feature (1091)..(1091): n is a, g, c or t
aggaaaaaagggaaaaaaaaaagaaattctccggcggaaattaccggcgattgacgatggccttgcctgaaaatttaaccagagagcagtgtttgtacttggcgaagctagctgagcaagctgaacgatatgaggagatggtgaagttcatggacaagctcgtaatcgggtcgggttcatcggagttgacggtggaagagagaaatcttctttcggtggcgtataagaacgttatcggttcacttcgagcagcgtggaggattgtatcgtcaattgagcagaaggaggagggtaggaagaacgatgagcatgtggttctagtgaaggattacagatctaaagttgaatctgagcttagtgatgtttgtgctggaattctgaagattttggatcagtatttgattccttcagcttctgctggtgaatccaaggtgttttatttgaagatgaaaggggattattatcgttatttagctgaattcaaagttggaaatgaacgcaaggaagctgctgaggatactatgcttgcctacaaagctgctcaggacatcgctgttgcggagcttgccccaacacatccgatacgacttgggttggctctcaacttctcggtgttctactatgagattctgaatgcatcagaaaaagcatgcagcatggctaagcaggcatttgaggaagctattgctgaactggacactatgggtgaggaatcctataaggatagcacacttatcatgcagttgttaagggacaatctcacgctctggacttccgatatgcaggagcagatggacgaggcttgacatgatagcgctcctccaggagggtgagttcaaatgtcacaacaacagtctgtaaaatctacctatgcaattgatagcttttgtaatttttatatgccctgcttactttgatgattttcttgttcaaacttccgtttgatacttcttatgattttaattttatttgtttagctcccttttcgttcactctcttatgtcttggagtatctccaagtctgaaacccttctaattatgcgtctttagtttgactgaatatgaagtttaagaaagtaaaaaagaatgancgaatctttttaagttaaaaaaaaaaaaaaaaaaaa

SEQ ID NO: 661 - protein, 249 aa, Solanum lycopersicum
MALPENLTREQCLYLAKLAEQAERYEEMVKFMDKLVIGSGSSELTVEERNLLSVAYKNVIGSLRAAWRIVSSIEQKEEGRKNDEHVVLVKDYRSKVESELSDVCAGILKILDQYLIPSASAGESKVFYLKMKGDYYRYLAEFKVGNERKEAAEDTMLAYKAAQDIAVAELAPTHPIRLGLALNFSVFYYEILNASEKACSMAKQAFEEAIAELDTMGEESYKDSTLIMQLLRDNLTLWTSDMQEQMDEA

SEQ ID NO: 662 - DNA, 1020 bp, Solanum tuberosum
  CDS (51)..(830)
gcggcgctgtcagagacatcaatcaccaggtaactttacagacaacaaacatggccgattcacgtgaagaaaatgtgtacatggccaagttggctgagcaggctgagaggtatgaggaaatggttgagtttatggagaaggttgcaaaggtagatgttgaagagctgactgtggaggaaaggaatcttctttctgtggcttacaagaatgtcattggtgcaagaagggcttcgtggaggataatatcttcaattgagcagaaagaggagagccgtggaaatgaagaccatgttagcagcattaaagaatatagagtcaaaattgaggccgagctcagcaagatctgtgatgggattttgagccttctcgagtctcatttagtaccatcagcctcaacagccgagtccaaagtgttttacttgaagatgaaaggtgattaccataggtacttggctgagttcaagacgggggccagagagaggaaagaggctgcagagaacactttattagcctacaagtctgctcaggatatagcattggctgaactgactcctactcatccaatcagactgggacttgcccttaacttttcagtgttctattatgaaattcttaactcacctgatcgtgcttgtaaccttgcaaagcaggcctttgatgatgccatcgcagagctggatacattgggtgaggaatcttacaaggacagtacattgattatgcagcttctccgagacaatctcacactttggacctctgataccacagatgatgccgaggatgagatcagggaaggttcaaaacaagagtcgggtgatggacagcagtgatatctaagtagcctagtcttgtactccttattttgtgattttcgacgactcttcgtatcactgctgaagttgtttgatataaaaacaggttttagtctgataaaagaaacatgtttagtacaatttgtttgtgatgctattgcatcgccatttaataattagagttggaataaaaaaaaaaaaaaaaaaa

SEQ ID NO: 663 - protein, 259 aa, Solanum tuberosum
MADSREENVYMAKLAEQAERYEEMVEFMEKVAKVDVEELTVEERNLLSVAYKNVIGARRASWRIISSIEQKEESRGNEDHVSSIKEYRVKIEAELSKICDGILSLLESHLVPSASTAESKVFYLKMKGDYHRYLAEFKTGARERKEAAENTLLAYKSAQDIALAELTPTHPIRLGLALNFSVFYYEILNSPDRACNLAKQAFDDAIAELDTLGEESYKDSTLIMQLLRDNLTLWTSDTTDDAEDEIREGSKQESGDGQQ

SEQ ID NO: 664 - DNA, 780 bp, Arabidopsis thaliana
  CDS (1)..(780)
atggcgtctgggcgtgaagagttcgtatacatggctaagctcgcggagcaagcggagaggtacgaagagatggtagagtttatggagaaagtctccgccgccgttgatggcgatgaactcaccgtagaagagcgaaatcttctctccgtcgcttataagaatgtgattggtgctcgccgtgcctcgtggcgtatcatttcatcgatcgagcagaaggaagagagccgtggtaacgatgaccacgtcacggcgatccgtgaatataggtctaagatcgagacggaactctccggaatctgcgacggaatccttaagttgcttgactctagactcatccctgccgctgcttctggtgattccaaggtcttttaccttaagatgaagggagattatcacaggtacttggctgagtttaagactggtcaagagaggaaagacgccgccgaacatacactcgccgcttacaaatctgctcaggatattgctaatgcagagcttgctccaacacacccaattcgtcttggtcttgcattgaacttctctgtgttctattacgagatcctcaattctcctgatcgtgcctgtaacctcgccaaacaggcctttgatgaggcgattgcagagttggacactcttggtgaagagtcatacaaagacagtaccttgatcatgcagcttcttcgtgacaatctcactctctggacatctgatatgcaggatgatgctgcggatgagatcaaggaagcagcagcgccaaaaccgaccgaggaacagcagtga

SEQ ID NO: 665 - protein, 259 aa, Arabidopsis thaliana
MASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 666 - DNA, 1120 bp, Solanum lycopersicum
  CDS (80)..(844)
gccgctctcagatctcaaaaaaaaaaaaaaattgcattttcataaaaaagaaaagagatcccaaaatattgaatccattatggcgcgtgaggagaatgtgtacatggcgaagcttgctgagcaagctgaaagatacgaagaaatggtgcagttcatggagaaagtttcaacttcattaggctcagaggaacttactgttgaggaacggaatcttctttccgttgcttacaaaaacgttatcggggctcgtagagcctcgtggcgtattatctcttcaattgaacagaaggaggagtcgaggggaaatgaggaacatgttaaatgtataaaggagtatagatctaagattgaatctgaactttcggatatttgtgatggaattctcaagctccttgattctaatctcattccttcagcttctaatggcgattctaaggtgttttaccttaaaatgaagggtgattatcatcgttatttggctgaatttaagaccggagctgaacgtaaggaagctgctgagagcacactctccgcctacaaagctgctcaggatattgcaaatactgaacttgccccaacacatccaatccgacttggactggctctcaacttctcagtgttttattatgagattttgaactctcctgaccgtgcttgcaatcttgctaaacaagcatttgatgaagcaattgccgagttggacacactgggagaagaatcttacaaggatagcactttgatcatgcaacttcttcgtgacaatctcactctctggacctctgatatgcaggatgatggtgccgatgaaattaaggaaaccaaaaacgacaatgaacaacagtgagggaactggtcctcagattatcatttggcttctttcttcctggctgtttttattgggagaagctgcttcttttttatttcctttctcctgtctttcgggtttcctctttatccgtggcaacgaacaactttgaatattgatgttcaattgtttcatctgtaccttaatgtggttcttgctggtgcttagtttctatggaagcatttcagttgtatttgtgaactggatatataaaatggtacatccaagtgatactcagcaaccgggtttcaatca

SEQ ID NO: 667 - protein, 254 aa, Solanum lycopersicum
MAREENVYMAKLAEQAERYEEMVQFMEKVSTSLGSEELTVEERNLLSVAYKNVIGARRASWRIISSIEQKEESRGNEEHVKCIKEYRSKIESELSDICDGILKLLDSNLIPSASNGDSKVFYLKMKGDYHRYLAEFKTGAERKEAAESTLSAYKAAQDIANTELAPTHPIRLGLALNFSVFYYEILNSPDRACNLAKQAFDEAIAELDTLGEESYKDSTLIMQLLRDNLTLWTSDMQDDGADEIKETKNDNEQQ

SEQ ID NO: 668 - DNA, 1106 bp, Solanum tuberosum
  CDS (61)..(825)
attttctcaactttctctctctaaaacccctctttctctctctagaacacagaaccatcaatggcgtctccacgtgaagagaacgtgtacatggcgaacgttgctgcaagagctgaacgctatgaggagatggtagaattcatggagaaggtcgtcgccgccttggacacggaactaaccgtcgaggaacgcaatcttctctccgtcgcatacaaaaacgtgatcggagctaggagagcatcctggcgtataatttcatcgatcgagcagaaagaggagagtcgtggtaacgaagatcacgttgcctccattaaaaaatacagatctcagatcgagaatgagctgacttcgatctgtaacggcatcctcaagttgcttgattcaaaactcatcgggtcagctgctaccggagactccaaagttttctatttgaaaatgaagggagattattaccggtacttggctgagttcaaaaccggaaccgagagaaaagaagctgcagagaatactctttcggcctacaagtctgctcaggatattgctaatggcgaattggctccaacacatccaatccgattgggtctagctctcaatttctcagtgttttactatgagatattgaattctcctgaccgtgcttgtaatctcgccaaacaggcttttgatgaggcaattgcggacgttgacaccctaggagaggagtcctacaaggatagcactttaattatgcaacttctgcgtgataacctcactttgtggacctctgatatgcaggatgatggagctgatgagatcaaagaaccatcaaaagctgataatgagtagtaacaacgtgagtgaaacctctttgcttaggattgaaaaccgatgatgtaattttactcattgatcaaaattggctgtttgtagtccttatcctgtgatttgtaatacctattactaaaggcgctgtttcttgccatttgttgttttcatcaagattactttttgtctctgtatttcttttgtatttggatgctctgatgaaactctcttatttcgtggaaatgaatatttatttttacgaagcaaaaaaaaaaaaaaaaaactcgagactacttctctca

SEQ ID NO: 669 - protein, 254 aa, Solanum tuberosum
MASPREENVYMANVAARAERYEEMVEFMEKVVAALDTELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIADVDTLGEESYKDSTLIMQLLRDNLTLWTSDMQDDGADEIKEPSKADNE

SEQ ID NO: 670 - DNA, 768 bp, Arabidopsis thaliana
  CDS (1)..(768)
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggaaagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 671 - protein, 255 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGKIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 672 - DNA, 1054 bp, Solanum lycopersicum
  CDS (94)..(876)
acgagttcaattcagaaaatcgaaaaactctctcatttcattcagatctcaaaataattatttccgagcacacagaaggaaaaaaatctaaacatggcggtggtggcaccgacggcgcgtgaggagaacgtgtacatggcaaagctggcggacagggccgagagtgatgaagagatggtggaattcatggagaaggtctccaactcccttggctcggaagaactaaccgtggaggagagaaaccttctctccgtcgcgtataagaatgtgatcggagcgcgtagggcatcatggcgtatcatttcatcgatcgagcaaaaggaagagtctagaggaaatgaggaacatgttaactctatccgcgagtacagatctaagattgagaatgagctctctaagatctgtgatggcattctcaaattgcttgattctaagcttattccttcagcaacatctggtgattccaaggttttttacctgaaaatgaaaggagattaccaccgctatttggctgagttcaagaccggtgctgaacgtaaggaggccgctgagagtactctcacagcctacaaagctgctcaggatatcgcatctgctgaacttgccccaacacatcccatccgacttggactggctctcaacttctctgtgttttattatgagatcttgaactctcctgaccgcgcttgcaatcttgccaaacaggcctttgatgaagcaattgctgagttggatacattgggagaggagtcttacaaggatagcactttgatcatgcaacttcttcgtgacaatctcactctctggacctccgatatgcaggatgatggtgctgatgaaatcaaggaagatcccaaacctgaagaaaaaaattgaggggaattgaaaccctctaatttgcttttcacttctcccctagttgtttttattgggagaagctgattatcataatttccttgctagtattatgattttccattaagaggttctcttcttattggcaacaaacgacttttatattgatgttttaaaagttccatcttaaaaaaaaaaa

SEQ ID NO: 673 - protein, 260 aa, Solanum lycopersicum
MAVVAPTAREENVYMAKLADRAESDEEMVEFMEKVSNSLGSEELTVEERNLLSVAYKNVIGARRASWRIISSIEQKEESRGNEEHVNSIREYRSKIENELSKICDGILKLLDSKLIPSATSGDSKVFYLKMKGDYHRYLAEFKTGAERKEAAESTLTAYKAAQDIASAELAPTHPIRLGLALNFSVFYYEILNSPDRACNLAKQAFDEAIAELDTLGEESYKDSTLIMQLLRDNLTLWTSDMQDDGADEIKEDPKPEEKN

SEQ ID NO: 674 - DNA, 1126 bp, Arabidopsis thaliana
  CDS (52)..(855)
aaatctctctcaatctctctcagatctgaatccatccatcaccgatctctaatggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggacaagagaggaaagatgctgctgaacatactctcaccgcttacaaagctgctcaggatattgctaatgctgaattggctccaacgcatccgattcgtcttggtttggctttgaatttctctgtgttttactatgagattcttaattctccagatcgtgcttgtaatctcgctaagcaggcgtttgatgaagccattgctgagttagatactcttggagaggagtcatacaaggatagtaccttgatcatgcagcttcttcgtgacaatcttactctctggacttctgacatgcaggacgaaagtccggaggagattaaagaagcagcagcaccaaagcctgctgaagaacagaaggagatctaagtttgtggtttcttttttcagtattcttaagttatgcaattataattatgtttctgcttggtgtttattttctaatctttcctttgctatccccgaagcttctaaggccgtctaattcttgtcctttgtttgcttttctcaatcgtggatgctactggatttctgttttgttttacttcttctcttgattgattgcatttcccggcttatgccttgtacttgaaactcagttttctctcttattaatgatttgccattcaccaaaaaaaaa

SEQ ID NO: 675 - protein, 267 aa, Arabidopsis thaliana
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEEQKEI

SEQ ID NO: 676 - DNA, 1094 bp, Solanum lycopersicum
  CDS (50)..(832)
ctttcttcttccgtcaagagaaccaggtgtaatttcacatacaacaaaaatggctgactcttcacgtgaagaaaatgtgtatttggctaagctggctgagcaggctgagcgatacgaggaaatgattgagtttatggagaaggttgcaaagacagcagatgttgaggagctgactgttgaggaaaggaatcttctttcagtggcctacaaaaatgtaattggcgcaagaagagcctcatggaggataatctcttcaattgagcaaaaggaggaaagccgtggaaatgaagaccatgtcaatactattaaagaatacagaagcaaaattgaggctgaccttagcaagatttgtgatgggattttgagcctccttgagtccaatttaataccatcggcctcaacagctgagtccaaagtttttcacttgaagatgaaaggtgactaccataggtacctggctgagtttaaaacagggacagagaggaaagaagcagctgagaacactttgttggcttacaagtctgctcaggatattgctttggctgaactggctcctactcacccaatcaggctgggacttgcccttaacttttccgttttctattatgaaattctcaactcacctgatcgtgcttgtaaccttgcgaaacaggcatttgatgaagccatctcagagttggatacactgggtgaggaatcttacaaggacagtacattgatcatgcaacttctccgagacaatctcactctttggacttctgacaatgcggatgatgttggggatgacatcaaggaagcttcaaaacctgagtcaggcgaggggcagcagtgatgagagagtggcatagtcctgtagtcttttcttataggggatgttggtggagaggatatagcaagatcgtgaatttagatctccgatggttgtgtcactgttgaaacggttcaatataaaacatgtcttagtgttggtaagaatgtctggttgagtcgattgcgtagtgctatgatcattagagttgaattggttgcattacttgcttgtgttgataacttttctcgtaattttttgtctcatttgcatgtttgtgtgattg

SEQ ID NO: 677 - protein, 260 aa, Solanum lycopersicum
MADSSREENVYLAKLAEQAERYEEMIEFMEKVAKTADVEELTVEERNLLSVAYKNVIGARRASWRIISSIEQKEESRGNEDHVNTIKEYRSKIEADLSKICDGILSLLESNLIPSASTAESKVFHLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDNADDVGDDIKEASKPESGEGQQ

SEQ ID NO: 678 - DNA, 838 bp, Arabidopsis thaliana
  CDS (1)..(807)
atgtcttctgattcgtcccgggaagagaatgtgtacttggccaagttagccgagcaagctgagcgttacgaggaaatggttgagttcatggagaaagttgcaaagaccgtggagaccgaggaacttactgttgaagagaggaatctcttgtctgttgcttacaagaacgtgattggtgctaggagagcttcttggaggattatctcttccattgagcagaaggaagatagcaggggcaacagtgatcatgtttcgattatcaaggattacagaggcaagattgaaactgagctcagcaagatttgtgatggcattttgaaccttcttgaggctcatctcattcctgctgcttctttggctgagtccaaagttttttacctgaagatgaagggagattatcatcggtaccttgctgaattcaagactggtgctgagaggaaagaagctgctgagagcactcttgttgcctacaagtctgctcaggatattgctcttgctgatctggctcccactcacccaatcagactggggcttgctcttaacttctctgttttctactatgagattctcaactcatctgatcgtgcgtgtagtctcgcaaagcaggcttttgatgaggcaatctcggagctagacacattgggagaggaatcatacaaggacagtacattgatcatgcagcttctccgtgacaatctcaccctctggacttctgacctcaatgacgaagctggtgatgatatcaaggaagccccgaaagaggtgcagaaagttgatgaacaagcccaaccaccaccttcgcagtgataaaatcagatccatggaatgatttgcagac

SEQ ID NO: 679 - protein, 268 aa, Arabidopsis thaliana
MSSDSSREENVYLAKLAEQAERYEEMVEFMEKVAKTVETEELTVEERNLLSVAYKNVIGARRASWRIISSIEQKEDSRGNSDHVSIIKDYRGKIETELSKICDGILNLLEAHLIPAASLAESKVFYLKMKGDYHRYLAEFKTGAERKEAAESTLVAYKSAQDIALADLAPTHPIRLGLALNFSVFYYEILNSSDRACSLAKQAFDEAISELDTLGEESYKDSTLIMQLLRDNLTLWTSDLNDEAGDDIKEAPKEVQKVDEQAQPPPSQ

SEQ ID NO: 680 - DNA, 1000 bp, Solanum lycopersicum
  CDS (59)..(826)
agtctaaacttactctctctaaaacccctctttctctctctagaatacagaaccatcaatggcgtctccacgtgaagagaacgtgtacatggcgaacgttgctgacgaagctgaacgctatgaggagatggtagaattcatggagaaggtcgtcgcggccttgaacggtgaggaacttaccgtcgaggaacgcaaccttctctccgtcgcatacaaaaacgtgatcggagctaggagagcatcgtggcgtataatttcatcgatcgagcagaaagaggagagtcgtggtaacgaagatcacgttgcctccattaagaaatacagatctcagatcgagaatgagctgacttcgatctgtaacggcatcctcaagttgcttgattccaaactcatcggttcagctgctaccggagactccaaggttttctatttgaaaatgaagggagattactaccggtacttggctgagttcaaaaccggaaccgagagaaaagaagctgcagagaatactctttcggcctacaagtctgctcaggatatcgctaatggcgaattggccccaacacatccaatccgattgggtctagctctcaatttctcagtgttttactatgagatattgaattctcctgatcgtgcttgtaatctcgccaaacaggcctttgatgaggcaattgcggagcttgacaccctgggagaggagtcctacaaggatagcactttgattatgcaacttctgcgtgataacctcactttgtggacctcggatatgcaggatgatggaactgatgagatcaaagaaccatcaaaagctgataatgagtagtaacatcgtgagtgaaacttctttgcttagaattgacaaccgatgatgtaattttactcattgatcaaaattggctgtttgtagtccttatcctgtgatttgtaatacctattacctaaaggcgctgtttcttgccatttgttgttttcatcaaagattaccttttgtctaaaa

SEQ ID NO: 681 - protein, 255 aa, Solanum lycopersicum
MASPREENVYMANVADEAERYEEMVEFMEKVVAALNGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 682 - DNA, 1219 bp, Solanum tuberosum
  CDS (90)..(866)
gaattgttgagaaaggaagagattctaaaaaccgctctcactttctctctctagaaaaacaaaaaactctctttctctctctaatatcaatggcgtcgccacgcgaggaaaacgtgtacatggcgaagctcgccgagcaagctgagcgttacgaggagatggtagagttcatggagaaagttgtcgctgccgccgatggtgccgaggagttaaccgtcgaagaacgaaacctcctctccgtcgcgtataagaatgtgatcggagcacggagagcttcatggaggatcatttcctccattgagcagaaagaggagagccgtggtaacgaagatcatgttgcttccattaaggaatacagatctaagatcgagtctgaacttacctcgatctgtaatggaattcttaagctgcttgattctaagctcattggctctgctgctaccggtgactcgaaggtgttttacttgaaaatgaagggagattatcatcgttatttggctgagtttaagactggtgctgagcgaaaagaagctgctgagaatactctctcggcttacaaagctgctcaggatattgctaatgccgaacttgctcctacacatccaatccgattgggacttgctctcaatttctctgtgttttactacgagattttgaattctcctgatcgtgcctgtaatctcgccaaacaggcctttgatgaggcaattgcggagttggacacattgggcgaagagtcctacaaggatagcactctgatcatgcagcttcttcgtgataacctcactttatggacctctgatatgcaggatgatggaactgatgagatcaaagaagctgcacctaaaccagataataatgaatgagcagcagtaaaaactggtgaaatttctttaggattgaaatatgctatgttgtaacttctttttcatttgtctggattcagctctttgttagttctagatcttgtgatttgtaatacctaaaatcaaccgtttcttgttcaattgttgttcttgtttgtttctatgttgatttctcttgtattcggattatttcctttttctcaagggaatgacttattgggaagttggatctaccttttaatccacaaatttgttagcttctcctttttcatattacatggatataaattcaaaaactttgtgccaaaaaaaaaaaaaaaaaaaaaaaaaaaaaaaaaaaaaaaaaactcgag

SEQ ID NO: 683 - protein, 258 aa, Solanum tuberosum
MASPREENVYMAKLAEQAERYEEMVEFMEKVVAAADGAEELTVEERNLLSVAYKNVIGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTLWTSDMQDDGTDEIKEAAPKPDNNE

SEQ ID NO: 684 - DNA, 747 bp, Arabidopsis thaliana
  CDS (1)..(747)
atggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagcgagtgagtctaaggtcttttacttgaagatgaaaggtgattatcatcggtacatggctgagtttaagtctggtgatgagaggaaaactgctgctgaagataccatgctcgcttacaaagcagctcaggatatcgcagctgcggatatggcacctactcatccgataaggcttggtctggccctgaatttctcagtgttctactatgagattctcaattcttcagacaaagcttgtaacatggccaaacaggcttttgaggaggccatagctgagcttgacactctgggagaggaatcctacaaagacagcactctcataatgcagttgctgagggacaatttaaccctttggacctccgatatgcaggagcagatggacgaggcctga

SEQ ID NO: 685 - protein, 248 aa, Arabidopsis thaliana
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 686 - DNA, 1026 bp, Solanum lycopersicum
  CDS (62)..(838)
ctctcacttcctctctctagaaaaacaaaaacctctctccctctttctctctctaacatcaatggcgtcgccacgcgaggaaaacgtgtacatggcgaagcttgccgagcaagctgagcgttacgaggagatggtagagttcatggaaaaagttgtcgctgccgccgatggtgcagaggagttaaccgttgaagaacgaaatctcctctccgttgcgtataagaatgtgatcggagcacggagagcttcatggaggatcatttcctccattgagcagaaagaggagagccgtggtaacgaagatcatgttgcttctattaaggaatacagatctaagatcgagtctgaacttacctcgatctgtaatggaattcttaagctgcttgattctaagctcattggctctgctgctaccggtgactctaaggtgttttacttgaaaatgaagggagattatcatcgttacttggctgagtttaagaccggtgctgagcgaaaagaagctgctgagaatactctctccgcttacaaagctgctcaggatattgcaaatgctgagcttgctcctacacatccaatccgattgggacttgctctcaatttctctgtgttttactacgagattttgaattctcctgatcgtgcctgtaatctcgccaaacaggcctttgatgaggcaattgccgagttggacacattgggcgaagagtcctacaaggatagcactctgatcatgcagcttcttcgtgataacctcactttatggacctctgatatgcaggatgatggaactgatgagatcaaagaagctacacctaaaccagatgataatgaatgagcagcagtaaaaactggtgaaatttctttaggattgaaatatgctatgttgtaacttctttttcatttgtctggattcaactctttttcatttgtctggattcaactctttgttagttctagatcttgtgatttgtaatacctaaaatcaaccgtttcttgttaattgttaaaaaaaaaaaaaaaaaa

SEQ ID NO: 687 - protein, 258 aa, Solanum lycopersicum
MASPREENVYMAKLAEQAERYEEMVEFMEKVVAAADGAEELTVEERNLLSVAYKNVIGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTLWTSDMQDDGTDEIKEATPKPDDNE

SEQ ID NO: 688 - DNA, 798 bp, Arabidopsis thaliana
  CDS (1)..(798)
atgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggatattgcacttgctgatttagctcctactcatccgattagactgggacttgctcttaacttctctgtcttctactacgagattctcaactcacctgatcgtgcctgcagtctcgcaaaacaggcttttgatgaggccatttctgagctggatacattaggagaagaatcatacaaagacagtacgttgataatgcaacttctccgtgacaatctgaccctttggaactctgacatcaatgatgaggcgggcggtgatgagatcaaggaggcgtcaaaacatgagccggaagaggggaaaccagctgagacagggcagtga

SEQ ID NO: 689 - protein, 265 aa, Arabidopsis thaliana
MSSSREENVYLAKLAEQAERYEEMVEFMEKVAKTVDTDELTVEERNLLSVAYKNVIGARRASWRIISSIEQKEESRGNDDHVSIIKDYRGKIETELSKICDGILNLLDSHLVPTASLAESKVFYLKMKGDYHRYLAEFKTGAERKEAAESTLVAYKSAQDIALADLAPTHPIRLGLALNFSVFYYEILNSPDRACSLAKQAFDEAISELDTLGEESYKDSTLIMQLLRDNLTLWNSDINDEAGGDEIKEASKHEPEEGKPAETGQ

SEQ ID NO: 690 - DNA, 972 bp, Solanum lycopersicum
  CDS (49)..(807)
gaacacagagaaaataggcagagagagagagagagagagagaagagaaatggagaaggaaagagaaaaacaggtttacttggctaggctggctgagcaagctgagagatatgatgaaatggttgaagcaatgaaggcgattgctaagatggatgtcgaactgactgttgaagagaggaatttggtgtcggttgggtataagaatgtaatcggagcaagaagggcttcatggcggatcttgtcttcgattgaacagaaggaggagagtaagggtcatgagcagaatgttaagagaataaagacttacagacagagagttgaagacgagcttacaaaaatatgcagcgacattttgtcagtgatcgatgagcacctcgttccttcgtccactactggagaatctactgtcttctactacaagatgaagggagattactatcgctatttagcagagttcaaagcaggggatgatcgtaaagaggcgtctgaacagtctcttaaagcttatgaggctgctactgccactgctagttcagatcttgctccgactcatccaatcagacttggactcgcattgaatttctcagttttctactatgagattctgaattcacccgagagggcatgccacttggctaagcaggcatttgatgaagctattgccgaacttgatagcctcagtgaagaatcctacaaggacagcacccttatcatgcagcttctaagggataatctcactttgtggacatcagatcttgaagagggaggtgagcattctaagggtgatgagcgccagggagagaactagttgaagttcaagaggtgtcggtgaatcattgtgatgctggctcctcaagagacatgttagcttgtggaaagtctttgttttcatataatgttcagggattcatgcctattggctttgtactttcttcctccatatacataaacattcccaaaaaaaaaaaaaaaa

SEQ ID NO: 691 - protein, 252 aa, Solanum lycopersicum
MEKEREKQVYLARLAEQAERYDEMVEAMKAIAKMDVELTVEERNLVSVGYKNVIGARRASWRILSSIEQKEESKGHEQNVKRIKTYRQRVEDELTKICSDILSVIDEHLVPSSTTGESTVFYYKMKGDYYRYLAEFKAGDDRKEASEQSLKAYEAATATASSDLAPTHPIRLGLALNFSVFYYEILNSPERACHLAKQAFDEAIAELDSLSEESYKDSTLIMQLLRDNLTLWTSDLEEGGEHSKGDERQGEN

SEQ ID NO: 692 - DNA, 778 bp, Arabidopsis thaliana
  CDS (1)..(747)
atggcgacgaccttaagcagagatcaatatgtctacatggcgaagctcgccgagcaagccgagcgttacgaagagatggttcaattcatggaacagctcgtaagtggagctacaccggccggtgagctgaccgtagaagagaggaatcttctctcggtcgcgtataagaacgtgattggatctcttcgtgcggcatggagaatcgtgtcttcgattgagcaaaaggaagagagcaggaagaacgaagaacacgtgtcgcttgttaaggattacagatctaaagttgagactgagctttcttcgatctgttctgggattctcaggttacttgattcgcatctaattccttcagctactgccagtgagtctaaggttttttacctgaagatgaaaggagattatcatcgttatttggctgagtttaaatctggtgatgagaggaaaactgctgctgaagatactatgatcgcttacaaagctgctcaggacgttgcagttgctgatctagcacctacacatccgatcaggcttggtttggctcttaacttctcagtgttttactacgagattctcaactcttcagagaaagcttgtagcatggcgaaacaggcttttgaagaagccattgctgagctggacacattgggagaggagtcatacaaggacagtactctcatcatgcagttgctaagggacaatctaaccctttggacctccgatatgcaggagcagatggatgaggcctgaaggtctaatggaagaaaagacggttatgtaa

SEQ ID NO: 693 - protein, 248 aa, Arabidopsis thaliana
MATTLSRDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 694 - DNA, 1112 bp, Solanum lycopersicum
  CDS (116)..(901)
tggatgggttccttgcttggaattcgagacggtacacaaatccgtgctcaaacaaaagaagaaagaagataaaaatctccatttttttttttcaactcaaagagaagatcggaaaatggcttcatccaaagaacgtgaaagcttggtatacatcgccaggcttgctgagcaagctgaacgctacgatgagatggttgatgcaatgaagaatgttgcgaatctggatgttgaactgacagtggaggagaggaatttgttatctgttggttataagaatgtggttggatctaggagagcgtcatggaggatcttgtcttccatcgagcagaaggaagatgctagaggaaatgagcagaatgtgaagcggatccaggggtaccgccaaaaagtagagtcagagctcaccgacatttgcaataatatcatgactgtgattgatgagcatctgattccgtcatgtactgctggtgaatcaactgtgttttactacaaaatgaaaggagattattatcgatatcttgcagagttcaaaacaggtgatgacaagaaagaagtttctgatctgtctttaaaagcatatcagacggctacaactactgcagaagctgaattaccaattacccatcccatccggttgggtttggctttaaatttctctgttttctactatgagataatgaactctcctgaaagggcttgccaattggctaagcaggtttttgatgaagcaatatctgagctggatagcctcaatgaggacaactacaaagatggtaccttaattctgcagcttcttagggacaatctcaccttgtggacgtctgacattccagaggatggagaagaggctccaaagggagatgctgcaaacaaagtgggtgcaggcgaggatgcggagtgatgatccaaacgagtagaatgtaccatgcgtatttgattaaagaggccggtgaaacatctggtggattgtttgtcaagtgctaatagataattgtaaggcacaccaacaaatgaatagatacttgtttattggatccgtcttgctgaagattgttttcacattaattgatgaatgcatatcatttgatttgcatccccattgttcttttctc

SEQ ID NO: 695 - protein, 261 aa, Solanum lycopersicum
MASSKERESLVYIARLAEQAERYDEMVDAMKNVANLDVELTVEERNLLSVGYKNVVGSRRASWRILSSIEQKEDARGNEQNVKRIQGYRQKVESELTDICNNIMTVIDEHLIPSCTAGESTVFYYKMKGDYYRYLAEFKTGDDKKEVSDLSLKAYQTATTTAEAELPITHPIRLGLALNFSVFYYEIMNSPERACQLAKQVFDEAISELDSLNEDNYKDGTLILQLLRDNLTLWTSDIPEDGEEAPKGDAANKVGAGEDAE

SEQ ID NO: 696 - DNA, 968 bp, Arabidopsis thaliana
  CDS (1)..(792)
atgggttctggaaaagagcgtgacactttcgtctacctcgctaagctctctgagcaagctgagcgttatgaagaaatggtggaatcaatgaaaagtgttgcgaaattgaatgttgatctgacggtggaagagaggaacttactctctgtgggttacaagaacgtgattggttcaaggagagcttcgtggaggatcttctcgtcgattgaacaaaaggaagcagtgaaagggaatgatgttaatgtaaagaggatcaaagagtatatggagaaggttgagttagagctttctaacatatgcattgatattatgtctgtcttagatgagcatctcattccttcggcttccgagggtgaatctactgtcttcttcaacaagatgaaaggtgactattaccgctatcttgctgagttcaaatcagggaacgagaggaaagaggctgctgatcagtctttgaaagcctatgagattgctactactgctgctgaggctaagctccctccaacacaccctatcagattgggtttggctttgaatttctctgtcttctactacgagatcatgaacgcacctgaaagggcatgtcaccttgctaagcaggcgttcgatgaagctatctcagagcttgacactctgaacgaggaatcctacaaagatagcaccttaataatgcaactccttagggacaatctgaccttgtggacttctgacatctcagaagaaggaggagacgatgctcataagacgaatggttctgccaaacctggtgctggtggagacgatgcagagtgatatgatatgtgtgcacctggacaatatgtttcaagaactgaatgtgcggtgaataatagtgaaaagtagagtttctctgttccctatatcatgattgtctatgttacttgtactctggtttagccctaaatgtctctctggtttgaatgtattgcatgcctgtctcaggacactct

SEQ ID NO: 697 - protein, 263 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGGDDAHKTNGSAKPGAGGDDAE

SEQ ID NO: 698 - DNA, 1072 bp, Solanum lycopersicum
  CDS (74)..(859)
gagagaatagagcaaaatctctctctgttttcactacaaaaaatctttgatttcaatttgagagagatcggaaatggcttcttccaaagaacgtgagaacttcgtctacgtcgctaagctcgctgagcaagccgaacgctacgatgaaatggttgaagcgatgaaaaatgtcgcaaacatggatgttgaattgactgtggaggaaaggaatcttctttctgttggttataagaatgtggtaggttctaggagagcatcttggaggatcttgtcctctattgagcagaaggaagaatctagaggaaacgagcaaaatgtcaagcgaatcaaggagtacctgcaaaaggtggagtcggagctcaccaacatttgcaatgatattatggtggtcattgatcagcatctaattccgtcatgctctgcaggcgaatcaactgtgttttaccacaagatgaagggagactattatcgttatcttgcagaatttaaagctggcaatgacaagaaggaggttgctgagctttcattgaaagcatatcaggcagctacaactgctgcggaggcggaattagcacccactcatcccattcgtctgggactggctttaaatttctctgttttctactatgagatcatgaattcacctgaaagggcatgccatcttgcaaaacaggccttcgatgaagcaatatctgagctggatagcctgaatgaggattcctacaaagacagcaccttgattatgcaacttctaagggacaacctcaccttgtggacttctgatcttccagaggatgctgaagatgcccaaaagggagatgccacaaacaaagctggtggaggtgaagatgcagagtgaatgggcctaatagttagaactactatgtgtatttggaggtgtgacgacaaggatacgccaagggggatgttagtttgttaagtcttagtagatacttctattatgggtctgtcgtgtcagattcttcacttgttaattggttgtctgcaactcagtgtgtaatttgtatccctgtgctatttccgttctccgtaaaaaaaaaaaaaaaaaaaa

SEQ ID NO: 699 - protein, 261 aa, Solanum lycopersicum
MASSKERENFVYVAKLAEQAERYDEMVEAMKNVANMDVELTVEERNLLSVGYKNVVGSRRASWRILSSIEQKEESRGNEQNVKRIKEYLQKVESELTNICNDIMVVIDQHLIPSCSAGESTVFYHKMKGDYYRYLAEFKAGNDKKEVAELSLKAYQAATTAAEAELAPTHPIRLGLALNFSVFYYEIMNSPERACHLAKQAFDEAISELDSLNEDSYKDSTLIMQLLRDNLTLWTSDLPEDAEDAQKGDATNKAGGGEDAE

SEQ ID NO: 700 - DNA, 1004 bp, Glycine max
  CDS (8)..(781)
ctgagaaatgtcggattcttctcgggaggagaatgtttacatggcgaaattggcggacgaggccgagcgttacgaggagatggttgagttcatggagaaggtagcaaagactgtggaggttgaggagttgacggtggaggagagaaatcttctctctgtggcttacaagaacgtgattggtgcgaggagggcttcgtggaggatcatatcctccattgagcagaaggaggagagcaggggcaatgaggaccatgtggccattataaaggagtacaggggcaaaattgaggctgaactcagcaagatctgtgacgggattttgaacctccttgagtccaacctcatcccatccgccgcatctcccgagagtaaagtgttttaccttaaaatgaagggtgattaccacaggtaccttgccgagttcaagactggggcagagaggaaagaggcagcagagagtactttgcttgcttacaaatctgctcaggatattgctcttgctgacttggcccccactcaccccattaggctgggacttgctctcaacttttctgtcttctattatgaaatccttaactcgccagatcgggcttgtaatcttgccaaacaggcatttgatgaggcaatttccgagcttgacacattgggtgaagagtcatacaaggatagtacgttgatcatgcaacttctccgtgacaatctgactttgtggacatcagacatcacggacatcgctggagatgagatcaaggaaacatctaagcaacaaccaggtgaataggcgatggcagtagttgatgggatatgtattaccgataatatacatccaatgtggcttgccatagtggaactgtgtattaatgagtttcgtgatttcaattgcgggttgcgcttgagatttacaatgtttcagtcgtgtatgtgttttattgacgagaacaatgtggcttggtggtttagtgatttataaattttttattgttgctaaaaaaaaaaaaaaaaaa

SEQ ID NO: 701 - protein, 257 aa, Glycine max
MSDSSREENVYMAKLADEAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDIAGDEIKETSKQQPGE

SEQ ID NO: 702 - DNA, 1095 bp, Nicotiana tabacum
  CDS (62)..(829)
cattctctcaactttctctttctaaaactcttcctttctctttctaggacacagaccatcaatggcatcgccacgcgaagagaacgtgtacctggcgaagcttgctgagcaagccgaacgctacgaggagatggtagaatttatggagaaagtcgtcggcgccggcgacgacgaactcaccatcgaggaacgcaacctcctctccgtcgcgtacaaaaacgtgatcggagcgaggagagcgtcgtggcgcataatctcatcgattgagcagaaagaggagagtcgcggtaacgaagatcacgtggcctccattaaaacctacagatctaagatcgaatctgaattgacttcgatctgtaacggtatccttaagttgctcgattcaaaactcattggcaccgctgctactggtgactctaaggttttctatttgaaaatgaagggagattattacaggtacttggctgagttcaaaaccggagctgagagaaaagaagccgccgagaatactctttcggcttacaagtcggctcaggatattgctaatggtgaattagcccctacacatccaatccgattggggctagctctcaatttctcagtgttttactatgagatattgaactctcctgatcgtgcttgtaatctcgccaaacaggcatttgatgaggctattgcggagcttggcaccctgggagaggagtcctacaaggatagcactttgattatgcaacttttttgtgataacctcactttgtggacctcagatatgcaggatgatggaactgatgagatcaaagaaccatcaaaagcagaggagcagcagtaatgtgagtgaagcctctttgcttaggattgaaatcctatggactttgctcattgatcgaaatttgctgtttgtgtagttttgaattccctgaattgtaatacctaaaagcactgttttttgccatttgttgttttcagcaaagattatttttttccgcagtatttcccttgtatttggatgctccggtgaaacttttttattttcgtggaaatgaatttttgtttttacggagccaaaaaaaaaaaaaaaaaaaaaaaaaaaaaaaa

SEQ ID NO: 703 - protein, 255 aa, Nicotiana tabacum
MASPREENVYLAKLAEQAERYEEMVEFMEKVVGAGDDELTIEERNLLSVAYKNVIGARRASWRIISSIEQKEESRGNEDHVASIKTYRSKIESELTSICNGILKLLDSKLIGTAATGDSKVFYLKMKGDYYRYLAEFKTGAERKEAAENTLSAYKSAQDIANGELAPTHPIRLGLALNFSVFYYEILNSPDRACNLAKQAFDEAIAELGTLGEESYKDSTLIMQLFCDNLTLWTSDMQDDGTDEIKEPSKAEEQQ

SEQ ID NO: 704 - DNA, 946 bp, Vicia faba
  CDS (13)..(798)
ccagattctccgatggccaccgcaccaacaccgcgtgaagagttcgtctacatggcgaaactcgccgaacaagccgagcgttacgaagagatggtggagttcatggaaaaagtaaccgccgccgtcgagagcgaggaactcaccgtcgaagaacggaacctcctctccgttgcttacaaaaacgtgatcggagcacgacgcgcttcgtggaggatcatctcctccatcgagcagaaggaagaaagcagaggcaacgacgaacacgtgtcggtcatccgtgattacagatctaagatcgagactgaactctccaacatctgtaacggtattctcaaactcctagattcgcgtctcatcccgtctgctgcgctcggtgattcgaaggttttctacctgaagatgaaaggtgattatcataggtatcttgctgagtttaagagcggcgctgaacgtaaagatgccgccgaaagcactctcactgcttataaatctgctcaggacattgcaaacactgagttgcctccaactcatcctatcaggcttggtcttgctctgaacttctccgtgttttactatgagattctcaactctcccgacagggcttgcggccttgcaaaacaggcttttgatgaagctattgctgagttggatacattgggagaggagtcatacaaggatagcactttgattatgcaacttctccgtgataacctcaccctttggacctctgatatgcaggatgacggtgctgatgaaatcaaagaagctgcacctaaaggcaatgatgaaccacagtaaaatgtgtgactgctaattagttattaaacttctcttctatcatgtttttaaagggagaaggtgctgattgataatgttgaagctactgagattttaggcgttcatggtctattttatgatatatggatgcactgggcttttttagttt

SEQ ID NO: 705 - protein, 261 aa, Vicia faba
MATAPTPREEFVYMAKLAEQAERYEEMVEFMEKVTAAVESEELTVEERNLLSVAYKNVIGARRASWRIISSIEQKEESRGNDEHVSVIRDYRSKIETELSNICNGILKLLDSRLIPSAALGDSKVFYLKMKGDYHRYLAEFKSGAERKDAAESTLTAYKSAQDIANTELPPTHPIRLGLALNFSVFYYEILNSPDRACGLAKQAFDEAIAELDTLGEESYKDSTLIMQLLRDNLTLWTSDMQDDGADEIKEAAPKGNDEPQ

SEQ ID NO: 706 - DNA, 1136 bp, Hordeum vulgare
  CDS (64)..(852)
gacagccgcccgtcttgctcgagattgacctttggtgaccattagaaaccagagacactgaagatggcgcagcctgctgagctttcccgtgaggagaatgtgtacatggctaagcttgcagagcaggctgagaggtacgaggagatggttgagttcatggagaaggtggccaagacggttgactccgaggagctcaccgtcgaagagcgcaaccttctatcagttgcttacaagaatgttattggtgcccgccgtgcctcgtggcgcatcatttcctccatcgagcagaaggaagagagccgtggcaacgaggaccgtgtcacactcatcaaggactaccgtggaaagattgaagttgagctcactaagatttgtgatggtatcctcaagcttcttgattcccaccttgtcccctcatctaccgctccagagtccaaggtcttctacctgaagatgaagggtgattactacaggtaccttgcagagttcaagagtggaactgagaggaaggatgctgctgagaacaccatggtggcatacaaagctgctcaggagattgcactggcagagctgcccccgactcatcctattaggcttgggctggcactcaacttctcggtgttctactatgagatcctcaactctcctgaccgtgcttgcgacctcgccaagcaggcttttgacgaggccatctcggaattggactcactgagcgaggagtcctacaaggacagcactttgatcatgcagcttctccgtgataacctgacgctgtggacttccgacatctcggaggacgctgctgaagaaatgaaggatgctcccaagggtgaatctggagatggacagtaaacattgtctatgtgtccagaaacttgtctttcttgcttgttcagtgtagattgtaatgtcgtcagtgtggttgttggtaattggaggctccaatttgtgttgtgatagggaagcttgtagctgcctgccttgcttggttatcgggctgcactggttattgcctcttgttgaaccttcctgttactttggtggttctagaaatttctgctgctcttgtctgtgtggccccttgtctattcatctgcttttcttctttaggaagggcgtcttctgaaccctttcca

SEQ ID NO: 707 - protein, 262 aa, Hordeum vulgare
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 708 - DNA, 1037 bp, Nicotiana tabacum
  CDS (14)..(781)
attagaattcattatggcgcgtgaggagaacgtgtacatggcgaagcttgccgagcaagccgagagatatgaggaaatggtatcgttcatggagaaagtttcgacttccctagggacgtcagaggaactcacggtagaggagagaaatctcctctccgtggcgtacaagaatgttatcggggctcgtagagcctcgtggcgtataatctcctccatcgaacagaaggaggagtcgaggggtaacgaggaccatgtgaaatgcattcaggaatacagatctaagattgaatctgaactctccaatatctgtgatggcattctcaagctccttgattcttgtcttattccttctgcttcagctggtgattctaaggtattttaccttaaaatgaagggtgattatcatcgttatttggctgagtttaagactggtgctgaacgtaaggaagccgctgagagtactctctccgcctacaaagccgctcaggatattgcaaatgctgaacttgccccaactcaccctatccgacttggactggctctcaacttctctgtgttttattatgagattttgaactctcctgatcgtgcctgcaatcttgctaaacaggcctttgacgaagcaattgcggaattggacacactgggagaggagtcttacaaggatagcactttgatcatgcaactgcttcgtgacaatcttactctctggacctctgatatgcaggatgatggcgctgatgaaatcaaggaaaccaaaactgacaatgaacaacagtgagggaactgcccctcaaattgtcttttgacttctgcctgatggtttttattgggagaagctgtttccttttatttcctttctactgtggtttccctttagcgttctcttatcctcgcaataaaaactctgattattgatgttcaatgatttcatctttattttaatgtgctcctggtgctttgtttctattaaagtatttcagttgtatttttgaaccggatatatatcaaatggtacaccgaagtgatactcaaaa

SEQ ID NO: 709 - protein, 255 aa, Nicotiana tabacum
MAREENVYMAKLAEQAERYEEMVSFMEKVSTSLGTSEELTVEERNLLSVAYKNVIGARRASWRIISSIEQKEESRGNEDHVKCIQEYRSKIESELSNICDGILKLLDSCLIPSASAGDSKVFYLKMKGDYHRYLAEFKTGAERKEAAESTLSAYKAAQDIANAELAPTHPIRLGLALNFSVFYYEILNSPDRACNLAKQAFDEAIAELDTLGEESYKDSTLIMQLLRDNLTLWTSDMQDDGADEIKETKTDNEQQ

SEQ ID NO: 710 - DNA, 1105 bp, Vicia faba
  CDS (52)..(837)
gaaagagagagagatttcgcaattcgcaaaccctaatcaacgagatcggcgatggcttccaccaaggatcgcgagaacttcgtctacatcgccaagctcgctgagcaagctgaacgatacgaagagatggtggattcgatgaagaatgttgcgaatctagatgttgaactgactattgaagagaggaatttgctttctgttggttataagaatgtgatcggtgctcgcagagcgtcttggaggattctgtcttcgattgagcaaaaggaggagtcgaagggaaatgatgtaaatgcgaaacggattaaggagtataggcataaggttgaaactgagctttcgaacatctgtattgatgttatgagagttattgatgaacatctaataccttcggctgcagctggcgaatcaactgtgttttactataagatgaaaggagattattatcgttaccttgcggaatttaagacagggaatgagaagaaggaggctggtgatcagtcaatgaaagcatatgagtctgctactactgcagcagaggctgaattaccccccactcatcccattcggttgggtttggctttgaatttctcagttttctattacgagatcttgaattcaccagaaagagcctgccatcttgcaaagcaggcatttgatgaagctatttcggagctcgacactttgaatgaggagtcctacaaagatagtacattgatcatgcaacttctcagggacaacctgactctctggacttctgacatcccagaagatggagaagattcccagaaagcgaatggcactgccaagttcggcggaggtgatgatgcagagtgaggctggtgtttggtgggaacttctttagaatttgatgcaggtgcttgagtatgaagcattagggctgattacttatttgtgtactagctagagttagggttccattgtttctctttctctgttttgtgtcaattggccttacattcctatagaggaaaacaaaactccatttgtgcttatattatgattatgtttttatttgtgtggtgtcttgaaatggtctgtttcactcctcagcacctccttctgtctttgggagattgatttt

SEQ ID NO: 711 - protein, 261 aa, Vicia faba
MASTKDRENFVYIAKLAEQAERYEEMVDSMKNVANLDVELTIEERNLLSVGYKNVIGARRASWRILSSIEQKEESKGNDVNAKRIKEYRHKVETELSNICIDVMRVIDEHLIPSAAAGESTVFYYKMKGDYYRYLAEFKTGNEKKEAGDQSMKAYESATTAAEAELPPTHPIRLGLALNFSVFYYEILNSPERACHLAKQAFDEAISELDTLNEESYKDSTLIMQLLRDNLTLWTSDIPEDGEDSQKANGTAKFGGGDDAE

SEQ ID NO: 712 - DNA, 1118 bp, Glycine max
  CDS (12)..(788)
gcagatcctccatggcctccaccaaggaacgtgaaaacttcgtctacgtcgccaagctcgccgaacaagccgaacgctatgaagaaatggtggaagcaatgaagaatgtggcgaacctaaacgtggaattgacggtagaggagcggaaccttctgtcggttgggtacaagaacgtggtgggtgctcgtagggcttcgtggaggattctttcctcgattgaacagaaagaagaagctaaagggaacgatgtgagcgtgaagaggataaaggagtataggctgaaggtggagtctgagttgtccaatatctgcagtgatatcatgactgttattgatgaataccttattccctctagctcatctggtgaacctagtgtctttttctacaaaatgaagggggactattaccggtacctcgcagagttcaagtccggtgatgagagaaaagaggctgctgatcattccatgaaagcgtatcagttggcttccactactgccgaggctgagttagcatccacacatcccatccgtttgggcctggctttgaacttctctgtcttttattatgaaattttgaactctcctgaaagggcctgtcaccttgctaagcaggcatttgatgaagcaatctctgagttggatactctgagcgaggagtcttacaaagacagcaccctaattatgcagcttctgagggacaatctcaccctgtggacttctgacatccctgaagatggagaggaacaaaaggtggattctgcccgagctgatggaggtgacgatgcataggtattggccaaggaatttgtggagtgcatacgagaaggctagtctctctcttgatagtttaccattaggatgttgtaatagaacatggaattggtctctagaaaatcaccataaggctttgtgagccttttattctatgcgtgtgctttctgttactggagactggagttgagatttgcatggtgtttggctctaatttagtgaatttcttcattttgactttctttctaagaggatgctaccttgcattcttttatcagtttacatagataatatttatttcaaattatgcgaatcattgtttctaaacaaaaaaaaaaaaaaaaaaaa

SEQ ID NO: 713 - protein, 258 aa, Glycine max
MASTKERENFVYVAKLAEQAERYEEMVEAMKNVANLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARADGGDDA

SEQ ID NO: 714 - DNA, 1027 bp, Nicotiana tabacum
  CDS (71)..(853)
cccattcagaaaatcggaaaactccctcattcagatctccaaaaaaaaatacagagaaacaaatctaaacatggcggtggcaccgacggcgcgtgaggagaacgtgtacatggcaaagcttgcagagcaagctgagaggtacgaagaaatggttgaattcatggaaaaggtctccaactccctcggctcagaagaactcaccgtggaggaacgaaacctcctctccgtcgcgtacaagaacgtgatcggagcgcgtagggcatcgtggcgtattatctcatcgattgagcaaaaggaagagtccagagggaacgaggaacacgtaaactctatccgcgagtacagatctaagattgagaatgaactctctaagatctgtgatggcattctgaaattgctcgatgcaaagcttatcccttctgcagcatctggtgattctaaggtgttttacctgaaaatgaaaggagattaccaccgctatttggctgagttcaagaccggtgctgaacgtaaggaggctgctgagagtactctcactgcctacaaagctgctcaggatattgcaactactgagcttgccccaacacatcccatccgacttggactggctcttaacttctctgtgttttactatgagatcttgaactctcctgaccgcgcttgcaatcttgctaaacaggcctttgatgaagcaattgctgagttggacacactgggcgaggagtcttacaaggatagcactttgatcatgcaacttcttcgtgacaatctcactctctggacatctgatatgcaggatgatggggctgatgaaatcaaggaagatcccaaacctgatgaagccaaaaattgaaggaattgaaactctctaatttgcttttcacttcttcctggttgtttttattggaagaagctgattatcgtaatttcctttactattatggttttccgctagggggttgtcttattggaaatgaacaacttttaatattgatgtttcagaagttccatctttaaaaaaaaaaaa

SEQ ID NO: 715 - protein, 260 aa, Nicotiana tabacum
MAVAPTAREENVYMAKLAEQAERYEEMVEFMEKVSNSLGSEELTVEERNLLSVAYKNVIGARRASWRIISSIEQKEESRGNEEHVNSIREYRSKIENELSKICDGILKLLDAKLIPSAASGDSKVFYLKMKGDYHRYLAEFKTGAERKEAAESTLTAYKAAQDIATTELAPTHPIRLGLALNFSVFYYEILNSPDRACNLAKQAFDEAIAELDTLGEESYKDSTLIMQLLRDNLTLWTSDMQDDGADEIKEDPKPDEAKN

SEQ ID NO: 716 - DNA, 1157 bp, Glycine max
  CDS (13)..(798)
gaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagacagggattctattgtttcctctttgtttcctgttggattgcccaatacttcccgataggggcaaagagatactccatttgtgctatatttatggtatgtttttatttgtgtggtgtctggaaatggcctatttcattcccttaccgtttcctccagtctctgggggatttgattgatgagaattgcttatggtgggtgtatttccttttccaatgaaatgctacaacatttactgcaaaaaaaaaaaaaaaaaaaaaaaaaaaaa

SEQ ID NO: 717 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 718 - DNA, 938 bp, Nicotiana tabacum
  CDS (11)..(760)
atatccgacgatggccgtgccggaaaatttaaccagagagcagtgcctatacttagcaaagctcgccgagcaagccgagcgttacgaggagatggtaaaattcatggaccgcctcgtagccgtctcggcttcctcagagctaaccgtagaggagcgaaacctcctctcggtggcatataagaacgtaatcggctcacttcgagccgcgtggaggatagtttcgtcaattgagcaaaaggaagaaggtaggaagaacgaggaacacgtggttctagtgaaggattatagatctaaggttgaatctgagcttagtgatgtttgtgctggaattttgaagattttggatcagtatttgattccttctgctgctgctggcgagtcaaaggtgttttacttgaagatgaagggagattattatcgttatttggctgaatttaaagttggtaatgaacgtaaggaggctgctgaggacactatgcttgcctacaaagctgctcaggacatcgcccttgctgagcttgccccaacacatcctatacgacttgggctagctctcaactattcagtattctactatgagattctgaatgcatcagaaaaagcatgcagcatggctaaacaggcctttgaggaagctattgccgaactggacactttgggggaagaatcctacaaggatagcacccttatcatgcagttattgagggacaatctcactctctggacttcggatatgcaggagcagatggacgaggcttgacaagaaagtagaaactgctcgtctaggaggtgacctcaaatgtcacacagcaactctgtaatctacatatgtgactgataacttttgtaattttatttctcatgcctactttgataattatcttatttcaaactctggtttgaaacttaatgtttcaatttaaaaaaaaaaaaaaaaa

SEQ ID NO: 719 - protein, 249 aa, Nicotiana tabacum
MAVPENLTREQCLYLAKLAEQAERYEEMVKFMDRLVAVSASSELTVEERNLLSVAYKNVIGSLRAAWRIVSSIEQKEEGRKNEEHVVLVKDYRSKVESELSDVCAGILKILDQYLIPSAAAGESKVFYLKMKGDYYRYLAEFKVGNERKEAAEDTMLAYKAAQDIALAELAPTHPIRLGLALNYSVFYYEILNASEKACSMAKQAFEEAIAELDTLGEESYKDSTLIMQLLRDNLTLWTSDMQEQMDEA

SEQ ID NO: 720 - DNA, 1116 bp, Nicotiana tabacum
  CDS (51)..(869)
acaatcagagaccattagctatacatcaatcagataactagacaacaaacatggccgagtcaacacgtgaagaaaatgtgtacatggccaagctggctgagcaggctgagcggtatgaagaaatggttgagtttatggagaaggtcgcaaagacagtagatgttgaagaactgaccgtggaggaaaggaatcttctttctgtggcttacaagaatgtgattggtgcaagaagggcttcatggaggataatctcttcaattgagcagaaagaggaaagccgtggaaatgaagaccatgttagcagcattaaagaatacagaggcaaaattgaggctgaactcagcaagatatgtgatgggattttgaacctccttgagtcccatttaataccagttgcctcaacagccgagtctaaagtgttttacttgaagatgaaaggtgattatcacaggtacttggctgagtttaagacaggggcagaaaggaaagaagccgcagagaacactttattagcctacaagtctgctcaggatattgctttggctgaactagctcctactcacccaatcaggctgggacttgcccttaacttttcagtgttctattatgaaattctcaactcgtcggatcgtgcttgtaaccttgcaaagcaggcctttgacgatgccatcgcggagctggatactctgggtgaggaatcttacaaggacagtacattgattatgcaacttctccgagacaatcttacactttggacttctgataccacggtctctctctctctctctcagaaatacacacccaccaatgcagatgcacccaccaacaataccgtgcacacgagcaaaagttttttgggaagtgcatgacctttgtacatgtacacccaggaaatggactagcttgattgctaaatgccactccctccgtttcatttatgcgacacattttacttctcgagattcaaactttgtgaagtttgaccaacattttaacatttttttaatcatattgacatgagaagaattgtaacttatagtactttttgtataattttttatatctaaattataattttaaaatattgagttgaaaaaaaaaaaaaaaaaaaaaaaa

SEQ ID NO: 721 - protein, 272 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDTTVSLSLSQKYTPTNADAPTNNTVHTSKSFLGSA

SEQ ID NO: 722 - DNA, 927 bp, Nicotiana tabacum
  CDS (50)..(826)
gctctttcatttcatattcccagttctctctctctcccttcaaacatcgatgtcgtcgtcgcgcgatgagttcgtatacatggcgaagcttgcggagcaagctgagcggtacgaggagatggtagattttatggagaaggtcgtaaccgccgcggacggcggcgaggaactcactatcgaagaacgtaatcttctatccgtagcatacaaaaacgtgatcggagcacggcgagcctcgtggcgaatcatttcctctatcgagcaaaaagaagagagccgaggcaacgaagatcatgtgacctctattaaaacttacagatctaagatcgagtcggagttgacctcgatctgtaacggtatcctcaagctgctcgattcaaatctcatccgcgctgcgtcaaccggagattctaaggtgttttatttgaaaatgaaaggagattatcaccggtatttggctgagtttaagaccggagctgagagaaaggaagctgctgagaatactctttcatcttacaagtccgctcaggatattgcaaatgcggaactggcacctacacatcctattcgattggggcttgctctcaatttctctgtattttattatgagatattgaattctcctgatcgtgcctgtaatcttgccaaacaggcctttgatgaggcgatcgctgagctggacacattgggggaggagtcctacaaggatagcacgttgataatgcagcttcttcgcgataatctgactttgtggacctcggacatgcaggacgagggaacagaagagatgaaagaagtagcaaaacctgataatgaggagcactaaaagtggtgaaaatctttaattcaggatttgaatgccatgttaaactttgctcattggtttaattaagctctttgcagttctaactccaaaaaaaaaaaaaa

SEQ ID NO: 723 - protein, 258 aa, Nicotiana tabacum
MSSSRDEFVYMAKLAEQAERYEEMVDFMEKVVTAADGGEELTIEERNLLSVAYKNVIGARRASWRIISSIEQKEESRGNEDHVTSIKTYRSKIESELTSICNGILKLLDSNLIRAASTGDSKVFYLKMKGDYHRYLAEFKTGAERKEAAENTLSSYKSAQDIANAELAPTHPIRLGLALNFSVFYYEILNSPDRACNLAKQAFDEAIAELDTLGEESYKDSTLIMQLLRDNLTLWTSDMQDEGTEEMKEVAKPDNEEH

SEQ ID NO: 724 - DNA, 795 bp, Candida albicans
  CDS (1)..(795): transl_table=12
atgccagcctcccgtgaagattccgtttaccttgctaaattagccgaacaagcagaacgttatgaagaaatggttgaaaacatgaaagccgttgcttcctctggccaagaattgtctgttgaagaacgtaatttattatctgttgcttacaagaatgtcattggtgctcgtcgtgcttcttggagaattgtttcatcaattgaacaaaaagaagaagccaaaggaaatgagagccaagttgctttgatcagagattaccgtgccaagattgaagctgaattgtctaaaatttgtgaagatattctctctgtgttgagcgaccatttaattacatctgcccaaactggtgaatcaaaagtattttactacaagatgaaaggtgattaccacagatacttggctgaatttgctatcgctgaaaaacgtaaggaagctgctgatttatcattagaggcttataaagctgcttctgacgttgctgtgaccgagttgccaccaacccatccaatcagattaggtttagcattgaacttctctgttttctactatgaaattttgaactccccagatagagcttgtcatttagctaaacaagctttcgatgatgctgttgctgatttagaaaccttatctgaagattcatacaaggattcaactttgattatgcaattattgagagataacttgactttatggaccgatttatctgaagccccagctgccactgaagaacaacaacaatccagtcaagctccagctgctcaaccaacagaaggtaaggctgatcaagaatag

SEQ ID NO: 725 - protein, 264 aa, Candida albicans
MPASREDSVYLAKLAEQAERYEEMVENMKAVASSGQELSVEERNLLSVAYKNVIGARRASWRIVSSIEQKEEAKGNESQVALIRDYRAKIEAELSKICEDILSVLSDHLITSAQTGESKVFYYKMKGDYHRYLAEFAIAEKRKEAADLSLEAYKAASDVAVTELPPTHPIRLGLALNFSVFYYEILNSPDRACHLAKQAFDDAVADLETLSEDSYKDSTLIMQLLRDNLTLWTDLSEAPAATEEQQQSSQAPAAQPTEGKADQE

SEQ ID NO: 726 - DNA, 1464 bp, Chlamydomonas reinhardtii
  CDS (69)..(848)
agacaccgtgcttcacacagtctcacacacaccttgcatttagcccgctacagagagcactagctgagatggcggtcgaccgggaggaatgcgtctacatggccaagctggccgagcaggctgagcgctatgacgagatggtggaggagatgaagaaggtggccaagctggtgcacgaccaggagctgtccgtggaggagcgcaacctgctttcggtggcttacaagaacgtcattggcgctcgccgcgcgtcctggcgcattatctcctccatagagcagaaggaggaggctaagggcaacgaggagcatgtccagcgcattcgcaagtaccgcactgtggtcgaggaggagctcagcaaaatctgcgccagcattctgcagctgttggacgaccacctgatccccactgcctccactggcgagagcaaggtgttctacctgaagatgaagggcgactaccaccgctacctggctgagtttaagaccggcgctgaccgcaaggaggctgccgagcacaccctgctcgcgtacaaggccgcgcaggacattgccctggtggacctcccgcctacgcaccccattcgcctgggcctggccctcaacttctccgtcttctactacgagattctgaactcgcccgagcgcgcgtgccacctggccaagcaggcgttcgacgaggccattgccgagcttgactcgctgggcgaggagtcctacaaggactcgacgctcatcatgcagctgctgcgcgacaacctcacactgtggacctccgacatgcaggaccccgctgccggtgacgacagagagggcgctgacatgaaggttgaggacgctgagccctgaaaggagcttctgcagcagccggggccgggtcagtagcctgaagctcgttctacacgtaatacggggaatcgtttttagggtttgggagtgggcctgttctgaagtgcacgcttcaaacatggctgcacgtgtggtccacgcacggtgttcgtcacatgcattgttgtcgtggctacccggggtcgataaattctttgcctcaggtgactggtcccacacataggcggggagatccggtggggagttgcgcttgtcgaggtcggcgtgaagtggcgttacagctatctcgtcggagaaccctaactacgagagtggcgggtccgaagacgtgtcatgcaaaacacgttgtgtgggtgcgtacagagggcctcttgacattgtgttggccatcacggcccaatgcgcacgttgacgagtccgggtacattccgtaaattcaatcgcaatgcgtaggttcttagacattagaccgccatgagtggtggggccgactgcatacgttggaccagaccgtggcgctggcgctgtgagatggaacatatgtgaagtgcgtgaggcgtgttgaagcgcactaatgcttgcaaaatggcttccatggaaaaaaaaaaaaaaaaaa

SEQ ID NO: 727 - protein, 259 aa, Chlamydomonas reinhardtii
MAVDREECVYMAKLAEQAERYDEMVEEMKKVAKLVHDQELSVEERNLLSVAYKNVIGARRASWRIISSIEQKEEAKGNEEHVQRIRKYRTVVEEELSKICASILQLLDDHLIPTASTGESKVFYLKMKGDYHRYLAEFKTGADRKEAAEHTLLAYKAAQDIALVDLPPTHPIRLGLALNFSVFYYEILNSPERACHLAKQAFDEAIAELDSLGEESYKDSTLIMQLLRDNLTLWTSDMQDPAAGDDREGADMKVEDAEP

SEQ ID NO: 728 - DNA, 780 bp, Helianthus annuus
  CDS (1)..(780)
atggcagccgcatcatctcctcgcgaagagaacgtatacctagcaaaactcgcagaacaagccgaacgctacgaagaaatggtcgaattcatggaaaaagtcgtcgccgccgcagacggcggagaagaactaaccatcgaagaacgaaacctcttatccgtcgcctacaagaacgtcatcggagcacgaagagcctcgtggcggatcatctcttcaatcgagcagaaagaggagagccgtggcaacgaaggacacgtgtccaccatccgtgactacagatctaagatcgagtcggagttatcgtcgatttgcgacggtattttgaaggttctggattccaaacttattggatctgcatctggtggtgattcaaaggtgttctatttgaagatgaaaggtgattattataggtatttggctgagtttaagaccggagatgagaggaagctggctgctgagaatactctttcggcttataaggctgctcaggatattgcgaatgcggaactagctcccacccatccgatcagattaggactggcactcaacttctctgtgttttactatgagatccttaactcacctgatcgcgcttgtaatcttgcaaaacaggcttttgatgaagcaattgctgaattggatactttaggagaggactcatacaaggacagcactctcatcatgcagctacttcgcgataaccttactttgtggacttctgatatgcaggatgacactgctgaagaagttaaagaagcacctaagcctgatgatcagtaa

SEQ ID NO: 729 - protein, 259 aa, Helianthus annuus
MAAASSPREENVYLAKLAEQAERYEEMVEFMEKVVAAADGGEELTIEERNLLSVAYKNVIGARRASWRIISSIEQKEESRGNEGHVSTIRDYRSKIESELSSICDGILKVLDSKLIGSASGGDSKVFYLKMKGDYYRYLAEFKTGDERKLAAENTLSAYKAAQDIANAELAPTHPIRLGLALNFSVFYYEILNSPDRACNLAKQAFDEAIAELDTLGEDSYKDSTLIMQLLRDNLTLWTSDMQDDTAEEVKEAPKPDDQ

SEQ ID NO: 730 - DNA, 1153 bp, Lilium longiflorum
  CDS (97)..(876)
ctggcacgagccctattcctctttttagtgcctccccacctctcccccaaaatccgaacagctcctcgttcctatctaggtttcaacgcgttcaggatgtcgccggcggagccatcgcgggaggagaacgtgtacatggcgaagctggcggagcaggcggagcgctacgaggagatggtggagttcatggagaaggtggcccgcacggttgacaccgaggagctcactgttgaggagcgcaacctcctgtcagtggcgtacaagaacgtcatcggcgcccgccgcgcctcgtggcggatcatttcctcgatcgagcagaaggaagagagccgcgggaacgaggatcatgtcgcgttgatcaaggattaccgcgggaagatcgaggccgagctgagcaagatctgtgacgggatcctcaagctacttgattcgcatctggtgccgtcttcgacggcgccggagtcgaaggtgttttacctcaagatgaagggagactaccacaggtaccttgcggagttcaaatctggagctgagaggaaggaggctgcggagagcacgctcttggcctacaagtctgctcaggacattgctctggcggagctggctcctactcatccgatcaggctcgggctggcgcttaacttctctgtcttctactatgaaatcctgaactcgccggaccgtgcttgcaatctagcaaagcaggcctttgatgaggctatctcagagctagacactttgggtgaggaatcgtacaaggacagcacactgatcatgcagcttctccgagacaatctgactctgtggacctccgatatcaacgaggaggccggggatgagattaaggaagcctcaaaagcagtagagggacagtaatgaaccgtggtgaaccgctatgctgttggagtctatgttttttatttttgtgtccggtggagttatagttaggatatttatgctcagcaaacctattgtgtggcttttgaatgtacctcccatcatttttattgtggattgttgttctagttgaacaaggttttgttcgtatgcaatacttcatttcagtttatatcatgtgggcttgaaaacaagtgattttcaataattatatagtactggcatatctttatgaatgatttggcaaaagttggct

SEQ ID NO: 731 - protein, 259 aa, Lilium longiflorum
MSPAEPSREENVYMAKLAEQAERYEEMVEFMEKVARTVDTEELTVEERNLLSVAYKNVIGARRASWRIISSIEQKEESRGNEDHVALIKDYRGKIEAELSKICDGILKLLDSHLVPSSTAPESKVFYLKMKGDYHRYLAEFKSGAERKEAAESTLLAYKSAQDIALAELAPTHPIRLGLALNFSVFYYEILNSPDRACNLAKQAFDEAISELDTLGEESYKDSTLIMQLLRDNLTLWTSDINEEAGDEIKEASKAVEGQ

SEQ ID NO: 732 - DNA, 1242 bp, Mesembryanthemum crystallinum
  CDS (55)..(849)
tctctctctcaattccgtaataaccgattttgagatttgtttggcatagtgaaaatgtcgtccgaatcctccagggaagaaaatgtttacatggccaagctggccgagcaggcggagcgctatgaggaaatggtggagttcatggagaaagttgcaaagatgacagataccgaggaacttagcgttgaggagagaaacctcttgtctgtggcttacaagaatgtgattggtgctaggagggcttcgtggaggattatttcctctattgagcagaaggaggaaagcaggggaaacgaggatcacgtttcaaccatcaaggagtacaggggtaagattgaaactgagttgagcaagatctgtgatgggatcttgaacctccttgagtcacacctcatcccttcagcctccactgctgaatcaaaggtcttttacctcaagatgaagggtgactaccataggtaccttgccgagttcaagactggagccgagaggaaggaggctgctgagaacaccctgttggcttacaagtccgctcaggacattgctttggcagaattggccccgactcatcctattaggcttggacttgctcttaacttttctgtcttctattacgaaattttgaactcacctgaccgtgcttgcaatctagcgaaacaggcttttgatgaggctatctctgagcttgatactttgggtgaggagtcatacaaggacagcacattgatcatgcagcttctccgagacaatctaaccttgtggacttcagataatgcggaggagggaggcgatgagatcaaggaggctgctgccaaacgggaatcaggcgaggagaagcctcagcagtgataaatttaaaggagttctgctatgtatttgtcgcacggggctcctatatagatgtcatttgggtggttgtagctaggattattagtgaatcatattatctttagcacctgattgctgggtagcactcagatttagcggtcatcatgtcatttccatagacttataaacagcttctgctcgtggtcgtatttcagtgttgtgagagttttagcttatattcaacttgtttgcgtgcccaaagaggaggtattttgatttatctcagcctaaaggttgtacttatacttctgttcttgtttgtccatgttgaagtaactatctgctttgtactactattattcgcttgtggtttgcacctaaaagagtgattacaatgcaagtaagcattttaat

SEQ ID NO: 733 - protein, 264 aa, Mesembryanthemum crystallinum
MSSESSREENVYMAKLAEQAERYEEMVEFMEKVAKMTDTEELSVEERNLLSVAYKNVIGARRASWRIISSIEQKEESRGNEDHVSTIKEYRGKIETELSKICDGILNLLESHLIPSASTAESKVFYLKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDNAEEGGDEIKEAAAKRESGEEKPQQ

SEQ ID NO: 734 - DNA, 1017 bp, Oenothera hookeri
  CDS (39)..(821)
ctaacctctctctctctctctctctccctccctcaacaatggcgactgcaccttcaccgcgcgaggagaacgtctaccttgccaagctcgccgagcaagccgagcgctacgaggagatggttgagttcatggagaaggtctgcgccgctgctgactccgaggagctcacagtcgaggagcgcaacctcctctccgttgcctataagaacgtcatcggcgctcgtcgtgcttcctggcgtatcatctcctccatcgagcagaaggaggagagccgcggtaacgacgaccatgtctccaccatccgcgattaccgctccaagattgagaccgagctctctaacatctgtggtggaatcctcaagcttcttgattcccgtctcattccctccgctgcctctggtgactccaaggttttttatttgaagatgaagggagattaccacaggtacttggctgagttcaagacaggagctgagcgcaaagaagccgccgagagcaccctgtctgcctacaaagctgctcaggatattgcaaatgccgaattggctccaactcacccaatcagactcggattggcccttaacttttctgtcttctactatgagatcctcaactctcctgatcgtgcttgcaaccttgcaaacgaggcatttgatgaagcaattgctgaactggatactctggaagaggagtcgtacaaggacagcactctgatcatgcaacttcttcgtgacaatctcaccctctggacatccgacatgcaggatgatggaggtgatgagattaaagaagcggctccaaagcctgacgaacagtactgattaatgctcggtttgggtcaatgaagaaatattgaagcactccattgagtttttcagtaggagaagttgcttatttgtgactgctttctttttttttttgttcctctcttatgccgaagatgtcaaggcacgacctttgttactgaattgaattatgtcatgctgtgttaattgaatctcttctcttttttttttt

SEQ ID NO: 735 - protein, 260 aa, Oenothera hookeri
MATAPSPREENVYLAKLAEQAERYEEMVEFMEKVCAAADSEELTVEERNLLSVAYKNVIGARRASWRIISSIEQKEESRGNDDHVSTIRDYRSKIETELSNICGGILKLLDSRLIPSAASGDSKVFYLKMKGDYHRYLAEFKTGAERKEAAESTLSAYKAAQDIANAELAPTHPIRLGLALNFSVFYYEILNSPDRACNLANEAFDEAIAELDTLEEESYKDSTLIMQLLRDNLTLWTSDMQDDGGDEIKEAAPKPDEQY

SEQ ID NO: 736 - DNA, 1113 bp, Pisum sativum
  CDS (86)..(868)
tttttttctctctcacaatctcaatcgctttctctctctaaactccctaaaaccagatctcgctttctctctctaggtttcaacaatggcggccgctcatactcctcgggaagagaacgtctacatggctaagctcgccgagcaagccgagcgctacgaagaaatggtggagttcatggaaaaggtttccgctaacgccgatagcgaagaactcaccgtggaggagaggaatcttctctccgtcgcttacaaaaacgtgatcggagctagacgtgcctcgtggcgtatcatttcgtcgatcgagcagaaggaagagagccgcggcaacgaggatcacgtcgccgtcatccgtgattaccgatctaaaatcgagtctgagctctctaacatctgcgacggtatcctcaagctcctcgatactcgtctcattccatcagcttcctctggcgattctaaggttttctaccttaagatgaagggagattaccacaggtacctcgctgagtttaagaccggagccgagcgtaaggaggctgcagagagcactcttacaggctacaaatctgctcaggacattgcaaatgctgaattaccaccaactcatccaattaggcttggccttgccctgaacttctccgttttttactatgaaatccttaactctcctgatcgtgcctgcaatcttgcaaaacaggcttttgatgaagctattgctgaattggatacccttggagaggaatcatacaaggatagcactttgatcatgcaacttcttcgtgataatctcaccctatggacctctgacatgcaggatgatggtgctgatgaaattaaagaagcagccccaaaagcagatgaacagcagtaaacaaattcaactgccaattagaatcgaacttctcctcctctataagttaatgaatgaaggaagaaggtgcttgttgccaatctctttgggttctgagattttaggcattcatgtctgttgagttctggagtcctgggctgttttagtttgtccttccatttttaagtgttttacaaattattgcctattttattgaggacactgaagttttattatatggaattggaaatttaagattcaaaccg

SEQ ID NO: 737 - protein, 260 aa, Pisum sativum
MAAAHTPREENVYMAKLAEQAERYEEMVEFMEKVSANADSEELTVEERNLLSVAYKNVIGARRASWRIISSIEQKEESRGNEDHVAVIRDYRSKIESELSNICDGILKLLDTRLIPSASSGDSKVFYLKMKGDYHRYLAEFKTGAERKEAAESTLTGYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKADEQQ

SEQ ID NO: 738 - DNA, 1093 bp, Nicotiana tabacum
  CDS (25)..(780)
cccaaatagagagagagcggagaaatggacaaggaaagagagaaacaggtttacttggctaggctggctgaacaagctgagagatatgatgaaatggtagaagcaatgaagacggttgctaagatggatgtcgaactgactgttgaggagaggaatttggtgtcagttgggtataagaatgttattggagcaagaagggcttcatggcggatattgtcttcaattgaacaaaaggaggagagtaagggtcatgaccagaatgttaagagaataaagacttaccaacagagggttgaagatgagcttacaaaatatgcattgacattgtccgtgatagatgagcacgttgttccttcgtccactagtggagaatctactgtcttctactataagatgaagggagactactatcgctatttagcagagttcaaatcaggggatgatcgtaaagaggcagctgatcagtcacttaaagcttatgaggctgctactgccacagctagcgcagatcttgctcctactcacccaattagacttggacttgcattgaacttctcagtcttctactatgagattctaaattcacctgagagggcatgtcacttggccaagcaagcatttgacgaagctattgccgagcttgatagccttagtgaagaatcctacaaggacagtacccttatcatgcagcttctaagggataacttcactttgtggacctcagaccttgaagagggaggtgaacattctaagggtgatgagcgtcaaggggagaactagctgaagttttaaaggagagaaatctttgtgaagctggctccttgtggaaagtctgtttttcatttaatgtttcagggattcatcgctattggcttgtatctacataaacattaccagagtgcttgaaaaccttttttattcttatattttaaattattaagtcaacttttttatggatggttttttacaccgtgaatatcaaaagttaaaaattttcataggatggtgctcgtcaatgagagctacaagaattacataccaaaaattgagataatacattatggcttttcaccagtaaaaaaaaaaaaaaaaa

SEQ ID NO: 739 - protein, 251 aa, Nicotiana tabacum
MDKEREKQVYLARLAEQAERYDEMVEAMKTVAKMDVELTVEERNLVSVGYKNVIGARRASWRILSSIEQKEESKGHDQNVKRIKTYQQRVEDELTKYALTLSVIDEHVVPSSTSGESTVFYYKMKGDYYRYLAEFKSGDDRKEAADQSLKAYEAATATASADLAPTHPIRLGLALNFSVFYYEILNSPERACHLAKQAFDEAIAELDSLSEESYKDSTLIMQLLRDNFTLWTSDLEEGGEHSKGDERQGEN

SEQ ID NO: 740 - DNA, 1101 bp, Trichoderma harzianum
  CDS (35)..(823)
caccaaaaaaaaagttcaaaaatctaccgtcaaaatgggtcacgaagatgctgtttacctggccaagctcgccgagcaggctgagcgatatgaggagatggttgagaacatgaagatcgtcgcctccgaggaccgcgacctgaccgtcgaggagcgcaaccttctctccgtcgcctacaagaacgtcattggtgctcgccgcgcctcttggagaatagtcacttctatcgagcagaaggaggagtctaagggcaactcttcccaggtcacccttatcaaggagtaccgccagaagatcgagaacgagcttgccaagatctgcgacgatatccttgaggttctcgaccagcacctgatcccctctgccaagtctggcgagtccaaggtcttttaccacaagataaagggtgactaccaccgttacctcgctgagttcgctattggcgaccgccgcaaggactctgccgacaagtccctcgaggcttacaaggctgccaccgaggttgcccagactgagctgcctcccacccaccccatccgccttggacttgccctcaacttctccgtcttctactacgagatcctcaacgctcccgaccaggcttgccacctcgccaagcaggcctttgacgatgctattgctgagctcgacaccctcagcgaggagagctacaaggactccactctcatcatgcagctgctccgtgacaacctcaccctctggacctcctccgaggccgagactccggccaggctgatgcccctgctaaggaggagacccctgctgaggctgccgtcccgccgccgaagagcccaaggctgagtaagttcaggggagcacggtataaatctctaggcttgggtcgctttgttatcggatgggctggtgtctacggtgtggatggaagacttcgtttttgatcaagagcttcggcatcgttttaggtaaaactcgcaaactattttcgggaaggaatcgatttggttccccctttacggactggcagggaggatgaagaagaagagcatattggaggttctgcttttagactcttgatgcgtagccgtctggacaaataaaaactactaaaattgcttttt

SEQ ID NO: 741 - protein, 262 aa, Trichoderma harzianum
MGHEDAVYLAKLAEQAERYEEMVENMKIVASEDRDLTVEERNLLSVAYKNVIGARRASWRIVTSIEQKEESKGNSSQVTLIKEYRQKIENELAKICDDILEVLDQHLIPSAKSGESKVFYHKIKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETPARLMPLLRRRPLLRLPSRRRRAQG

SEQ ID NO: 742 - DNA, 822 bp, Saccharomyces cerevisiae
  CDS (1)..(822)
atgtcccaaactcgtgaagattctgtttacctagctaaattagctgaacaagccgaacgttatgaagaaatggtcgaaaacatgaaggccgttgcttcatcaggtcaagagttatctgtcgaagaacggaatctattgtcggttgcttacaagaacgtcatcggtgctcgccgtgcttcatggagaatagtttcttcgatcgaacaaaaagaagaatcaaaggagaaatctgaacatcaagttgaattaatccgttcttaccgttctaaaattgaaactgaattgaccaaaatctctgacgacattttatctgtgttagattctcatttaatcccttctgctactactggtgagtctaaagtattttactataagatgaagggtgactaccaccgttatttagctgaattttccagcggagatgcaagagaaaaggcaaccaactcctctttggaggcttataaaaccgcttccgaaatcgccacaactgaattgcctccaactcacccaattcgtttaggtctagctttgaatttctccgtcttctattacgaaattcaaaactctcctgataaggcttgccacttggccaaacaagcctttgatgatgctattgctgagttagatactttatctgaagaatcatacaaggatagcactttgatcatgcaattattaagggacaacttgaccttatggacctctgatatttctgaatctggtcaagaagatcaacaacaacaacaacaacagcaacagcaacagcaacaacagcaacaacaagctccagctgaacaaactcaaggtgaaccaaccaaataa

SEQ ID NO: 743 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 744 - DNA, 813 bp, Schizosaccharomyces pombe
  CDS (1)..(813)
atgtctactacttctcgtgaagatgctgtttatttagccaaacttgctgagcaagccgagcgctatgaaggcatggttgaaaacatgaaaagcgttgcctccactgatcaagaattgaccgtcgaagagcgtaacttgctctctgttgcttataagaatgtaattggagctcgccgggcgtcttggcgtatcgtttcctccatcgagcaaaaggaggagagcaaaggcaatactgctcaagttgaattaattaaggaatatcgtcaaaagattgaacaagaacttgacactatttgccaagatatcttgaccgttcttgagaagcaccttatccctaatgctgcctctgccgaatccaaggttttctactacaagatgaagggtgactactatcgttaccttgctgagtttgccgttggtgagaagcgccaacactccgctgatcaatctcttgaaggttacaaggccgcttctgaaattgctaccgccgaacttgcacctactcatcctatccgcttaggtcttgctcttaatttctccgttttctactatgagatcttgaactcccccgaccgtgcttgctacttagccaagcaagcctttgatgaagctatctccgagttggacagcctttccgaggaatcctacaaagattctactttaatcatgcaattgttgcgtgacaaccttaccttatggacttctgatgctgaatacagtgccgccgctgctggtggtaacaccgagggagctcaagaaaacgctccttccaatgctccagaaggcgaagctgagcccaaggcggacgcatag

SEQ ID NO: 745 - protein, 270 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDSTLIMQLLRDNLTLWTSDAEYSAAAAGGNTEGAQENAPSNAPEGEAEPKADA

SEQ ID NO: 746 - DNA, 813 bp, Schizosaccharomyces pombe
  CDS (1)..(813)
atgagtaattctcgtgaaaactcggtgtatctcgccaagttggccgaacaggctgaacgctacgaagaaatggtcgaaaatatgaagaaagttgcatgctcaaacgataaactttctgttgaagaacgtaacttgctttctgttgcctataaaaacatcattggtgctcgcagagcatcatggcgtattatttcctctatagagcaaaaggaggaaagtaggggcaacactcgacaagccgcattgattaaagagtaccgtaagaagattgaagatgagttatccgatatttgtcatgacgtcctttccgtccttgaaaagcatttgattcctgccgctacaaccggtgaatccaaggtattttactataaaatgaagggtgattactatcgttatttggccgaatttactgttggcgaagtttgcaaagaggccgccgacagctctttagaagcttacaaggcagcttctgacattgctgttgctgagttgcctcccacggaccctatgcgcttgggtttggctctcaacttttccgtcttctattatgaaatccttgactctccagaaagtgcatgccatttggctaaacaagtatttgatgaggccatttcagagctcgatagtctttctgaagaatcttacaaagactctactttaatcatgcagcttcttcgcgataacttgactttatggacttctgacgccgaatacaaccagtctgctaaggaggaggctcctgctgccgctgctgcttctgaaaacgaacatcccgagcccaaagagtctacgactgacactgttaaagcttga

SEQ ID NO: 747 - protein, 270 aa, Schizosaccharomyces pombe
MSNSRENSVYLAKLAEQAERYEEMVENMKKVACSNDKLSVEERNLLSVAYKNIIGARRASWRIISSIEQKEESRGNTRQAALIKEYRKKIEDELSDICHDVLSVLEKHLIPAATTGESKVFYYKMKGDYYRYLAEFTVGEVCKEAADSSLEAYKAASDIAVAELPPTDPMRLGLALNFSVFYYEILDSPESACHLAKQVFDEAISELDSLSEESYKDSTLIMQLLRDNLTLWTSDAEYNQSAKEEAPAAAAASENEHPEPKESTTDTVKA

SEQ ID NO: 748 - DNA, 777 bp, Oryza sativa
  CDS (1)..(777)
atggcctccaccaaggaacgtgaaaacttcgtctacgtcgccaagctcgccgaacaagccgaacgctatgaagaaatggtggaagcaatgaagaatgtggcgaagctaaacgtggaattgacggtagaggagcggaaccttctgtcggttgggtacaagaacgtggtgggtgctcgtagggcttcgtggaggattctttcctcgattgaacagaaagaagaagctaaagggaacgatgtgagcgtgaagaggataaaggagtataggctgaaggtggagtctgagttgtccaatatctgcagtgatatcatgactgttattgatgaataccttattccctctagctcatctggtgaacctagtgtctttttctacaaaatgaagggggactattaccggtacctcgcagagttcaagtccggtgatgagagaaaagaggctgctgatcattccatgaaagcgtatcagttggcttccactactgccgaggctgagttagcatccacacatcccatccgtttgggcctggctttgaacttctctgtcttttattatgaaattttgaactctcctgaaagggcctgtcaccttgctaagcaggcatttgatgaagcaatctctgagttggatactctgagcgaggagtcttacaaagacagcaccctaattatgcagcttctgagggacaatctcaccctgtggacttctgacatccctgaagatggagaggaacaaaaggtggattctgcccgagctgctggaggtgacgatgcatag

SEQ ID NO: 749 - protein, 258 aa, Oryza sativa
MASTKERENFVYVAKLAEQAERYEEMVEAMKNVAKLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARAAGGDDA

SEQ ID NO: 750 - DNA, 774 bp, Brassica napus
  CDS (1)..(774)
atgtcatcatcacgtgaagagaatgtgtacatggcgaaactagccgagcaagccgagcgttacgaagaaatggtcgagttcatggagaaagttgctaaatctgttgacaacgaagagctcactgttgaagagaggaaccttctctccgttgcttacaagaacgtgattggagccaggagggcttcgtggaggatcatctcttccattgagcagaaggaagagagcaaagggaacgaggatcacgttgctatcatcaaggactacagggccaagatcgaagctgagcttagcaaaatctgcgatggaatcttgaatgttcttgaagctcatctcattccatctgcttcgcctgctgagtctaaagtgttttaccttaagatgaagggagattatcacaggtatcttgctgagtttaaggctggcaacgagaggaaagatgctgctgaaagcactttggttgcttacaagtctgctcaggacattgccactgctgagttggctcccactcacccgatcaggcttggtcttgcactcaacttctctgtgttttactatgagatccttaactcgcctgaccgtgcctgcagcctcgccaagcaggcttttgatgaagcaatcgctgagttagacacgttgggtgaggaatcatacaaggacagtacactgatcatgcagcttctcagagacaatctcactctctggacttcggacatgacagacgaagcaggagatgagataaaggagacgtcgaagccagaaggtgctgcagagtaa

SEQ ID NO: 751 - protein, 257 aa, Brassica napus
MSSSREENVYMAKLAEQAERYEEMVEFMEKVAKSVDNEELTVEERNLLSVAYKNVIGARRASWRIISSIEQKEESKGNEDHVAIIKDYRAKIEAELSKICDGILNVLEAHLIPSASPAESKVFYLKMKGDYHRYLAEFKAGNERKDAAESTLVAYKSAQDIATAELAPTHPIRLGLALNFSVFYYEILNSPDRACSLAKQAFDEAIAELDTLGEESYKDSTLIMQLLRDNLTLWTSDMTDEAGDEIKETSKPEGAAE

SEQ ID NO: 752 - DNA, 789 bp, Brassica napus
  CDS (1)..(789)
atggaatctgccaaagagcgtgacactttcgtctacctcgctaagttatctgaacaagctgagcgctatgaagagatggtggagtcgatgaagaaccttgcgaagctgaacgttgatctaacgttggaagagaggaacttgctctctgttggatacaagaacgtgatcggttcgaggagagcttcttggaggatcttctcgtcgatcgaggagaaagaagcagtgaaagggaacgatgttaatgtaaagagaatcaaagattatatggagaaggttgagttagagctcacaagtatatgcattgacataatgtctgtgttggacgagcatctgatcccatctgcttcagagggtgaatcaactgtcttcttcaacaagatgaaaggtgattattaccgctatcttgctgaattcaaatcaggggatgagaggaaagaggctgctgatcagtctttgaaagcctatgagattgctactacttctgctgcggctaaactccctcctacccatcctatcagattgggattggctttgaacttctctgtcttctactacgagatcatgaactcacctgaaagggcatgtcaccttgctaaggaggcgtttgatgaagcaatctcagagcttgacagtctgaatgaggaatcttacaaagatagcactttgattttgcaactccttagggacaatctgaccttgtggacttctgacatccctgaagaaggagatgatgcccataagacgaatggttctgctaaacacggtgcaggtggagacgatgcagagtga

SEQ ID NO: 753 - protein, 262 aa, Brassica napus
MESAKERDTFVYLAKLSEQAERYEEMVESMKNLAKLNVDLTLEERNLLSVGYKNVIGSRRASWRIFSSIEEKEAVKGNDVNVKRIKDYMEKVELELTSICIDIMSVLDEHLIPSASEGESTVFFNKMKGDYYRYLAEFKSGDERKEAADQSLKAYEIATTSAAAKLPPTHPIRLGLALNFSVFYYEIMNSPERACHLAKEAFDEAISELDSLNEESYKDSTLILQLLRDNLTLWTSDIPEEGDDAHKTNGSAKHGAGGDDAE

SEQ ID NO: 754 - DNA, 777 bp, Brassica napus
  CDS (1)..(777)
atgtcatcatcatcacgtgaagagaatgtgtacatggcgaagctagcggagcaagccgagcgttacgaagagatggtggagttcatggagaaagttgctaaatctgttgacaacgaagagctcacagtcgaagagaggaaccttctctccgtcgcttacaagaacgtgattggagcgaggagggcttcgtggaggatcatctcttccatcgagcagaaggaagagagcaaagggaacgaggatcacgttgctatcatcaaggactacaggggcaagatcgaagctgagcttagcaagatctgcgatggaatcttgaatgttcttgaagctcatctcattccatctgcttcgcctgctgagtctaaagtgttttacttgaagatgaagggagattatcataggtatcttgctgagtttaaggctggcaacgagaggaaagatgctgctgaaagcactttggttgcgtacaagtctgctcaggacattgccactgctgagttggctcccactcacccgatcaggcttggtcttgcactcaacttctctgtgttttactatgagatccttaactcgcctgaccgtgcctgcagcctcgccaaactggcttttgatgaagcaatcgccgagttggatacgttgggtgaggaatcatacaaggacagtacactgatcatgcagcttctcagggacaatctcactctctggacttcggacatgacagacgaagcaggagatgagataaaggagacgtcgaagccagaaggtgctgcagagtaa

SEQ ID NO: 755 - protein, 258 aa, Brassica napus
MSSSSREENVYMAKLAEQAERYEEMVEFMEKVAKSVDNEELTVEERNLLSVAYKNVIGARRASWRIISSIEQKEESKGNEDHVAIIKDYRGKIEAELSKICDGILNVLEAHLIPSASPAESKVFYLKMKGDYHRYLAEFKAGNERKDAAESTLVAYKSAQDIATAELAPTHPIRLGLALNFSVFYYEILNSPDRACSLAKLAFDEAIAELDTLGEESYKDSTLIMQLLRDNLTLWTSDMTDEAGDEIKETSKPEGAAE

SEQ ID NO: 756 - DNA, 804 bp, Brassica napus
  CDS (1)..(804)
atgtcgtcaggatccgacaaagagagagagacattcgtctacttggctaagctctccgaacaagccgagcgttacgacgagatggttgagacgatgaagaaagtggcgaaggtggacagcgagctcacggtggaggagaggaatctattgtccgttggttacaagaacgtgatcggagctagacgggcctcgtggaggatcatgtcgtccatcgagcagaaggaagagtctaaaggcaacgaatcaaacgtgaaaacaatcaaggggtatcgccaaaaggtagaggacgagctcgcgaacatttgtcaagacattctcagcatcattgatcagcatctcatccctcacgctacctctggagaagccaccgttttctattacaagatgaaaggagattactaccgttacctggctgagtttaagaccgagcaagagaggaaggaagcctctgaacagtcactcaaaggctatgaggctgcaacacaagctgcaagcactgagcttccttcgacccacccgattcgtcttggccttgctcttaacttctctgttttctactatgagatcatgaactctcctgaaagagcttgccatctggcgaagcaagctttcgatgaggcgattgcggagttggatactctaagcgaggagtcatacaaggatagcactttgatcatgcagctcctgagagacaacctcaccctctggacttctgatcttcctgaagatggaggagaagacaacgccaagactgatgaacccaagaaagaagaggctaagcctgcagaagctaccgagaactga

SEQ ID NO: 757 - protein, 267 aa, Brassica napus
MSSGSDKERETFVYLAKLSEQAERYDEMVETMKKVAKVDSELTVEERNLLSVGYKNVIGARRASWRIMSSIEQKEESKGNESNVKTIKGYRQKVEDELANICQDILSIIDQHLIPHATSGEATVFYYKMKGDYYRYLAEFKTEQERKEASEQSLKGYEAATQAASTELPSTHPIRLGLALNFSVFYYEIMNSPERACHLAKQAFDEAIAELDTLSEESYKDSTLIMQLLRDNLTLWTSDLPEDGGEDNAKTDEPKKEEAKPAEATEN

SEQ ID NO: 758 - DNA, 750 bp, Brassica napus
  CDS (1)..(750)
atggcggcgacactaggcagagagcagtacgtgtacatggcgaagctcgcggagcaggcggagcgttacgaggagatggtccagttcatggagcagctcgtcacatccgccgctccatcatcatcgaagctcaccgtggaggagcgcaacctcctctcggtggcctacaagaacgtgatcggatctctgcgcgcggcgtggaggatcgtgtcctccatcgagcagaaggaagagagcaggaagaacgaggagcacgcggggctcgtgaaggactacagatctaaggtggaggcggagctctcctcggtctgctccgggatcctcaggctactcgatgagcacctgatcccgtcggcggcggggagcgagtcgaaggtgttttacatgaagatgaagggagattaccataggtacatggcggagtttaagtctggtgaggagaggaaaggtgctgctgaagatactatggttgcttacaaggctgctcaggatattgcagcggctgatatggctcctactcatcccataaggcttgggcttgctctcaatttctctgtgttttattatgagatcctcaattcttccgacaaagcttgtaacatggccaaacaggcatttgaagaagcgatagctgagcttgacacactgggagaagaatcctacaaagacagcactctcattatgcagttgctcagggacaatcttaccctctggacctccgatatgcaggagcagatggacgaggcctga

SEQ ID NO: 759 - protein, 249 aa, Brassica napus
MAATLGREQYVYMAKLAEQAERYEEMVQFMEQLVTSAAPSSSKLTVEERNLLSVAYKNVIGSLRAAWRIVSSIEQKEESRKNEEHAGLVKDYRSKVEAELSSVCSGILRLLDEHLIPSAAGSESKVFYMKMKGDYHRYMAEFKSGEERKGAAEDTMVAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 760 - DNA, 753 bp, Brassica napus
  CDS (1)..(753)
atggcggcggcgacactaggcagagaccagtacgtctacatggcgaagctcgccgagcaagccgagcgttacgaggagatggtccaattcatggagcagctcgtcacaggcggcgccactccatcgtcagagctcaccgtggaggaaagaaacctcctctcggtagcctacaagaacgtgatcggatctctacgcgccgcgtggaggatcgtgtcgtcgatcgagcagaaggaagagagcaggaagaacgaggagcacgcgacgctcgtgaagggttacagatctaaggtggagacggagctttcctccgtctgcgaagggatactaaagcttcttgattcgcatctgattccctctgcggcggcgagcgagtcgaaggtgttttatttgaagatgaagggggattatcataggtacatggcggagtttaagtctggggatgagaggaaagtggctgctgaggatactatgggtgcttataaggcagctcaggatattgcggctgctgatatggcgcctactcatccaataaggcttggtcttgccttgaatttctcggtgttttactatgagattcttaattcttcagacaaagcttgtaacatggccaaacaggcttttgaagaagctatagctgagcttgacacattgggggaagaatcctacaaagacagcactctcattatgcagttgctcagggacaatcttaccctatggacctccgatatgcaggagcagatggacgaagcctga

SEQ ID NO: 761 - protein, 250 aa, Brassica napus
MAAATLGRDQYVYMAKLAEQAERYEEMVQFMEQLVTGGATPSSELTVEERNLLSVAYKNVIGSLRAAWRIVSSIEQKEESRKNEEHATLVKGYRSKVETELSSVCEGILKLLDSHLIPSAAASESKVFYLKMKGDYHRYMAEFKSGDERKVAAEDTMGAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 762 - DNA, 783 bp, Brassica napus
  CDS (1)..(783)
atggcggttccgtcgcgcgaggatcttgtatacatggctaagcttgcggagcaggcggagaggtacgaagagatggtccaatacatggagaaagtctccgccgcaacagatggtagcgagctcacaatcgaggagcgaaacctcctctccgtcgcctacaagaacctgatcggcgctcgccgcgcctcgtggagaatcatctcttcgatcgagcagaaagaggagagccgcggcaacgtcgagcgcgtcaaaacgatccgtgactacaaggctaagatcgaatcggagctctcggggatctgcgacggaatcctaaagctgctcgactctacgctcgtcccttccgctgcttctgaggaatccaaggtgttctacctcaagatgaaaggtgactactacaggtacttagccgagttcaaaatcggtaaagagagagacgccgccgcggataacaccctcgccgcttacgaatctgctcaggacaatgctaaggggcttgcttcaactcaccctatccgtcttggtttggctttgaacttctctgtgttctattacgagatccttgagtcccctgaccgtgcctgcaacctcgctaaaacggcttttgatgctgctattgctgagttagacactctaggggaagagtcatacaaggatagcactttgatcatgcagcttctccgtgacaacctcactctctggacatccgacatgcaggatgaatctgcagacgagatcaaggaagcagctgcagctccgaagccaacagaagagcagaagtga

SEQ ID NO: 763 - protein, 260 aa, Brassica napus
MAVPSREDLVYMAKLAEQAERYEEMVQYMEKVSAATDGSELTIEERNLLSVAYKNLIGARRASWRIISSIEQKEESRGNVERVKTIRDYKAKIESELSGICDGILKLLDSTLVPSAASEESKVFYLKMKGDYYRYLAEFKIGKERDAAADNTLAAYESAQDNAKGLASTHPIRLGLALNFSVFYYEILESPDRACNLAKTAFDAAIAELDTLGEESYKDSTLIMQLLRDNLTLWTSDMQDESADEIKEAAAAPKPTEEQK

SEQ ID NO: 764 - DNA, 753 bp, Brassica napus
  CDS (1)..(753)
atggcggcggcgacactaggcagagaccagtacgtgtacatggcgaagctcgccgagcaagccgagcgctacgaagaaatggtcaacttcatggaaagcctcgtcacaggcggcgccacttcatcctcagaactcaccgttgaagaacgaaacctcctctcggtagcctacaagaacgtgatcggatctctacgcgccgcgtggaggatcgtgtcgtcgatcgagcagaaggaagagagcaggaagaacgaggagcacgcgacgctcgtgaagggttacagatctaaggtcgagacggagctttcctccgtctgcgaagggattctaaagcttcttgattcgcatctgattccctcggcggcggcgagcgagtcgaaggtgttttatttgaagatgaagggggattatcataggtacatggcggagtttaagtctggagaggagaggaaagctgctgctgaggatactatgggtgcttataaggctgctcaggatatcgcggctgctgatatggcgcctactcatccaataaggcttggtcttgcgttgaatttctcggtgttttactatgagatccttaattcttcagacaaagcttgtaacatggccaaacaggcttttgaagaagcaatagctgagcttgacacattgggagaagaatcctacaaagacagcactctcattatgcagttgctcagggacaatcttaccctatggacctccgatatgcaggagcagatggacgaagcctga

SEQ ID NO: 765 - protein, 250 aa, Brassica napus
MAAATLGRDQYVYMAKLAEQAERYEEMVNFMESLVTGGATSSSELTVEERNLLSVAYKNVIGSLRAAWRIVSSIEQKEESRKNEEHATLVKGYRSKVETELSSVCEGILKLLDSHLIPSAAASESKVFYLKMKGDYHRYMAEFKSGEERKAAAEDTMGAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 766 - DNA, 804 bp, Brassica napus
  CDS (1)..(804)
atgtcgtcaggatccgacaaagacagagagacattcgtctacttggctaagctctccgaacaggccgagcgatacgacgagatggtggagacaatgaagaaagtggcgaaggtggacagcgagctgacagttgaggagaggaatctgttgtcggttggttacaagaacgtgatcggagcaagacgtgcctcgtggaggataatgtcgtctatcgagcagaaggaagagtccaaaggcaacgaatcaaacgtgaaacacatcaagggttatcgccaaaaggtagaagacgagcttgctgacatctgtaaagatattctcactatcattgatcagcatctcatccctcacgctacatcgggagaagctaccgttttctattacaagatgaaaggtgattattaccgttacttggctgagtttaagactgaacaagagaggaaggaagcttctgaacagtcgctcaaaggctatgaggctgcaacacaagctgcaagcactgaccttccttcgacccatccgattcgtcttggacttgctcttaacttctctgttttctactatgagatcatgaactctcctgaaagagcttgccatttggcgaagcaagcctttgacgaggccattgcggagttggatactctaagtgaggagtcatacaaggacagcactttgatcatgcagctcctgagagacaaccttaccctctggacttctgatcttcctgaagatggaggagaagacaacattaagaccgatgaagccaagcaagaaccggctaagcctgcagaagccactgagaactga

SEQ ID NO: 767 - protein, 267 aa, Brassica napus
MSSGSDKDRETFVYLAKLSEQAERYDEMVETMKKVAKVDSELTVEERNLLSVGYKNVIGARRASWRIMSSIEQKEESKGNESNVKHIKGYRQKVEDELADICKDILTIIDQHLIPHATSGEATVFYYKMKGDYYRYLAEFKTEQERKEASEQSLKGYEAATQAASTDLPSTHPIRLGLALNFSVFYYEIMNSPERACHLAKQAFDEAIAELDTLSEESYKDSTLIMQLLRDNLTLWTSDLPEDGGEDNIKTDEAKQEPAKPAEATEN

SEQ ID NO: 768 - DNA, 762 bp, Brassica napus
  CDS (1)..(762)
atggagagtgagagggaaaagcaggtttactcggcgaagctctctgagcaaaccgaacgttacgatgaaatggttgaggcgatgaagaaagttgctcagatggatgtggagctcaccgtggaggagaggaaccttgtatctgttggttacaagaacgtcatcggcgcgaggagagcgtcgtggaggatactatcctccatcgagcagaaggaagagtccaaggggaacgaggagaatgtcaagaggattcagacttaccgaaagagggttgaagaggagcttgccaaagtttgcaatgacatcttgtccgtcattgataagcatctcattccttcctctaccgccgtggagtccactgtctttttctacaaaatgaaaggagattactatcgctatctggcagagttcagctctggtgctgagcgcaaggaagctgcagatcagtctcttgaagcctacaaggctgctgttgctgctgcagagactggattggcaccaacacatccagttagacttggcttggctttgaacttttcggttttctattatgagatcttaaactctcctgaaagcgcatgccaattggctaagcaagcattcgacgatgcaatcgctgaacttgacagcctcaacgaggagtcatacaaggacagcactcttatcatgcagctactcagagacaacctcaccttgtggacttctgacctccccgaggaaggagaagagaaatccaaaggtgatgagcctaaagaagagaactga

SEQ ID NO: 769 - protein, 253 aa, Brassica napus
MESEREKQVYSAKLSEQTERYDEMVEAMKKVAQMDVELTVEERNLVSVGYKNVIGARRASWRILSSIEQKEESKGNEENVKRIQTYRKRVEEELAKVCNDILSVIDKHLIPSSTAVESTVFFYKMKGDYYRYLAEFSSGAERKEAADQSLEAYKAAVAAAETGLAPTHPVRLGLALNFSVFYYEILNSPESACQLAKQAFDDAIAELDSLNEESYKDSTLIMQLLRDNLTLWTSDLPEEGEEKSKGDEPKEEN

SEQ ID NO: 770 - DNA, 762 bp, Brassica napus
  CDS (1)..(762)
atggagactgagagggaaaagcatgtttacttggccaagctctctgagcaaaccgagcgatacgatgagatggttgaggcgatgaagaaagtagctcagcttgatgtggagctcacggtagaggagaggaaccttgtgtctgtgggttacaagaacgtgattggggcaaggagagcttcgtggagaatactatcatccatcgagcagaaggaagagtccaaggggaacgaggagaatgtcaagaggattcagaactatcgaaagaaagttgaagacgagcttgctaaagtttgtaatgacatcttgtctgtcatcgataaacatctcattccgtcgtctactgctgtggagtccactgtgtttttctacaaaatgaaaggagattattatcgatatctggcagagttcagttctggtgctgaacgcaaggaagccgcagatcagtctcttgaggcatataaggctgctgttgctgctgcggagactggattggcaccaacacatccagttagactcggcttggcgttgaacttttctgttttctactatgagatcttaaactctcctgaaagcgcatgtcaattggctaagcaagcattcgacgatgcaatagctgaacttgacagcctgaacgaggaatcatacaaggacagcactcttatcatgcagctacttagagacaatctcaccttgtggacttcagaccttcctgaggaaggagacgagcgagccaaaggtgatgagcctcaggaagagaactga

SEQ ID NO: 771 - protein, 253 aa, Brassica napus
METEREKHVYLAKLSEQTERYDEMVEAMKKVAQLDVELTVEERNLVSVGYKNVIGARRASWRILSSIEQKEESKGNEENVKRIQNYRKKVEDELAKVCNDILSVIDKHLIPSSTAVESTVFFYKMKGDYYRYLAEFSSGAERKEAADQSLEAYKAAVAAAETGLAPTHPVRLGLALNFSVFYYEILNSPESACQLAKQAFDDAIAELDSLNEESYKDSTLIMQLLRDNLTLWTSDLPEEGDERAKGDEPQEEN

SEQ ID NO: 772 - DNA, 747 bp, Brassica napus
  CDS (1)..(747)
atggcggcaacactaggcagagaccagtacgtctacatggccaagctcgccgagcaagccgagcgctacgaggagatggtcaacttcatggagaagctcgtcacaggcgcaacaccatcctccgaactcaccgtcgaagaacgtaacctcctctccgtggcttacaagaacgtgatcggatccctgcgcgccgcgtggcgcatcgtgtcctcgatcgagcagaaggaagagagcaggaagaacgaggaacacgtggcgctcgtgaaggactacagatctaaagtggagacggagctctcctccgtctgcgaagggatactaaagcttctcgaggagaatctgattccctctgcggcggcgagcgagtcgaaggtgttttatctgaagatgaagggggattaccatcggtacatggcggagtttaaggccggtgaggagaggaaagcggcggcggaggatactatggttgcttacaaggctgctcaggatattgcagctgctgatatggcgcctactcatccgattaggcttggtttggcgttgaatttctcggtgttttactatgagattcttaattcttcggacaaagcttgtgacatggccaaacaggcttttgaagaagccatagctgagcttgacactcttggagaagagtcgtacaaagacagcactctcattatgcagctgctcagggacaatcttaccctctggacctctgatatgcaggagcagatggacgaggcatga

SEQ ID NO: 773 - protein, 248 aa, Brassica napus
MAATLGRDQYVYMAKLAEQAERYEEMVNFMEKLVTGATPSSELTVEERNLLSVAYKNVIGSLRAAWRIVSSIEQKEESRKNEEHVALVKDYRSKVETELSSVCEGILKLLEENLIPSAAASESKVFYLKMKGDYHRYMAEFKAGEERKAAAEDTMVAYKAAQDIAAADMAPTHPIRLGLALNFSVFYYEILNSSDKACDMAKQAFEEAIAELDTLGEESYKDSTLIMQLLRDNLTLWTSDMQEQMDEA

SEQ ID NO: 774 - DNA, 747 bp, Brassica napus
  CDS (1)..(747)
atggcggcgacgttgagcagagaccaatacgtgtacatggcgaagctggccgagcaagcggagcgatacgaggagatggtccagttcatggagagcctggtaagctccgccacgccggcgggggagctgacggtggaggagaggaacctcctctcggtggcgtacaagaacgtgatcggatctctcagagcggcgtggaggatcgtgtcatcgatcgagcagaaggaagagagcaggaagaacgaggagcacgtgtcgctcgtgaaggattacagatccaaggtggagggggagctctcgacgatctgctcggggatcctcaagctgctcgatacgcatctgatcccttcggctacggctagcgagtcgaaggtgttttacctgaagatgaagggggattaccatcgctacatggccgagttcaaatctggagatgagaggaagactgctgccgaagataccatgatcgcctacaaggctgctcaggatgttgcggttactgatctagcgcctacgcatccgatcaggctgggtctggctctcaatttctcggtgttttactacgagattctcaactcttctgagaaagcttgtagcatggccaaacaggctttcgaggaagccattgctgagctggacacgttgggagaggagtcgtacaaggacagtactctcatcatgcagttgctaagggacaacctaaccctctggacctccgacatgcaggagcagatggatgaggcctga

SEQ ID NO: 775 - protein, 248 aa, Brassica napus
MAATLSRDQYVYMAKLAEQAERYEEMVQFMESLVSSATPAGELTVEERNLLSVAYKNVIGSLRAAWRIVSSIEQKEESRKNEEHVSLVKDYRSKVEGELSTICSGILKLLDTHLIPSATASESKVFYLKMKGDYHRYMAEFKSGDERKTAAEDTMIAYKAAQDVAVTDLAPTHPIRLGLALNFSVFYYEILNSSEKACSMAKQAFEEAIAELDTLGEESYKDSTLIMQLLRDNLTLWTSDMQEQMDEA

SEQ ID NO: 776 - DNA, 747 bp, Brassica napus
  CDS (1)..(747)
atggcggcgacgatgagcagagaccaatacgtctacatggcgaaactcgccgagcaagcggagcgttacgaagagatggtccagttcatggaaagcctcgtgacttcctccacaccgtccagcgagctcaccgtagaggagaggaaccttctctccgtggcttacaagaacgtgatcggatctcttcgagcggcgtggaggatcgtgtcgtcgatcgagcagaaggaagagagcaggaagaacgaggaacacgtgtcgctcgtcaaggactacagatctaaggtcgagacggagctctccacgatctgcacggggatcctcaggctgctcgatacgaatctgatcccttcggctaacgctagcgagtccaaggtgttttacttgaagatgaagggtgattaccatcggtacatggctgagttcaaatctggtgacgagaggaagacagctgctgaagatactatgatcgcttacaaggctgctcaggacgttgcggttgctgatctagcgcctacgcatccgatcaggctgggactggctcttaacttctcggtgttttactacgagatcctcaactcttcggagaaagcttgtagcatggccaaacaggcttttgaggaagctattgcggagctggacacgttgggagaggagtcatacaaagacagtactctcatcatgcagttgctaagggacaatttaaccctctggacttccgatatgcaggagcagatggatgaggcctga

SEQ ID NO: 777 - protein, 248 aa, Brassica napus
MAATMSRDQYVYMAKLAEQAERYEEMVQFMESLVTSSTPSSELTVEERNLLSVAYKNVIGSLRAAWRIVSSIEQKEESRKNEEHVSLVKDYRSKVETELSTICTGILRLLDTNLIPSANASESKVFYLKMKGDYHRYMAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 778 - DNA, 741 bp, Brassica napus
  CDS (1)..(741)
atggcggcgacgatgagcagagaccaatacgtctacatggcgaaactcgccgagcaagcggagcgttacgaagagatggtccagttcatggaaagcctcgtgacttcctccacaccgtccagcgagctcaccgtagaggagaggaaccttctctccgtggcttacaagaacgtgatcggatctcttcgagcggcgtggaggatcgtgtcgtcgatcgagcagaaggaagagagcaggaagaacgaggaacacgtgtcgctcgtcaaggactacagatctaaggtcgagacggagctctccacgatctgcacggggatcctcaggctgctcgatacgaatctgatcccttcggctaacgctagcgagtccaaggtgttttacttgaagatgaagggtgattaccatcggtacatggctgagttcaaatctggtgacgagaggaagacagctgctgaagatactatgatcgcttacaaggctgctcaggacgttgcggttgctgatctagcgcctacgcatccgatcaggctgggactggctcttaacttctcggtgttttactacgagatcctcaactcttcggagaaagcttgtagcatggccaaacaggcttttgaggaagctattgcggagctggacacgttgggagaggagtcatacaaagacagtactctcatcatgcagttgctaagggacaatttaaccctctggacttccgatatgcagatggatgaggcctga

SEQ ID NO: 779 - protein, 246 aa, Brassica napus
MAATMSRDQYVYMAKLAEQAERYEEMVQFMESLVTSSTPSSELTVEERNLLSVAYKNVIGSLRAAWRIVSSIEQKEESRKNEEHVSLVKDYRSKVETELSTICTGILRLLDTNLIPSANASESKVFYLKMKGDYHRYMAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQMDEA

SEQ ID NO: 780 - DNA, 798 bp, Brassica napus
  CDS (1)..(798)
atggcggcagcatcatcctcggcgagggaagagttcgtatacctagcgaagctcgcggagcaagcggagcgatatgaagagatggttgaattcatggaaaaagtcgtcgaaggcgtggagaaagacgaactcagtgtggaggaacgaaacctcctctccgtggcttacaaaaacgtaatcggcgctcgtcgagcctcgtggcgcatcatctcctccatcgaacagaaggaagagagccgggggaacgatgaccacgtcaccacgatccgtgactacagaagcaagatcgagtctgagctctccaaaatctgcgacggcatccttaagctgctcgatacaagactcattccggcttctgcaaacggagattccaaggttttctaccttaagatgaagggagattaccataggtacttggctgagtttaagaccgctcaggagaggaaagacgccgccgagcataccctcaccgcttacaaagccgctcaggacattgctaactctgaattgcctccaacacaccccatccgtctgggtctggctttgaacttctctgtcttttactacgagattctcaactctccagaccgtgcttgcagtctcgctaagcaggcatttgatgaagcaatcgctgagttggatactctaggcgaggagtcatacaaggacagtactttgatcatgcagcttctccgtgacaaccttactctatggacttctgacatgcaggacgaaggtacagaggagatcaaagaagcggcagcaacaaagcctgctgaagaagagaaggagacttga

SEQ ID NO: 781 - protein, 265 aa, Brassica napus
MAAASSSAREEFVYLAKLAEQAERYEEMVEFMEKVVEGVEKDELSVEERNLLSVAYKNVIGARRASWRIISSIEQKEESRGNDDHVTTIRDYRSKIESELSKICDGILKLLDTRLIPASANGDSKVFYLKMKGDYHRYLAEFKTAQERKDAAEHTLTAYKAAQDIANSELPPTHPIRLGLALNFSVFYYEILNSPDRACSLAKQAFDEAIAELDTLGEESYKDSTLIMQLLRDNLTLWTSDMQDEGTEEIKEAAATKPAEEEKET

SEQ ID NO: 782 - DNA, 786 bp, Brassica napus
  CDS (1)..(786)
atgtcgtctactcgggaagagaatgtgtacttggctaagttagccgaacaagccgaacgttacgaggagatggttgagttcatggagaaagtcgccaagactgttgactccgaggagcttactgtggaagagaggaacctcttgtccgttgcttacaagaacgtgattggtgcaaggagagcttcgtggaggatcatttcttccattgaacagaaggaagaaagcagagggaacgatgatcacgttgctcttatcaaggactacagagtgaagattgaaaccgagctcgggaagatctgtgatgggattttgaaccttttggattctcaccttgttcccgctgcctctttggctgagtccaaagtgttttacctgaagatgaagggagattatcataggtaccttgctgagttcaagactggtgctgagaggaaggatgctgctgagagcactctcttggcttacaagtcagctcaggatattgcacttgctgatttacctccaactcatccgattagattgggacttgctcttaacttctctgtcttctactatgagattctcaactctcctgatcgcgcttgcagtctcgccaagcaggcatttgatgaagctatctctgagctggacacattaggagaagaatcatacaaagacagcacgctgataatgcaacttctccgtgacaatctgactctctggacttctgacctcaatgatgaggtgggtggtgacgagatcaaggaggcgtcaaaagacgagcctgaagaagggaaacaagcgtag

SEQ ID NO: 783 - protein, 261 aa, Brassica napus
MSSTREENVYLAKLAEQAERYEEMVEFMEKVAKTVDSEELTVEERNLLSVAYKNVIGARRASWRIISSIEQKEESRGNDDHVALIKDYRVKIETELGKICDGILNLLDSHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDLNDEVGGDEIKEASKDEPEEGKQA

SEQ ID NO: 784 - DNA, 786 bp, Brassica napus
  CDS (1)..(786)
atggcctctgccagagaagagttcgtttaccttgcgaagcttgcggagcaagcagagcgatatgaagaaatggttgaattcatggagaaagtcacagaagccgtcgacaaagacgaactcaccgtggaggaacgcaacctcctctccgttgcttacaaaaacgtaatcggcgctcgtcgtgcctcgtggcgcatcatctcctccatcgagcagaaggaagagagccgcggcaacgatgaccacgtcaacacgatccgtgactacagaagcaagatcgaaacggagctctccaaaatctgcgacggtatccttaagcttctggatacgagacttatcccggcttctgcaaacggagattccaaggttttctaccttaagatgaagggagattaccataggtacttggctgagtttaagaccgctcaggagaggaaagacgccgccgagcacaccctcaccgcttacaaagccgctcaggacatcgctaactccgaattggctccaacccacccgatccgtcttggtctggccttgaacttctctgtcttttactatgagattctcaactctccagaccgtgcttgcagtctcgctaagcaggcgtttgatgaagcaattgctgagttggatactctaggcgaggagtcatacaaggacagtaccttgatcatgcagcttctccgtgacaaccttactctctggacttccgacatgcaggacgaaagtactgaggagatcaaagaagatgcagcacccaagcctgctgaagaacagaaggagacctaa

SEQ ID NO: 785 - protein, 261 aa, Brassica napus
MASAREEFVYLAKLAEQAERYEEMVEFMEKVTEAVDKDELTVEERNLLSVAYKNVIGARRASWRIISSIEQKEESRGNDDHVNTIRDYRSKIETELSKICDGILKLLDTRLIPASANGDSKVFYLKMKGDYHRYLAEFKTAQERKDAAEHTLTAYKAAQDIANSELAPTHPIRLGLALNFSVFYYEILNSPDRACSLAKQAFDEAIAELDTLGEESYKDSTLIMQLLRDNLTLWTSDMQDESTEEIKEDAAPKPAEEQKET

SEQ ID NO: 786 - DNA, 789 bp, Glycine max
  CDS (1)..(789)
atggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaa

SEQ ID NO: 787 - protein, 262 aa, Glycine max
MAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 788 - DNA, 786 bp, Triticum aestivum
  CDS (1)..(786)
atgtctaccgctgaggcaacccgtgaggagaatgtgtacatggccaagcttgccgagcaggctgagcgttacgaagaaatggttgagttcatggagaaggtggcaaagaccgctgatgttggtgagctcactgttgaggagcgcaacctgctctctgttgcttacaagaatgtgattggtgcccggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtccaaggtgttctatctgaaaatgaagggtgactaccacaggtaccttgcggagttcaaggcaggcgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaaggacagcaccttgatcatgcaacttcttcgtgacaacttgactctctggacctccgataacgcagaggagggtggtgatgagatcaaggaagccgcctcaaagcctgagggagaggggcactga

SEQ ID NO: 789 - protein, 261 aa, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 790 - DNA, 786 bp, Triticum aestivum
  CDS (1)..(786)
atggcaaaggcagcggcagcgggaacgagggaggagatggtctacatggcgaagctggcggagcaggccgagcggtacgaggagatggtcgagttcatggagaaggtcgtggcggcggcggggaccggcgagctcaccgtcgaggagaggaacctgctctcagtcgcgtacaagaacgtcatcggggcgcgtcgtgcttcctggcgcatcgtgtcctccatcgagcagaaggaggaagggcgcggagcggcggggcacgccgccgcggcgcgcgggtaccgcgcacttgtcgaggccgagctctccaacatctgcgcggggatcctccgtctcctcgacgaacgcctagtccccgccgccgccgccatcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgcgaaacaggccttcgatgaagccatcgctgagctggattccctcggagaagattcctacaaggacagcaccctgatcatgcaacttctccgtgacaatctcaccttgtggacctctgatatgcaggatgacgctggcgatgaaatgagggattcaagcaagcctgaggatgagcagtag

SEQ ID NO: 791 - protein, 261 aa, Triticum aestivum
MAKAAAAGTREEMVYMAKLAEQAERYEEMVEFMEKVVAAAGTGELTVEERNLLSVAYKNVIGARRASWRIVSSIEQKEEGRGAAGHAAAARGYRALVEAELSNICAGILRLLDERLVPAAAAIDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 792 - DNA, 801 bp, Triticum aestivum
  CDS (1)..(801)
atgtcgccggcggagcagacgcgagacgagagcgtctacatggccaagcttgcggagcaggccgagcgctacgaggagatggtggagttcatggagcgcgtcgcgaaggccaccggcggggcagggcccggggaggagctatccgtcgaggagcgcaacctgctctctgtggcttacaagaatgtcatcggggcccggcgcgcgtcctggaggatcatctcctccatcgagcagaaggaggaaggtcggggcaacgacgcgcacgccgctaccatccgctcctaccgcagcaagatcgaggccgagctcgcaaagatctgtgacggcatcctcgccctgcttgattcccacctcgtgccatccgccggagctgccgagtccaaagtcttctatctcaagatgaagggcgactaccacaggtaccttgcagagtttaagtctggtggggagaggaaggaagccgccgagagcaccatgaacgcgtacaaagctgctcaggatatcgccctagtagatttggctccaacacaccccatcaggcttgggcttgcactcaacttttctgtgttctactatgagatcttgaactcccctgaccgtgcctgcaaccttgcaaaacaagcctttgacgaggctatatcagagctggacagtttaggcgaggaatcctacaaggacagcactttaatcatgcagctcctgcgtgacaatttgactctatggacatccgacaccaatgaggatgacgttgatgagattaaggaagccccagctccaaaagaatctggagacggacagtga

SEQ ID NO: 793 - protein, 266 aa, Triticum aestivum
MSPAEQTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGGERKEAAESTMNAYKAAQDIALVDLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 794 - DNA, 822 bp, Triticum aestivum
  CDS (1)..(822)
atggccactgagcgtgaaagcaagaccttcctcgcccgcctttgcgagcaggctgagcgctacgatgagatggtcacctacatgaaggaggtggccaagctgggtggagagctcaccgttgacgagcgtaaccttctcagcgttgcctacaagaacgttgtcggtacccgacgtgcctcgtggcgcattatctcctcgatcgagcagaaggaggagtctaagggatccgacaagcacgtttcaaccatcaaggactaccgcaacaagatcgagaccgagctcgagaaggtctgccaggatgtcctcgacgttttggacgacttccttatccccaacgctgccactggcgagtccaaggtcttctaccacaagatgaagggtgactaccaccgttacctcgctgagttcgcctctggtgagaagcgcaagggtgctgccaccgctgcccacgatgcttacaagagcgctaccgatgttgctcagactgagctcactcctactcaccccatccgtctgggtcttgccctcaacttctccgtcttctactacgagatcttgaactcccccgaccgtgcttgccacctcgcgaagcaggccttcgacgatgctattgccgagctcgactccctgtctgaggagtcttaccgtgacagcaccctcatcatgcagcttctccgcgacaaccttaccctctggacctcttccgacagcgccgagggtgaggctgccggtgctgctgatgctcccaagaaggaggagggcgaggctgccaagcccgccgaggaggctgctgaggagcccgcgcctgctcctgcctcctaa

SEQ ID NO: 795 - protein, 273 aa, Triticum aestivum
MATERESKTFLARLCEQAERYDEMVTYMKEVAKLGGELTVDERNLLSVAYKNVVGTRRASWRIISSIEQKEESKGSDKHVSTIKDYRNKIETELEKVCQDVLDVLDDFLIPNAATGESKVFYHKMKGDYHRYLAEFASGEKRKGAATAAHDAYKSATDVAQTELTPTHPIRLGLALNFSVFYYEILNSPDRACHLAKQAFDDAIAELDSLSEESYRDSTLIMQLLRDNLTLWTSSDSAEGEAAGAADAPKKEEGEAAKPAEEAAEEPAPAPAS

SEQ ID NO: 796 - DNA, 771 bp, Zea mays
  CDS (1)..(771)
atggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaa

SEQ ID NO: 797 - protein, 256 aa, Zea mays
MAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 798 - DNA, 786 bp, Glycine max
  CDS (1)..(786)
atggctgcctccaaggatcgcgagaacttcgtctacatcgccaagctcgccgaacaggccgagcgatacgaagagatggtggaatcaatgaagaacgttgcgaatctcgacgttgaactgactgtggaggagcggaatttactttctgttgggtacaagaatgtgattggtgctcggagagcatcgtggaggatcctgtcttccattgagcaaaaggaagaaacaaaagggaacgagttgaatgcgaagcggattaaggagtacaggcagaaggttgaattggagctttcaaacatctgtaatgatgttatgacagtgattgatgagcaccttatcccttcggctgcagctggtgaatccactgtgttttactataagatgaaaggagattattatcgttatcttgccgaatttaaggcaggcaatgagaagaaggaagctgctgatcagtctatgaaagcatatgagtctgctaccactgcagcagaggctgatttacctccaacacatcccatccgattgggtctagctttaaatttctcagttttctattacgagatcttgaactctccagaaagagcctgtcatcttgcaaaacaagcttttgatgaagctatttctgagcttgacaccttgaatgaggagtcatacaaagacagcaccttaatcatgcaacttctcagggacaacctaactttgtggacttctgacatcccagaagatggagaagatgcccagaaagtgaatggcactgccaagcttggtggaggtgaggaggcagagtga

SEQ ID NO: 799 - protein, 261 aa, Glycine max
MAASKDRENFVYIAKLAEQAERYEEMVESMKNVANLDVELTVEERNLLSVGYKNVIGARRASWRILSSIEQKEETKGNELNAKRIKEYRQKVELELSNICNDVMTVIDEHLIPSAAAGESTVFYYKMKGDYYRYLAEFKAGNEKKEAADQSMKAYESATTAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEEAE

SEQ ID NO: 800 - DNA, 774 bp, Glycine max
  CDS (1)..(774)
atggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgcggacatcagacatcacggacgatgctggagatgagatcaaggaaacatctaagcaacaaccaggcgaatag

SEQ ID NO: 801 - protein, 257 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLRTSDITDDAGDEIKETSKQQPGE

SEQ ID NO: 802 - DNA, 756 bp, Linum usitatissimum
  CDS (1)..(756)
atggctgcactacccgacaacttcaccagagaccagtacgtctacctcgccaagctcgccgagcaagccgagcgctatgaggaaatggtccagttcatgcaaaagcttgttctcgcctccactcccgccgcagaactcaccgttgaggagcgtaacctcctttccgtcgcctacaagaacgttatcggctccctccgcgccgcctggaggatcgtctcctcgatcgagcaaaaagaggaagggaggaagaacgaggagcacgtggtgctcgtcaaggattacagatctaaagtggagaacgagctctctgagatctgcgctagtattctccgtctactcgactcgaatctggttccgtctgccacctctagtgagtccaaggtgttttacttgaagatgaagggagactaccacaggtatttggccgaattcaaggttggcgatgagaggaagaccgctgctgaggatactatgctggcttataaggttgctcaggaaactgctgctgcggatcttgccccgacgcatcctattaggttgggtctggctctcaatttctcggtgttttacttcgagatcctcaaccagtctgacaaagcttgcagtatggctaaacaggcctttgaggaagcgatcgctgagatagatacattgggtgaagaatcatacaaagatagtaccctgatcatgcaactcctacgggacaacctcactctttggacatcagatgtccaggaacaattggatgagccctag

SEQ ID NO: 803 - protein, 251 aa, Linum usitatissimum
MAALPDNFTRDQYVYLAKLAEQAERYEEMVQFMQKLVLASTPAAELTVEERNLLSVAYKNVIGSLRAAWRIVSSIEQKEEGRKNEEHVVLVKDYRSKVENELSEICASILRLLDSNLVPSATSSESKVFYLKMKGDYHRYLAEFKVGDERKTAAEDTMLAYKVAQETAAADLAPTHPIRLGLALNFSVFYFEILNQSDKACSMAKQAFEEAIAEIDTLGEESYKDSTLIMQLLRDNLTLWTSDVQEQLDEP

SEQ ID NO: 804 - DNA, 777 bp, Linum usitatissimum
  CDS (1)..(777)
atggctgaaagagacaagttcatctacactgccaagctcgccgagcaggctgagcgctatgacgagatggtggaagcgatgaagaatgttgccaagtgtggcgtggagttgactgtggaagagaggaacctgctgtcagtcggctacaagaatgtgatcggggcgaagcgagcttcgtggaggattctgtcctcgattgagcagaaggaagagagtaggggaaatgaagtgaatgctaagcggatcaaagaatacaggcacaaggtcgaaactgagctgactgatatttgcaacgatgtaatggttgtgatcgatgagcatctcattcctgctgctcctactggagagtcggccatcttctactataagatgaagggagattattaccggtatcttgctgagtttaagagtggtaacgagaagaaggaagctggcgataattcaatgaaagcatatgagaaagctactagtttggcagaggctgatttggctcctacgcacccaattagattgggcttggcactgaatttctcagtcttctattatgagatactgaattcacctgaaagggcctgccaccttgcgaaacaggctttcgatgaagctatctcggaactcgactctttgaacgaggattcatacaaggacagcactttgattatgcagcttctcagggacaacttaaccttgtggacttctgacatacccgaggatggagaagatgcccagaagatcaatggcactgccaaaggcatgggggccgaagatgaagagtga

SEQ ID NO: 805 - protein, 258 aa, Linum usitatissimum
MAERDKFIYTAKLAEQAERYDEMVEAMKNVAKCGVELTVEERNLLSVGYKNVIGAKRASWRILSSIEQKEESRGNEVNAKRIKEYRHKVETELTDICNDVMVVIDEHLIPAAPTGESAIFYYKMKGDYYRYLAEFKSGNEKKEAGDNSMKAYEKATSLAEADLAPTHPIRLGLALNFSVFYYEILNSPERACHLAKQAFDEAISELDSLNEDSYKDSTLIMQLLRDNLTLWTSDIPEDGEDAQKINGTAKGMGAEDEE

SEQ ID NO: 806 - DNA, 792 bp, Linum usitatissimum
  CDS (1)..(792)
atgtcgccgtctgaagcttcccgcgaggacaatgtctacatggcaaagttggccgagcaggctgaacgttacgaggaaatggttgagtttatggagaaagttgccaagacagttgacgttgaggagctaaccgtggaggaaaggaacctactttctgtggcttacaagaacgtgattggggccagaagagcttcatggagaattatctcttccatcgagcagaaagaagaaagcaggggaaatgaggaccatgtttctattatcaaggagtacaggtccaagattgaaactgagttgagcaagatttgtgatggcatcctgaaccttcttgagtctcatctcattcctgctacctccgccgctgagtctaaggtcttttaccttaaaatgaagggtgactaccataggtatcttgcagagtttaaaactggagctgagaggaaggaagctgctgagagcaccttgttggcttacaagtccgctcaggatattgcccttgctgatttggctcctacacacccaatccgtttgggactggcgcttaacttctccgttttctactatgagatcctcaactcgcctgatcgggcatgcaatcttgcaaaacaggcttttgatgaggccatctccgagctggacacactaggggaagaatcatacaaggacagcacattgatcatgcaattgctccgtgacaatttgacactgtggacttctgatatcactgatgatgctggagatgagatcaaggaagcatcaacgaagcgtgattcaggagagggacaacaatag

SEQ ID NO: 807 - protein, 263 aa, Linum usitatissimum
MSPSEASREDNVYMAKLAEQAERYEEMVEFMEKVAKTVDVEELTVEERNLLSVAYKNVIGARRASWRIISSIEQKEESRGNEDHVSIIKEYRSKIETELSKICDGILNLLESHLIPATSAAESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKEASTKRDSGEGQQ

SEQ ID NO: 808 - DNA, 771 bp, Zea mays
  CDS (1)..(771)
atgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccacccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaa

SEQ ID NO: 809 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 810 - DNA, 786 bp, Zea mays
  CDS (1)..(786)
atggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccactgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaa

SEQ ID NO: 811 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDATENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 812 - DNA, 801 bp, Zea mays
  CDS (1)..(801)
atgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctatccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgagaccgagctcgcccgcatctgcgatggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgctgccccgaaagaatccgcggagggtcagtaa

SEQ ID NO: 813 - protein, 266 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 814 - DNA, 759 bp, Zea mays
  CDS (1)..(759)
atgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgccttcaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctcgaagggcgatgctggtgagggtcagtag

SEQ ID NO: 815 - protein, 252 aa, Zea mays
MSREENVYMAKLAEQAERYEEMVEYMEKVAKTTDVQELTVEERNLLSVAFKNVIAAPRASWRIISSIEQKEESRKNEEHVAQIKEYRGKIEAELSNICDGILKLLDTHLVPSSTATESKVFYLKMKGDYHRYLAEFKTGAERKESAESTMVAYKAAQDIALAELPPIHPIRLGLALNFSVFYYEIQNSPDKACNLAKEAFDEAISQLDMLGEDSYKDSNLIMQLLRDNLTLWTEDGIEEGLESSKGDAGEGQ

SEQ ID NO: 816 - DNA, 786 bp, Zea mays
  CDS (1)..(786)
atggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtctcctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaa

SEQ ID NO: 817 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVSYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 818 - DNA, 807 bp, Hordeum vulgare
  CDS (1)..(807)
atgggctacgaagattctgtttatctcgcaaagcttgctgagcaagccgagcgttatgaggaaatggtagagaacatgaagcaggtagcttccgaagaccaagagctttcagtcgaagaacgaaacctactttctgtggcatacaaaaatgttatcggtgcccgtcgtgcttcatggagaatcgtcacatctattgaacagaaagaggaatctaagggaaactcttctcaggttggtctgattaaagattaccgtcagaagatcgaggcagaacttgccaagatttgcgaggacattctcgaagttctcaacaaacatctgattccttctgcgaaaagtggagagtccaaggttttttatcacaaaatgaaaggagattaccaccgttatcttgccgaatttgctgttggtgataagaggaaagaatctgctgatatgtcccttgaggcatacaaaaatgcaaccgaagttgcccaaactgatctcgcaccgactcaccccattcgtcttggacttgcccttaacttttcagtattttactatgaaatactcaattctcctgatcaagcctgccatctcgctaagcaggcatttgatgatgcaattgcagagcttgataccctcagcgaagaaagttacaaggactctactctcattatgcaactcttgagagacaacctgaccctctggacttcatcggaggccgagtcagctaccgctgaccaggcagccaccacaaatgttcctgacatgaaggaaagcgaagctgtaaccaaagaaacagcaactgaagcaactgcagagtag

SEQ ID NO: 819 - protein, 268 aa, Hordeum vulgare
MGYEDSVYLAKLAEQAERYEEMVENMKQVASEDQELSVEERNLLSVAYKNVIGARRASWRIVTSIEQKEESKGNSSQVGLIKDYRQKIEAELAKICEDILEVLNKHLIPSAKSGESKVFYHKMKGDYHRYLAEFAVGDKRKESADMSLEAYKNATEVAQTDLAPTHPIRLGLALNFSVFYYEILNSPDQACHLAKQAFDDAIAELDTLSEESYKDSTLIMQLLRDNLTLWTSSEAESATADQAATTNVPDMKESEAVTKETATEATAE

SEQ ID NO: 820 - DNA, 771 bp, Helianthus annuus
  CDS (1)..(771)
atggcttcttcaaccgaacgtgacaacttcatctatgtcgccaagcttgctgagcaagccgaacgttacgacgaaatggtggatgctatgaagaaggtagcaaagttggatgtggaactgactgttgaagagagaaacttgctttcagttgggtacaagaatgtggttggttctcgtagggcgtcatggagaatattgtcctcaatcgagcagaaagaggaatcaagaggcaatgaagtgagcgtaaatcggatcaaggaatacaggcagaaggttgaaaaagaattgaccgacatttgtaatgatatcatggttgtgattgatgaacatctgattccatcttcatcggctggagaatctactgttttctactacaaaatgaaaggagattattataggtatcttgcagagttcaagactggcgatgataagaaagaggcagctgatcagtctctgaaggcttatcaattggcttccacctcagcggaagctgaattatcctctactcacccgatcaggttgggtttggctttgaacttctctgtgttctattatgagatcatgaactctcctgaaagggcttgtcaccttgcaaaacaagcttttgatgaagctatctcagagcttgattccttgagcgaggaatcgtacaaagatagcactttaattatgcagctcttgagggacaacctcactttgtggacttccgacattccagaggatggagaagatgaaaagatggagatcaccaaatctggtgcggaagagtaa

SEQ ID NO: 821 - protein, 256 aa, Helianthus annuus
MASSTERDNFIYVAKLAEQAERYDEMVDAMKKVAKLDVELTVEERNLLSVGYKNVVGSRRASWRILSSIEQKEESRGNEVSVNRIKEYRQKVEKELTDICNDIMVVIDEHLIPSSSAGESTVFYYKMKGDYYRYLAEFKTGDDKKEAADQSLKAYQLASTSAEAELSSTHPIRLGLALNFSVFYYEIMNSPERACHLAKQAFDEAISELDSLSEESYKDSTLIMQLLRDNLTLWTSDIPEDGEDEKMEITKSGAEE

SEQ ID NO: 822 - DNA, 783 bp, Helianthus annuus
  CDS (1)..(783)
atgtcgttaccggcgcgcgaacagcacgtctacatggcgaaactcgccgaacaagccgaacgctacgacgaaatggtcgaattcatggaaaaagtgtccgaaaccgacgaactcacagtcgaagaacgaaacctgctctcggtggcgtacaagaacgtgatcggggctcgtagggcgtcgtggaggatcatatcgtcgatcgagcagaaagaggagtcgcgagggaatgaggatcatgtgaaggtgatcaaggagtatagagcgaagatcgaagcggagcttactagggtttgtgaggggattttgaagctgctggactcgagattgattccgaaggcgagtacgggtgattcgaaggtgttttatttgaagatgaagggggattatcatcggtatcttgctgagtttaagactgctggtgaaaggaaagatgctgctgagagtactcttactgcttataagtctgctcaggatatagcaaacagtgaacttgcaccaacacaccctattcgccttggactggctctcaatttctctgtgttttactatgagattttgaactctcctgaccgagcttgtagccttgccaaacaggcttttgatgaagcaattgctgagttggataccttgggtgaggagtcctacaaagatagcaccttgatcatgcaactccttcgtgacaacctcactctgtggacctctgatatgcaggaggatggaggtgatgaaattaaggaagctgctgctggtggaaagcaaagtgaggagcaaccaccacagtga

SEQ ID NO: 823 - protein, 260 aa, Helianthus annuus
MSLPAREQHVYMAKLAEQAERYDEMVEFMEKVSETDELTVEERNLLSVAYKNVIGARRASWRIISSIEQKEESRGNEDHVKVIKEYRAKIEAELTRVCEGILKLLDSRLIPKASTGDSKVFYLKMKGDYHRYLAEFKTAGERKDAAESTLTAYKSAQDIANSELAPTHPIRLGLALNFSVFYYEILNSPDRACSLAKQAFDEAIAELDTLGEESYKDSTLIMQLLRDNLTLWTSDMQEDGGDEIKEAAAGGKQSEEQPPQ

SEQ ID NO: 824 - DNA, 771 bp, Helianthus annuus
  CDS (1)..(771)
atggctgcttctgctgaacgcgaaaacttcatctacgtcgccaagctcgccgagcaagctgaacgctatgacgagatggtcgatgccatgaagaaagtagcaatgttggatattgaattgacggttgaggagagaaatttgctctcagttggatacaagaatgtggtgggttcacgtagggcatcatggaggatattgtcctccattgagcaaaaagaggagtcaaggggcaatgaagttaacgtcaagcggattaaggaatataggcagaaggtggaaacagagctgtcgaacatttgcaaagatatcatggctgtgattgacgagcatctgattccatcttcctctgcgggagaatccactgttttctactacaaaatgaaaggagactattataggtatcttgcggagttcaagtctggcaatgacaaaaaagaagcagctgatcagtcacttaaggcttatcaattggcttctactgctgcagaggaattatctcctacgcatcccattagattgggtttggctttgaacttctccgttttctattacgagatcatgaactctcccgaaagagcctgtcacctggcaaaacaagctttcgatgaagctatctcagaacttgattcgttgagtgaggaatcatacaaagatagcactttaattatgcagctcctgagggacaatctcactttgtggacctccgatattccagaggatggagaggaccaaaagatggagatcaccaaatctggtgaagatgcagagtaa

SEQ ID NO: 825 - protein, 256 aa, Helianthus annuus
MAASAERENFIYVAKLAEQAERYDEMVDAMKKVAMLDIELTVEERNLLSVGYKNVVGSRRASWRILSSIEQKEESRGNEVNVKRIKEYRQKVETELSNICKDIMAVIDEHLIPSSSAGESTVFYYKMKGDYYRYLAEFKSGNDKKEAADQSLKAYQLASTAAEELSPTHPIRLGLALNFSVFYYEIMNSPERACHLAKQAFDEAISELDSLSEESYKDSTLIMQLLRDNLTLWTSDIPEDGEDQKMEITKSGEDAE

SEQ ID NO: 826 - DNA, 783 bp, Helianthus annuus
  CDS (1)..(783)
atggcatcaccggcggcgcgtgaagagcacgtctacatggcaaagctctcggagcaagccgaacgctacgaagagatggtagaattcatggaaaaagtctccaactcactcaccgactcagaagaactcaccgtagaagaacgcaacctgttatccgtcgcgtacaaaaacgtgatcggagctcgccgtgcgtcgtggaggataatatcgtcgatcgagcagaaggaggagtctcgcggtaaccaggagcatgtggctgtgatcaaggagtacagatcgaagatcgagaaggagctttcggacatctgtgatggaattttgaagcttctggactcgaaacttgttccgtctgctggttctggcgactcgaaggtgttttatttgaagatgaagggagattatcatcgctaccttgcggagtttaagaccggtgctgagcggaaagaggctgctgagagtactctcaatgcttataaggccgctcaggatattgcaaatgctgaacttgcgccaacacacccaatccgtctaggattggctcttaacttctcggtgttctactatgagattttgaactcaccagatcgtgcatgtggtcttgccaaacaggcgttcgatgaagccatcgctgagttagatactttgggtgaagactcgtacaaggatagcactttgatcatgcaactccttcgtgataatcttactttgtggacatctgatatgcaggatgagggggctgatgagattaaggaagccaagcaaaatgacgaacaaaaggaatga

SEQ ID NO: 827 - protein, 260 aa, Helianthus annuus
MASPAAREEHVYMAKLSEQAERYEEMVEFMEKVSNSLTDSEELTVEERNLLSVAYKNVIGARRASWRIISSIEQKEESRGNQEHVAVIKEYRSKIEKELSDICDGILKLLDSKLVPSAGSGDSKVFYLKMKGDYHRYLAEFKTGAERKEAAESTLNAYKAAQDIANAELAPTHPIRLGLALNFSVFYYEILNSPDRACGLAKQAFDEAIAELDTLGEDSYKDSTLIMQLLRDNLTLWTSDMQDEGADEIKEAKQNDEQKE

SEQ ID NO: 828 - DNA, 777 bp, Helianthus annuus
  CDS (1)..(777)
atggcttcttcaaccgaacgtgacaacttcatctatgtcgctaagctcgccgagcaagccgagcgttatgacgaaatggtggatgctatgaagaaggtagcaaagttggatgttgaactgactgttgaagagaggaacttgctctcagttgggtacaagaatgtggtgggatcacgtagggcgtcatggagaatattgtcttcaatcgagcagaaagaggaatccagaggcaatgaagtgaatgtgaagcgtattaaggaatacaggcagaaggttgaaaccgaattgactgacatttgtaatgatatcatggttgtgattgatgagcatctgattccatcttcatctgctggtgaatccactgttttctactacaaaatgaaaggtgattattataggtatcttgcagagttcaagactggcgatgataagaaagaagcagctgatcagtcgctgaaggcttatcaattggcttccacgaccgcagaagctgatctggcacctactcaccccatcaggttgggtttggctttgaacttttcagtgttttattatgagatcatgaactctcctgaaagggcctgccaccttgcaaaacaagcttttgatgaagctatctcagagcttgattccctgagtgaagaatcatacaaagatagcaccttaataatgcagctcttgagggacaacctcactttgtggacttcagacattccagaggatggagaagaccaaaaaatggagatcaccaaatctggagcagaagatgcagagtaa

SEQ ID NO: 829 - protein, 258 aa, Helianthus annuus
MASSTERDNFIYVAKLAEQAERYDEMVDAMKKVAKLDVELTVEERNLLSVGYKNVVGSRRASWRILSSIEQKEESRGNEVNVKRIKEYRQKVETELTDICNDIMVVIDEHLIPSSSAGESTVFYYKMKGDYYRYLAEFKTGDDKKEAADQSLKAYQLASTTAEADLAPTHPIRLGLALNFSVFYYEIMNSPERACHLAKQAFDEAISELDSLSEESYKDSTLIMQLLRDNLTLWTSDIPEDGEDQKMEITKSGAEDAE

SEQ ID NO: 830 - DNA, 786 bp, Zea mays
  CDS (1)..(786)
atggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaa

SEQ ID NO: 831 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 832 - DNA, 807 bp, Zea mays
  CDS (1)..(807)
atgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaa

SEQ ID NO: 833 - protein, 268 aa, Zea mays
MSPSEPTREESVYMAKLAEQAERYEEMVEFMERVARYAGGAGGGDELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDAGDEIKEAAAAPKESAPEGQ

SEQ ID NO: 834 - DNA, 804 bp, Brassica napus
  CDS (1)..(804)
atgtcgtcaggatccgacaaagagagagagacattcgtctacttggctaagctctccgaacaagccgagcgttacgacgagatggttgagacgatgaagaaagtggcgaaggtggacagcgagctcacggtggaggagaggaatctattgtccgttggttacaagaacgtgatcggagcaagacgggcctcgtggaggataatgtcgtccatcgagcagaaggaagagtctaaaggcaacgaatcaaacgtgaaacacatcaagggttatcgccaaaaggtagaagacgagctcgctgacatatgtaaagacattctcaccatcatcgatcagcatctcatccctcacgctacctcaggagaagccaccgttttctattacaagatgaaaggagattattaccgttacttggctgagtttaagaccgagcaagagaggaaggaagcctctgaacagtcgctcaaaggctatgaggctgcaacacaagctgcaagcactgatcttccttcgacgcacccgattcgtcttggtcttgctcttaacttctctgttttctactatgagatcatgaactctcctgaaagagcttgccatctggccaagcaagcctttgatgaggcgattgcggagttggatacgctaagcgaggagtcatacaaggacagcactttgatcatgcagctcctgagagacaacctcaccctctggacttctgatcttcctgaagatggaggagaagacaacgccaagactgatgaacccaagaaagaagaggataagcttgcagaagctgccgagaactga

SEQ ID NO: 835 - protein, 267 aa, Brassica napus
MSSGSDKERETFVYLAKLSEQAERYDEMVETMKKVAKVDSELTVEERNLLSVGYKNVIGARRASWRIMSSIEQKEESKGNESNVKHIKGYRQKVEDELADICKDILTIIDQHLIPHATSGEATVFYYKMKGDYYRYLAEFKTEQERKEASEQSLKGYEAATQAASTDLPSTHPIRLGLALNFSVFYYEIMNSPERACHLAKQAFDEAIAELDTLSEESYKDSTLIMQLLRDNLTLWTSDLPEDGGEDNAKTDEPKKEEDKLAEAAEN

SEQ ID NO: 836 - DNA, 762 bp, Brassica napus
  CDS (1)..(762)
atggagactgagagggaaaagcaggtttactcggcgaagctctctgagcaaaccgaacgttacgatgaaatggttgaggcgatgaagaaagttgctcagatggatgtggagctcaccgtagaggagagaaaccttgtatctgtgggttacaagaacgtcatcggcgcgaggagagcttcgtggaggatactgtcctccatcgagcagaaggaagagtccaaggggaacgaggagaatgtcaagaggattcagaattaccgaaagagggttgaagaggagcttgccaaagtttgcaatgacatcttgtctgtcattgataagcatctcattccttcctctaccgccgtggagtccactgtctttttctacaaaatgaaaggagattactatcgctatctggcagagttcagctctggtgctgagcgcaaggaagctgcagatcagtctcttgaagcctacaaggctgctgttgctgctgcagagactggattggcaccaacacatccagttagacttggcttggctttgaacttttcggttttctattatgagatcttaaactctcctgaaagcgcatgccaattggctaagcaagcattcgacgatgcaatcgctgaacttgacagcctcaacgaggagtcatacaaggacagcactcttatcatgcagctactcagagacaacctcaccttgtggacttctgacctccccgaggaaggagaagagaaatccaaaggtgatgagcctaaagaagagaactga

SEQ ID NO: 837 - protein, 253 aa, Brassica napus
METEREKQVYSAKLSEQTERYDEMVEAMKKVAQMDVELTVEERNLVSVGYKNVIGARRASWRILSSIEQKEESKGNEENVKRIQNYRKRVEEELAKVCNDILSVIDKHLIPSSTAVESTVFFYKMKGDYYRYLAEFSSGAERKEAADQSLEAYKAAVAAAETGLAPTHPVRLGLALNFSVFYYEILNSPESACQLAKQAFDDAIAELDSLNEESYKDSTLIMQLLRDNLTLWTSDLPEEGEEKSKGDEPKEEN

SEQ ID NO: 838 - DNA, 786 bp, Brassica napus
  CDS (1)..(786)
atgtcgtctactcgggaagagaatgtgtacttggccaagttagccgagcaagccgaacgttacgaggagatggttgagttcatggagaaagtcgccaagaccgttgactccgaggagcttactgtcgaagagaggaacctcttgtccgttgcttacaagaacgtgattggtgctaggagagcttcgtggaggatcatttcttccattgaacagaaggaagaaagcagagggaacgaggatcacgttgctcttatcaaggactacagagggaagattgaaaccgagcttgggaagatctgcgatgggattttgaaccttttggattctcaccttgttcccgctgcgtctttggctgagtccaaagtgttttacctgaagatgaagggagattaccataggtaccttgctgagttcaagactggtgctgagaggaaggatgctgctgagagcactctcttggcttacaagtcagctcaggatattgcacttgctgatttacctccaactcatccgattagattgggacttgctcttaacttctctgtcttctactatgagattctcaactctcctgatcgcgcttgcagtctcgccaagcaggcttttgatgaagcaatctctgagctggacacattaggagaagaatcatacaaggacagcacgctgataatgcaacttctccgtgacaatctgacgctctggacttctgacatcaatgatgaggcgggtggtgatgagatcaaggaggcgtcaaaagacgagcctgaagaaggcaaacaagcttag

SEQ ID NO: 839 - protein, 261 aa, Brassica napus
MSSTREENVYLAKLAEQAERYEEMVEFMEKVAKTVDSEELTVEERNLLSVAYKNVIGARRASWRIISSIEQKEESRGNEDHVALIKDYRGKIETELGKICDGILNLLDSHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDINDEAGGDEIKEASKDEPEEGKQA

SEQ ID NO: 840 - DNA, 747 bp, Brassica napus
  CDS (1)..(747)
atggcggcgacgttgagcagagaccaatacgtgtacatggcgaagctggccgagcaagcggagcgatacgaggagatggtccagttcatggagagcctggtaagctccgccacgccggcgggggagctgacggtggaggagaggaacctcctctcggtggcgtacaagaacgtgatcggatctctaagagcggcgtggaggatcgtgtcatcgatcgagcagaaggaagagagcaggaagaacgaggagcacgtgtcgctcgtgaaggattacagatccaaggtggagggggagctctcgacgatctgctcggggatcctcaagctgctcgatacgcatctgatcccttcggctacggctagcgagtcgaaggtgttttacctgaagatgaagggggattaccatcgctacatggccgagttcaaatctggagatgagaggaagactgctgccgaagataccatgatcgcctacaaggctgctcaggacgttgcggttgctgatctagcgcctacgcatccgatcaggctgggtctggctctcaatttctcggtgttttactacgagattctcaactcttctgagaaagcttgtagcatggccaaacaggctttcgaggaagccattgctgagctggacacgttgggagaggagtcatacaaggacagtactctcatcatgcagttgctaagggacaatctaaccctctggacctccgacatgcaggagcagatggatgaggcctga

SEQ ID NO: 841 - protein, 248 aa, Brassica napus
MAATLSRDQYVYMAKLAEQAERYEEMVQFMESLVSSATPAGELTVEERNLLSVAYKNVIGSLRAAWRIVSSIEQKEESRKNEEHVSLVKDYRSKVEGELSTICSGILKLLDTHLIPSATASESKVFYLKMKGDYHRYMAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 842 - DNA, 750 bp, Brassica napus
  CDS (1)..(750)
atggcggcggcgacgatgagcagagaccaatacgtctacatggcgaaactcgccgagcaagcggagcgctacgaagagatggtccagttcatggaaagcctcgtaacctccgccacacctgccggcgagctcacggtagaagagaggaacctcctctccgtcgcgtacaagaacgtgatcggatctcttcgagccgcgtggaggatcgtgtcttcgatcgagcagaaggaagagagcaggaagaacgaggaacacgtgtccctcgtcaaggactacagatctaaggtcgagacagagctctccacgatctgctcggggatcctcaagctgctcgacacgcatctgataccttcggctagtgctagcgagtccaaagtgttttacttgaagatgaagggtgattaccatcggtacatggccgagttcaaatctggtgatgagaggaagacggctgctgaagatactatggtcgcttacaaggctgctcaggatgttgcggttgctgatctagcgcctacgcatccgatcaggctgggtttggctcttaatttctcggtgttttactacgagattctcaattcttcggagaaagcttgtagtatggctaaacaggctttcgaggaagcaattgcggagctggacacgttgggagaggagtcatacaaagacagtactctcatcatgcagttgctaagggacaatcttaccctctggacctctgatatgcaggagcagatggatgaggcctga

SEQ ID NO: 843 - protein, 249 aa, Brassica napus
MAAATMSRDQYVYMAKLAEQAERYEEMVQFMESLVTSATPAGELTVEERNLLSVAYKNVIGSLRAAWRIVSSIEQKEESRKNEEHVSLVKDYRSKVETELSTICSGILKLLDTHLIPSASASESKVFYLKMKGDYHRYMAEFKSGDERKTAAEDTMVAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 844 - DNA, 774 bp, Brassica napus
  CDS (1)..(774)
atgtcgtcacgtgaagagaatgtgtacatggcgaaactagccgaacaagcggagcgttacgaagagatggttgagttcatggagaaagttgctaagaccgttgactctgaagaactcactgtcgaggagaggaaccttctctccgttgcttacaagaacgtgatcggggcgaggagggcttcgtggaggatcatctcttccattgagcagaaggaagagagcaaagggaacgaagagcacgttgctatcatcaaggagtacagggggaagattgaaaccgagcttagcaaaatctgcgacgggatcttgaatgttcttgaagctcatctcatcccctctgcttcacctgctgagtctaaggtgttttatctcaagatgaagggagattatcacaggtatcttgctgagtttaaggctggtgatgagaggaaagatgctgctgagagcactttggttgcttacaagtctgctcaggacattgcgactgctgagttagctccaactcacccgatcaggcttggtcttgcactcaacttctctgtgttttactatgagatccttaactcgcctgaccgtgcctgcaccctcgctaagcaggcatttgatgaagctatcgctgagctggatacattgggagaggaatcatacaaagacagtacgctgattatgcagcttctcagagacaacctcactctctggacttctgacatgactgacgaagcaggagatgagataaaggaggcatcgaagccagaaggcggtgcagcagagtaa

SEQ ID NO: 845 - protein, 257 aa, Brassica napus
MSSREENVYMAKLAEQAERYEEMVEFMEKVAKTVDSEELTVEERNLLSVAYKNVIGARRASWRIISSIEQKEESKGNEEHVAIIKEYRGKIETELSKICDGILNVLEAHLIPSASPAESKVFYLKMKGDYHRYLAEFKAGDERKDAAESTLVAYKSAQDIATAELAPTHPIRLGLALNFSVFYYEILNSPDRACTLAKQAFDEAIAELDTLGEESYKDSTLIMQLLRDNLTLWTSDMTDEAGDEIKEASKPEGGAAE

SEQ ID NO: 846 - DNA, 786 bp, Brassica napus
  CDS (1)..(786)
atgtcgtctactcgggaagagaatgtgtacttggctaagttagccgaacaagccgaacgttacgaggagatggttgagttcatggagaaagtcgccaagactgttgactccgaggagcttactgtggaagagaggaacctcttgtccgttgcttacaagaacgtgattggtgcaaggagagcttcgtggaggatcatttcttccattgaacagaaggaagaaagcagagggaacgatgatcacgttgctcttatcaaggactacagagtgaagattgaaaccgagctcgggaagatctgcgatgggattttgaaccttttggattctcaccttgttcccgctgcctctttggctgagtccaaagtgttttacctgaagatgaagggagattaccataggtaccttgctgagttcaagactggtgctgagaggaaggatgctgctgagagcactctcttggcttacaagtcagctcaggatattgcacttgctgatttacctccaactcatccgattagattgggacttgctcttaacttctctgtcttctactatgagattctcaactctcctgatcgcgcttgcagtctcgccaagcaggcatttgatgaagcaatctctgagctggacacattaggagaagaatcatacaaagacagcacactgataatgcaacttctccgtgacaatctgactctctggacttctgacatcaatgatgaggcgggtggtgacgagatcaaggaggcgtcaaaagacgagcctgaagaaggcaaacaagcttag

SEQ ID NO: 847 - protein, 261 aa, Brassica napus
MSSTREENVYLAKLAEQAERYEEMVEFMEKVAKTVDSEELTVEERNLLSVAYKNVIGARRASWRIISSIEQKEESRGNDDHVALIKDYRVKIETELGKICDGILNLLDSHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDINDEAGGDEIKEASKDEPEEGKQA

SEQ ID NO: 848 - DNA, 783 bp, Brassica napus
  CDS (1)..(783)
atggcggttccgtcgcgcgaggatcttgtatacatggctaagcttgcggagcaggcggagaggtacgaagagatggtccaatacatggagaaagtctccgccgcaacagatggtagcgagctcacaatcgaggagcgaaacctcctctccgtcgcctacaagaacctgatcggcgctcgccgcgcctcgtggagaatcatctcttcgatcgagcagaaagaggagagccgcggcaacgtcgagcgcgtcaaaacgatccgtgactacaaggctaagatcgaatcggagctctcggggatctgcgacggaatcctaaagctgctcgactctacgctcgtcccttccgctgattccgaggaatccaaggtcttctacctcaagatgaaaggtgactactacagatacttagccgagttcaaaatcggtaaagagagagacgccgccgcggataacaccctcgccgcttacgaatctgctcaggacaatgctaaggggcttgcttcaactcacccaatccgtcttggtttggctttgaacttctctgtgttctattacgagatccttgagtcccctgaccgtgcctgcaacctcgctaaaacggcttttgatgctgctattgctgagttagacactctaggggaagagtcatacaaggatagcactttgatcatgcagcttctccgtgacaacctcactctctggacatccgacatgcaggatgaatctgcagacgagatcaaggaagcagctgcagctccgaagccaacagaagagcagaaatga

SEQ ID NO: 849 - protein, 260 aa, Brassica napus
MAVPSREDLVYMAKLAEQAERYEEMVQYMEKVSAATDGSELTIEERNLLSVAYKNLIGARRASWRIISSIEQKEESRGNVERVKTIRDYKAKIESELSGICDGILKLLDSTLVPSADSEESKVFYLKMKGDYYRYLAEFKIGKERDAAADNTLAAYESAQDNAKGLASTHPIRLGLALNFSVFYYEILESPDRACNLAKTAFDAAIAELDTLGEESYKDSTLIMQLLRDNLTLWTSDMQDESADEIKEAAAAPKPTEEQK

SEQ ID NO: 850 - DNA, 774 bp, Brassica napus
  CDS (1)..(774)
atgtcgtcacgtgaggtgaatgtgtacatggcgaaactagccgaacaagccgagcgttacgaagagatggttgagttcatggagaaagttgctaaaaccgtcgactctgaagaactcactgtcgaggagaggaaccttctctccgttgcttacaagaacgtgatcggagcgaggagggcttcgtggaggatcatctcttccattgagcagaaggaagagagcaaagggaacgaagaacacgttgctatcatcaaggagtacagggggaagattgaaaccgagcttagcaaaatctgcgacgggatcttgaatgttcttgaagctcatctcatcccctctgcttcgcctgctgagtctaaggtgttttatctgaagatgaagggagattatcacaggtatcttgctgagtttaaggctggtgatgagaggaaagatgctgctgagagcactttggttgcttacaagtctgctcaggacattgcgactgctgagttagctccaactcacccgatcaggcttggtcttgcactcaacttctctgtgttttactatgagatccttaactcgcctgaccgtgcctgcaccctcgctaagcaggcatttgatgaagctatcgctgagctggatacattgggagaggaatcatacaaagacagtacgctgattatgcagcttctcagagacaacctcactctctggacttctgatatgactgacgaggccggagatgagataaaggaggcatcgaagccagagggtggtgcagcagagtaa

SEQ ID NO: 851 - protein, 257 aa, Brassica napus
MSSREVNVYMAKLAEQAERYEEMVEFMEKVAKTVDSEELTVEERNLLSVAYKNVIGARRASWRIISSIEQKEESKGNEEHVAIIKEYRGKIETELSKICDGILNVLEAHLIPSASPAESKVFYLKMKGDYHRYLAEFKAGDERKDAAESTLVAYKSAQDIATAELAPTHPIRLGLALNFSVFYYEILNSPDRACTLAKQAFDEAIAELDTLGEESYKDSTLIMQLLRDNLTLWTSDMTDEAGDEIKEASKPEGGAAE

SEQ ID NO: 852 - DNA, 783 bp, Brassica napus
  CDS (1)..(783)
atggcggtttcggcgcgtgaggagtacgtgtacatggccaagctcgcggagcaagccgagcgctacgaggagatggtggagttcatggagaaagtctccgcagccatcgacggcgacgagctcaccgtcgaggagcgaaacctcctctccgtcgcgtacaaaaacgtgatcggcgcgcgccgcgcatcgtggcgaatcatctcctcgatcgagcagaaggaggagagccgcggcaacgacgaccacgtcaaggcgatccgagactacagggcgaagatcgagacggagctctccgggatctgcgacgggatcctcaagctgcttgacgataggctcgtccccgcggctggttcgggtgattcgaaggtgttttatctgaagatgaaaggggattaccataggtacttggctgagtttaagactggtcaggagaggaaggatgctgctgagaatactctctctgcttacaaggctgctcaggatattgcaaatgcagagctagctccaactcacccgatccgtcttggtctggcattgaacttctctgtgttctactacgagatccttaactctcctgatcgtgcctgcagcctcgccaaacaggcttttgatgaagcgatagcagagttggacactctaggtgaagagtcgtacaaagacagcaccttgatcatgcagcttctccgtgacaacctcactctctggacatccgacatgcaggatgatgatgctggggaggagatcaaagaatcatcagctccaaagccgactgaggaacagtag

SEQ ID NO: 853 - protein, 260 aa, Brassica napus
MAVSAREEYVYMAKLAEQAERYEEMVEFMEKVSAAIDGDELTVEERNLLSVAYKNVIGARRASWRIISSIEQKEESRGNDDHVKAIRDYRAKIETELSGICDGILKLLDDRLVPAAGSGDSKVFYLKMKGDYHRYLAEFKTGQERKDAAENTLSAYKAAQDIANAELAPTHPIRLGLALNFSVFYYEILNSPDRACSLAKQAFDEAIAELDTLGEESYKDSTLIMQLLRDNLTLWTSDMQDDDAGEEIKESSAPKPTEEQ

SEQ ID NO: 854 - DNA, 783 bp, Brassica napus
  CDS (1)..(783)
atggcggtttctgcgcgtgaggagttcgtgtacatggccaagctcgccgagcaagcggagaggtacgaggaaatggtagagttcatggagaaagtctccgccgccgtcgacggcgatgaactcaccgtcgaggagcgtaacctcctctccgtcgcttacaaaaacgtgatcggcgcccgccgtgcctcgtggcgcatcatttcgtcgatcgagcagaaggaagagagccgcggcaacgacgaccacgtcacggcgatccgcgattacagatctaagatcgagacggagctctctggaatctgcgacgggatccttaagctcctcgattcgaggctcgtccccgccgctgcttccggcgattccaaggtgttttacctcaagatgaaaggtgattaccacaggtacttggctgagtttaagactggccaggagaggaaagacgccgccgagaacactctctccgcttacaaagccgctcaggatattgcgaatgcagagctagcaccaactcacccaatccgtctaggtctggcattgaacttctctgtgttctactacgagatccttaactctcctgatcgtgcctgcagcctcgccaaacaggcctttgatgacgcgatagccgagttggacactctaggtgaagagtcatacaaagacagcaccttgatcatgcagcttctccgtgacaacctcactctctggacatccgacatgcaggatgatgctgcggatgagatcaaggaagcatcagctccaaaaccaacagaggaacagcagtaa

SEQ ID NO: 855 - protein, 260 aa, Brassica napus
MAVSAREEFVYMAKLAEQAERYEEMVEFMEKVSAAVDGDELTVEERNLLSVAYKNVIGARRASWRIISSIEQKEESRGNDDHVTAIRDYRSKIETELSGICDGILKLLDSRLVPAAASGDSKVFYLKMKGDYHRYLAEFKTGQERKDAAENTLSAYKAAQDIANAELAPTHPIRLGLALNFSVFYYEILNSPDRACSLAKQAFDDAIAELDTLGEESYKDSTLIMQLLRDNLTLWTSDMQDDAADEIKEASAPKPTEEQQ

SEQ ID NO: 856 - DNA, 753 bp, Brassica napus
  CDS (1)..(753)
atggcggcggcgacactaggcagagaccagtacgtctacatggcgaagctcgccgagcaagccgagcgctacgaggagatggtccacttcatggagcagctcgtcacaggcggcgccactccatcctcagagctcaccgtggaggaacgaaacctcctctcggtagcctacaagaacgtgatcggatctctacgcgccgcgtggaggatcgtgtcgtcgatcgagcagaaggaagagagcaggaagaacgaggagcacgcgacgctcgtgaagggttacagatctaaggtcgagacggagctttcctccgtctgcgaagggatactaaagcttcttgattcgcatctgattccctcggcggcggcgagcgagtcgaaggtgttttatttgaagatgaagggggattatcataggtacatggcggagtttaagtctggggaggagaggaaagctgctgctgaggatactatgggtgcttataaggcagctcaggatatcgcggctgctgatatggcgcctactcatccaataaggcttggtcttgcgttgaatttctcggtgttttactatgagattcttaattcttcagacaaagcttgtaacatggccaaacaggcttttgaagaagcaatagctgagcttgacacattgggagaagaatcctacaaagacagcactctcattatgcagttgctcagggacaatcttaccctatggacctccgatatgcaggagcagatggacgaagcctga

SEQ ID NO: 857 - protein, 250 aa, Brassica napus
MAAATLGRDQYVYMAKLAEQAERYEEMVHFMEQLVTGGATPSSELTVEERNLLSVAYKNVIGSLRAAWRIVSSIEQKEESRKNEEHATLVKGYRSKVETELSSVCEGILKLLDSHLIPSAAASESKVFYLKMKGDYHRYMAEFKSGEERKAAAEDTMGAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 858 - DNA, 780 bp, Brassica napus
  CDS (1)..(780)
atggcagtttcatcgcgcgaggactacgtatacatggcgaagctctccgagcaagccgagaggtacgaagagatggtcgaattcatggagaagctgtccgccgccgcagacggcgccgagctcaccgtcgaggagcgcaacctcctctccgtcgcgtacaaaaacgtgatcggcgcccgccgcgcttcgtggcggatcatctcctcgatcgagcagaaggaagagagccgcggcaacgacgaccgcgtcaagacgatcggcgactacaaggcgaagatcgagtcggagctagcgggaatctgcgaggggatcctgaagctgctcgagtctgcgctcgtcccttccgccgcttccgaggattccaaggttttctacctcaagatgaaaggcgattactataggtacttggctgagttcaagatcggtaaggagagagatgacgccgctgataacactctctccgcttacgaatctgctcaggagaatgcgaaggggctagctccaactcacccgatccgtcttggtttggcattgaacttctctgtgttttattacgagatcctcaattctcctgatcgtgcttgcaacctcgctaaaacggcttttgatgctgccattgctgagttagacacgctaggggaagagtcgtacaaggatagcactttgatcatgcaacttctacgtgacaacctcactctctggacatccgacatgcaggatgaagctgcagatgagatcaaggaagcaacgcctccaaagccagcagaggagcagaaatga

SEQ ID NO: 859 - protein, 259 aa, Brassica napus
MAVSSREDYVYMAKLSEQAERYEEMVEFMEKLSAAADGAELTVEERNLLSVAYKNVIGARRASWRIISSIEQKEESRGNDDRVKTIGDYKAKIESELAGICEGILKLLESALVPSAASEDSKVFYLKMKGDYYRYLAEFKIGKERDDAADNTLSAYESAQENAKGLAPTHPIRLGLALNFSVFYYEILNSPDRACNLAKTAFDAAIAELDTLGEESYKDSTLIMQLLRDNLTLWTSDMQDEAADEIKEATPPKPAEEQK

SEQ ID NO: 860 - DNA, 753 bp, Brassica napus
  CDS (1)..(753)
atggcggcggcgacactaggcagagaccagtacgtctacatggcgaagctcgccgagcaagccgagcgttacgaggagatggtccaattcatggagcagctcgtcacaggcggcgccactccatcgtcagagctcaccgtggaggaaagaaacctcctctcggtagcctacaagaacgtgatcggatctctacgcgccgcgtggaggatcgtgtcgtcgatcgagcagaaggaagagagcaggaagaacgaggagcacgcgacgctcgtgaagggttacagatctaaggtggagacggagctttcctccgtctgcgaagggatactaaagcttcttgattcgcatctgattccctctgcggcggcgagcgagtcgaaggtgttttatttgaagatgaagggggattatcataggtacatggcggagtttaagtctggggatgagaggaaagtggctgctgaggatactatgggtgcttataaggcagctcaggatattgcggctgctgatatggcgcctactcatccgattaggcttggtttggcgttgaatttctccgtgttttactatgagattcttaattcttccgacaaggcttgtgacatggccaaacaggcttttgaagaagccatagctgagcttgacactctgggagaagagtcctacaaagacagcactctcatcatgcagttgctcagggacaatctcaccctctggacctccgatatgcaggagcagatggacgaggcgtga

SEQ ID NO: 861 - protein, 250 aa, Brassica napus
MAAATLGRDQYVYMAKLAEQAERYEEMVQFMEQLVTGGATPSSELTVEERNLLSVAYKNVIGSLRAAWRIVSSIEQKEESRKNEEHATLVKGYRSKVETELSSVCEGILKLLDSHLIPSAAASESKVFYLKMKGDYHRYMAEFKSGDERKVAAEDTMGAYKAAQDIAAADMAPTHPIRLGLALNFSVFYYEILNSSDKACDMAKQAFEEAIAELDTLGEESYKDSTLIMQLLRDNLTLWTSDMQEQMDEA

SEQ ID NO: 862 - DNA, 786 bp, Brassica napus
  CDS (1)..(786)
atgtcgtctactcgggaagagaatgtgtacttggctaagttagccgaacaagccgaacgttacgaggagatggttgagttcatggagaaagtcgccaagactgttgactccgaggagcttactgtggaagagaggaacctcttgtccgttgcttacaagaacgtgattggtgcaaggagagcttcgtggaggatcatttcttccattgaacagaaggaagaaagcagagggaacgatgatcacgttgctcttatcaaggactacagagtgaagattgaaaccgagctcgggaagatctgcgatgggattttgaaccttttggattctcaccttattcccgctgcgtctttggctgagtccaaagtgttttacctgaagatgaagggagattaccataggtaccttgctgagttcaagactggtgctgagaggaaggatgctgctgagagcacactcttggcttacaagtcagctcaggatattgcacttgctgatttacctccaactcatccgattagattggggcttgctcttaacttctctgtcttctactatgagattctcaactctcctgatcgtgcttgcagtctcgccaagcaggcttttgatgaagcaatctctgagctggacacattaggagaagaatcatacaaggacagcacgctcataatgcaacttctccgtgacaatctgacgctctggacttctgacatcaatgatgaggcgggtggtgatgagatcaaggaggcgtcaaaagacgagcctgaagaaggcaaacaagcttag

SEQ ID NO: 863 - protein, 261 aa, Brassica napus
MSSTREENVYLAKLAEQAERYEEMVEFMEKVAKTVDSEELTVEERNLLSVAYKNVIGARRASWRIISSIEQKEESRGNDDHVALIKDYRVKIETELGKICDGILNLLDSHLIPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDINDEAGGDEIKEASKDEPEEGKQA

SEQ ID NO: 864 - DNA, 753 bp, Glycine max
  CDS (1)..(753)
atggcagcagcagaggggctaaacagagagcagtacgtgtacttggcgaagctgtcggagcaggcggagcggtacgaggagatggtggagttcatgcagaaggtggtggtggggtcgacgccggcgtcggagctcacggtggaggagcgcaacctcctctcggtggcctacaagaacgtcatcggctcgctgcgtgccgcgtggcgcatcgtctcctccatcgagcagaaggaggagggccgcaagaacgacgaccacgtctccctcgtcaagcactacagatccaaggtcgagaacgagctcactcaggtctgcgccagcatcctcagcctcctcgactccaacctcgtaccctccgcctccgccagcgagtccaaggtcttctacttgaagatgaagggcgattaccaccgctatctcgccgagtttaaggttggggacgaaagaaaaaccgctactgaggataccatgttgtcttacaaggctgcccaggatattgcttctgcggatcttccccctactcaccccatcagattgggtcttgctctcaacttctccgtcttctactatgaaatcctcaaccagtctgataaagcgtgtgccatggctaaacaggcttttgaggaagcaattgctgagctggacaccttgggagaagaatcttacaaagacagcacgctcataatgcagcttttaagagacaacctcaccctttggacttctgatgttcaggaccagctagatgagccctga

SEQ ID NO: 865 - protein, 250 aa, Glycine max
MAAAEGLNREQYVYLAKLSEQAERYEEMVEFMQKVVVGSTPASELTVEERNLLSVAYKNVIGSLRAAWRIVSSIEQKEEGRKNDDHVSLVKHYRSKVENELTQVCASILSLLDSNLVPSASASESKVFYLKMKGDYHRYLAEFKVGDERKTATEDTMLSYKAAQDIASADLPPTHPIRLGLALNFSVFYYEILNQSDKACAMAKQAFEEAIAELDTLGEESYKDSTLIMQLLRDNLTLWTSDVQDQLDEP

SEQ ID NO: 866 - DNA, 780 bp, Glycine max
  CDS (1)..(780)
atggcggccgctccctcgcctcgcgaagagaacgtctacatggcgaagctcgccgagcaggccgagcgctacgaagagatggtggagttcatggagaaggtctccgccgccgccgacaacgaggaacttaccgtggaggagaggaacctcctctccgtcgcctacaagaacgtgatcggagcgcgccgcgcctcgtggcgcatcatctcctcgatcgagcagaaggaggagagccgcggcaacgaggatcacgtctccgtcatccgcgactaccgatccaagatcgagtccgagctctccaacatctgcgacggtatcctcaagctcctcgactctcgcctcattccatccgcttcctccggcgattccaaggtcttctacctcaagatgaagggagattaccacagataccttgccgagttcaagaccggcgccgagcgtaaggaggctgccgagagcactctctctgcatacaaagccgctcaggacattgcgaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaa

SEQ ID NO: 867 - protein, 259 aa, Glycine max
MAAAPSPREENVYMAKLAEQAERYEEMVEFMEKVSAAADNEELTVEERNLLSVAYKNVIGARRASWRIISSIEQKEESRGNEDHVSVIRDYRSKIESELSNICDGILKLLDSRLIPSASSGDSKVFYLKMKGDYHRYLAEFKTGAERKEAAESTLSAYKAAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 868 - DNA, 780 bp, Glycine max
  CDS (1)..(780)
atggcctccaccaaggaacgcgaaaactttgtctacaccgccaagctcgccgaacaagccgaacgctatgaagaaatggtggaagcaatgaagaatgtggcgaagctgaacgtggaattgacggtcgaggagcggaaccttctgtcggtagggtacaagaacgtggtgggtgctcgtagggcttcgtggaggattctatcgtcgattgaacagaaagaagaagctaaagggaacgatgtgagtgtgaagaggataaaggagtataggcagaaggtggagtctgagttgtccaatatctgcagtgatatcatgactgttattgatgaacaccttattccctctagctctgctggtgaacctagtgtctttttctacaaaatgaagggggactattaccggtacctcgcggagttcaagtccggtgatgagagaaaagaggctgctgatcattccatgaaggcgtatcagtcggcttccactactgcagaggctgagttaccacccacacatcccatccgtttgggcctggctttgaacttctctgtcttttattatgaaattttgaactctcctgaaagggcctgtcaccttgctaagcaggcatttgatgaagccatctctgagttggatactctgagcgaggagtcttacaaagacagcaccctaattatgcagcttctgagggacaatctcaccctgtggacttctgacatccctgaagaaggagctgaggaacaaaaggtggattctgccagagctgctggaggtgacaatgcatag

SEQ ID NO: 869 - protein, 259 aa, Glycine max
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQSASTTAEAELPPTHPIRLGLALNFSVFYYEILNSPERACHLAKQAFDEAISELDTLSEESYKDSTLIMQLLRDNLTLWTSDIPEEGAEEQKVDSARAAGGDNA

SEQ ID NO: 870 - DNA, 774 bp, Glycine max
  CDS (1)..(774)
atggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaatag

SEQ ID NO: 871 - protein, 257 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 872 - DNA, 786 bp, Glycine max
  CDS (1)..(786)
atgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctccaacacatcccatccgattgggtctagctttaaatttctcagttttctattacgagatcttgaactctccagaaagagcctgtcatcttgcaaaacaagcttttgatgaagctatttctgagcttgacaccttgaatgaggagtcatacaaagacagcaccttaatcatgcaacttctcagggacaacctaactttgtggacttctgacatcccagaagatggagaagatgcccagaaagtgaatggcactgccaagcttggtggaggtgaggaggcagagtga

SEQ ID NO: 873 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEEAE

SEQ ID NO: 874 - DNA, 756 bp, Glycine max
  CDS (1)..(756)
atgtccgccgagaaagagagagagacccaggtttacttggccaagcttgccgagcaggccgagagatacgaagaaatggttgagtgtatgaagaaagtagcaaaacttgatcttgatctaactgtggaagaaaaaaacctcatcgtgcacgaaggaccctcttggcgcatcatgtcctcaattgagcagaaggaagagtctaagggaaatgagcacaatgttaaactgatcaagagttactgccaaaaagttgaggaggaactctccaaaatttgtggggacattctgactattatagaccagcatttgattccttcttccgcatcagcagaagctagtgttttctactataagatgaaaggtgattattttcggtatcttgctgagttcaagactgaccaagaaaggaaagaggcagctgaacagtcactgaaaggatacgaggctgcttcagccactgcaaacacagatcttccatcaacacatccaatccgtcttggacttgcactcaatttctctgtcttttattatgagataatgaactctcctgaaagggcctgccatttggctaagcaagcttttgatgaggcaattgcggagttggacaccctgagtgaagagtcatacaaggacagcactttgatcatgcagctgttgagagacaacctgactctctggacctctgatttgcctgaggatggaggtgaggacagcataaaagctgaagaaaccaaaccttctgagcctgagcattga

SEQ ID NO: 875 - protein, 251 aa, Glycine max
MSAEKERETQVYLAKLAEQAERYEEMVECMKKVAKLDLDLTVEEKNLIVHEGPSWRIMSSIEQKEESKGNEHNVKLIKSYCQKVEEELSKICGDILTIIDQHLIPSSASAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDSIKAEETKPSEPEH

SEQ ID NO: 876 - DNA, 786 bp, Glycine max
  CDS (1)..(786)
atggcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaa

SEQ ID NO: 877 - protein, 261 aa, Glycine max
MASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 878 - DNA, 780 bp, Glycine max
  CDS (1)..(780)
atgtccgtcgagaaagagagagagacccaggtttacttggccaagcttgccgagcaggccgagagatacgaagaaatggttgagtgtatgaagaaagtagcaaaacttgatcttgatctgactgtggaagaaaggaaccttctctcagtgggatacaaaaatgtgattggtgcacgaagggcctcttggcgcataatgtcctcaattgagcagaaggaagagtctaagggaaatgagcacaatgttaaactgatcaagagttactgccaaaaagttgaggaggaactctccaaaatctgtggtgacattctgactattatagaccagcatttgattccttcttccggatcagcagaagctagcgttttctactacaagatgaaaggtgattattttcggtatcttgctgagttcaagactgaccaagaaaggaaagaggcagctgagcagtcactaaaaggatacgaggctgcttctgccactgcaaacacagatcttccatcaacacatccaatccgtcttggacttgcactcaatttctctgtcttttattatgagataatgaactctcctgaaagggcctgccatttggccaagcaagcttttgatgaggcaattgcggagttggacaccctgagtgaagagtcatacaaggacagcactttgatcatgcagctgttgagagacaaccttactctctggacttccgatttaccagaggatggaggtgaggacaacataaaagctgaagaagccaaaccttctgagcctgagcattga

SEQ ID NO: 879 - protein, 259 aa, Glycine max
MSVEKERETQVYLAKLAEQAERYEEMVECMKKVAKLDLDLTVEERNLLSVGYKNVIGARRASWRIMSSIEQKEESKGNEHNVKLIKSYCQKVEEELSKICGDILTIIDQHLIPSSGSAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDNIKAEEAKPSEPEH

SEQ ID NO: 880 - DNA, 753 bp, Glycine max
  CDS (1)..(753)
atggcaggagcagaggggctaaacagagaacagtacgtgtaccttgcgaagctgtcggagcaggcggagcggtacgaagagatggtggagttcatgcagaaggtggtggtggggtggacgccggcgtcggagctcacggtggaggagcgcaacctcctctcggtggcctacaagaacgtgatcgggtctctgcgtgccgcgtggcgcatcgtgtcctccatcgaacagaaggaggaagggcgcaagaacgacgaccacgtgtccctcgtgaagcactacagatccaaggtcgagaacgagctcacgcaggtctgcgccagcatcctcaacctcctcgactccaacctcgtaccctccgtcttcgccagcgagtccaaggtcttctacttgaagatgaagggcgattaccaccgctatctcgcagagtttaaggttggggatgagagaaaaaccgctgctgaggataccatgttgtcttacaaggctgcccaggacattgcttctggggatcttccccctactcaccccatcagattgggtctcgctctcaacttctccgtcttctactatgaaatcctcaaccagtctgacaaagcgtgtgccatggctaaacaggcttttgaggaagcaattgctgagctggacaccttgggagaagaatcctacaaagacagcacgctcataatgcagcttttaagagacaacctcaccctttggacttctgatgtccaggaccagctagatgagccctga

SEQ ID NO: 881 - protein, 250 aa, Glycine max
MAGAEGLNREQYVYLAKLSEQAERYEEMVEFMQKVVVGWTPASELTVEERNLLSVAYKNVIGSLRAAWRIVSSIEQKEEGRKNDDHVSLVKHYRSKVENELTQVCASILNLLDSNLVPSVFASESKVFYLKMKGDYHRYLAEFKVGDERKTAAEDTMLSYKAAQDIASGDLPPTHPIRLGLALNFSVFYYEILNQSDKACAMAKQAFEEAIAELDTLGEESYKDSTLIMQLLRDNLTLWTSDVQDQLDEP

SEQ ID NO: 882 - DNA, 786 bp, Glycine max
  CDS (1)..(786)
atgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacaggcagaaggttgaattggagctttcaaacatctgtaatgatgttatgacagtgattgatgagcaccttatcccttcggctgcagctggtgaatccactgtgttttactataagatgaaaggagattattatcgttatcttgccgaatttaaggcaggcaatgagaagaaggaagctgctgatcagtctatgaaagcatatgagtctgctaccactgcagcagaggctgatttacctccaacacatcccatccgattgggtctagctttaaatttctcagttttctattacgagatcttgaactctccagaaagagcctgtcatcttgcaaaacaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtga

SEQ ID NO: 883 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMTVIDEHLIPSAAAGESTVFYYKMKGDYYRYLAEFKAGNEKKEAADQSMKAYESATTAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 884 - DNA, 777 bp, Glycine max
  CDS (1)..(777)
atggcctccaccaaggaacgtgaaaacttcgtctacgtcgccaagctcgccgaacaagccgaacgctatgaagaaatggtggaagcaatgaagaatgtggcgaacctaaacgtggaattgacggtagaggagcggaaccttctgtcggttgggtacaagaacgtggtgggtgctcgtagggcttcgtggaggattctttcctcgattgaacagaaagaagaagctaaagggaacgatgtgagcgtgaagaggataaaggagtataggctgaaggtggagtctgagttgtccaatatctgcagtgatatcatgactgttattgatgaataccttattccctctagctcatctggtgaacctagtgtctttttctacaaaatgaagggggactattaccggtacctcgcagagttcaagtccggtgatgagagaaaagaggctgctgatcattccatgaaagcgtatcagttggcttccactactgccgaggctgagttagcatccacacatcccatccgtttgggcctggctttgaacttctctgtcttttattatgaaattttgaactctcctgaaagggcctgtcaccttgctaagcaggcatttgatgaagcaatctctgagttggatactctgagcgaggagtcttacaaagacagcaccctaattatgcagcttctgagggacaatctcaccctgtggacttctgacatccctgaagatggagaggaacaaaaggtggattctgcccgagctgctggaggtgacgatgcatag

SEQ ID NO: 885 - protein, 258 aa, Glycine max
MASTKERENFVYVAKLAEQAERYEEMVEAMKNVANLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARAAGGDDA

SEQ ID NO: 886 - DNA, 774 bp, Glycine max
  CDS (1)..(774)
atgtcggattcttctcgggaggagaatgtttacatggcgaaattggcggagcaggccgagcgttacgaggagatggttgagttcatggagaaggtagcaaagactgtggaggttgaggagttgacggtggaggagagaaatcttctctctgtggcttacaagaacgtgattggtgcgaggagggcttcgtggaggatcatatcctccattgagcagaaggaggagagcaggggcaatgaggaccatgtggccattataaaggagtacaggggcaaaattgaggctgaactcagcaagatctgtgacgggattttgaacctccttgagtccaacctcatcccatccgccgcatctcccgagagtaaagtgttttaccttaaaatgaagggtgattaccacaggtaccttgccgagttcaagactggggcagagaggaaagaggcagcagagagtactttgcttgcttacaaatctgctcaggatattgctcttgctgacttggcccccactcaccccattaggctgggacttgctctcaacttttctgtcttctattatgaaatccttaactcgccagatcgggcttgtaatcttgccaaacaggcatttgatgaggcaatttccgagcttgacacattgggtgaagagtcatacaaggatagtacgttgatcatgcaacttctccgtgacaatctgactttgtggacatcagacatcacggacgatgctggagatgagatcaaggaaacatctaagcaacaaccaggtgaatag

SEQ ID NO: 887 - protein, 257 aa, Glycine max
MSDSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 888 - DNA, 786 bp, Brassica napus
  CDS (1)..(786)
atgtcgtctcctcgtgaagagaatgtgtacttggccaagttagccgagcaagccgagcgttacgaggagatggtcgagttcatggagaaagtcgccaagaccgttgactccgaggagctcaccgtggaagagaggaacctcttgtccgttgcttacaagaacgtgattggtgctaggagagcttcctggaggatcatctcttcgattgagcagaaggaagagagcagagggaacgaggatcacgttgctattatcaaggactacagaggaaagatcgagacagagctaagcaagatctgcgatgggattttgaatcttttggattctcatcttgttcccgctgcgtctttggctgagtctaaggtcttttatctgaagatgaagggggattaccataggtaccttgctgagtttaagactggtgctgagaggaaagatgctgctgagaacactctcgtggcttacaagtcagctcaggatattgcacttgctgatttgcctccgactcatccgattagattggggcttgcacttaacttctctgtcttctactatgagattctcaactcgcctgaccgcgcttgcaatctcgccaaacaggcttttgatgaagcgatatctgagctggacacattaggagaagaatcatacaaggacagcacactgatcatgcaacttctccgtgacaatctgaccctctggacttctgacatcaatgatgaggcgggtggtgatgagatcaaggaggcgtcaaaagacgagcctgaagaagggaaacaagcgtag

SEQ ID NO: 889 - protein, 261 aa, Brassica napus
MSSPREENVYLAKLAEQAERYEEMVEFMEKVAKTVDSEELTVEERNLLSVAYKNVIGARRASWRIISSIEQKEESRGNEDHVAIIKDYRGKIETELSKICDGILNLLDSHLVPAASLAESKVFYLKMKGDYHRYLAEFKTGAERKDAAENTLVAYKSAQDIALADLPPTHPIRLGLALNFSVFYYEILNSPDRACNLAKQAFDEAISELDTLGEESYKDSTLIMQLLRDNLTLWTSDINDEAGGDEIKEASKDEPEEGKQA

SEQ ID NO: 890 - DNA, 747 bp, Zea mays
  CDS (1)..(747)
atggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccagtgagctctcacctgctcaccaaatccggcttggccttgccctcaatttgtcggtcttcttttatgagataatgaactctcatgagagagcttgccaagtggcaaaacaagcatttgatgaggctcttactgagataaattctggtgagggagtttacaaggatagcacacttatgatgcagcttctgaaggacaacttagcattgtggacatcagaactaactggaggtgaagcatccaagggtaacgacgatgtcgacatggagggttga

SEQ ID NO: 891 - protein, 248 aa, Zea mays
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASSELSPAHQIRLGLALNLSVFFYEIMNSHERACQVAKQAFDEALTEINSGEGVYKDSTLMMQLLKDNLALWTSELTGGEASKGNDDVDMEG

SEQ ID NO: 892 - DNA, 771 bp, Zea mays
  CDS (1)..(771)
atgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaggagcatgtgaatcttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatttgctgagagcacaatggtggcctataaggctgctcaggacattgctctggctgagctggcacctacccatccgataaggctgggacttgctcttaatttttcagtgttttattatgagattttgaactccccagacaaagcttgcaacctggcaaagcaggcgtttgatgaagctatttttgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaa

SEQ ID NO: 893 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKEFAESTMVAYKAAQDIALAELAPTHPIRLGLALNFSVFYYEILNSPDKACNLAKQAFDEAIFELDSLGEESYKDSTLIMQLLRDNLTLWTSDLTEDGADEGKDAPKGDAGEGQ

SEQ ID NO: 894 - DNA, 747 bp, Zea mays
  CDS (1)..(747)
atggaggagcgggagaagctcgtgtgcctggccaagcttgccgagcaggcggagcggtacgacgatatggtggaattcatgaagaatcttgctaggatggacgtggatatgagtgctgaagaaaggcatttgttctcagttggtttcaagaacactattggagcaaagagagcatcatggagaatcatttgttcacatgagcaaaaggtcgcagctgatcgtcagactggtgtgatgatagatgcctataagaagaaagtagaagaggaactaaggaaggtttgcaatgaagtattgtcagtcattgctattcactgccttcccttggccagtacgggtgaaaatatcgtattcttttataagatgaaaggtgactactaccgttacttggctgaatttagcactggaactgaaaagaaagctgcctctgatcagtcacttatggcctatcagcatgccatggttgtcgcctccagtgagctctcacctgctcaccaaatccggcttggccttgccctcaatttgtcggtcttcttttatgagataatgaactctcatgagagagcttgccaagtggcaaaacaagcatttgatgaggctcttactgagataaattctggtgagggaggttacaaggatagcacacttatgatgcagcttctgaaggacaacttagcattgtggacatcagaactaactggaggtgaagcatccaagggtaacgacgatgtcgacatggagggttga

SEQ ID NO: 895 - protein, 248 aa, Zea mays
MEEREKLVCLAKLAEQAERYDDMVEFMKNLARMDVDMSAEERHLFSVGFKNTIGAKRASWRIICSHEQKVAADRQTGVMIDAYKKKVEEELRKVCNEVLSVIAIHCLPLASTGENIVFFYKMKGDYYRYLAEFSTGTEKKAASDQSLMAYQHAMVVASSELSPAHQIRLGLALNLSVFFYEIMNSHERACQVAKQAFDEALTEINSGEGGYKDSTLMMQLLKDNLALWTSELTGGEASKGNDDVDMEG

SEQ ID NO: 896 - DNA, 807 bp, Zea mays
  CDS (1)..(807)
atgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaaagcaggcctttgatgaggcaatctccgagctagacagcctgggagaggagtcctacaaggacagcactctgatcatgcagctcctgcgtgacaacttgaccctatggacttccgacaccaacgaggacggcggggatgagatcaaggaagcagctgctgcccccaaagaatccgcccccgagggccagtaa

SEQ ID NO: 897 - protein, 268 aa, Zea mays
MSPSEPTREESVYMAKLAEQAERYEEMVEFMERVARYAGGAGGGDELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQ

SEQ ID NO: 898 - DNA, 759 bp, Zea mays
  CDS (1)..(759)
atgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgcctacaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctcgaagggcgatgctggtgagggtcagtag

SEQ ID NO: 899 - protein, 252 aa, Zea mays
MSREENVYMAKLAEQAERYEEMVEYMEKVAKTTDVQELTVEERNLLSVAYKNVIAAPRASWRIISSIEQKEESRKNEEHVAQIKEYRGKIEAELSNICDGILKLLDTHLVPSSTATESKVFYLKMKGDYHRYLAEFKTGAERKESAESTMVAYKAAQDIALAELPPIHPIRLGLALNFSVFYYEIQNSPDKACNLAKEAFDEAISQLDMLGEDSYKDSNLIMQLLRDNLTLWTEDGIEEGLESSKGDAGEGQ

SEQ ID NO: 900 - DNA, 774 bp, Zea mays
  CDS (1)..(774)
atgtcgcgggaggataatgtttacatggccaagctggctgagcaagcagaacggtacgaggaaatggttgagtacatggagaaggtggctaagaccgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcgaggattcatacaaagatagcaccttgatcatgcagctcctgagggacaacctaaccctatggaccgctgacagcacaacggaggacggcatcgaggagggcaatgaggcctcgaagggtgatgctggtgagggtcagtag

SEQ ID NO: 901 - protein, 257 aa, Zea mays
MSREDNVYMAKLAEQAERYEEMVEYMEKVAKTVDVEELTVEERNLLSVAYKNVIGARRASWRIISSIEHKEESRKNEEHVIQIKEYRGKIEAELSNICDGILKLIDSHLVPSSTAAESKVFYLKMKGDYHRYLAEFKTGAERKEAAESTMIAYKAAQDIALAELASTHPIRLGLALNFSVFYYEILNSPDKACNLARQAFDEAISQLDTLGEDSYKDSTLIMQLLRDNLTLWTADSTTEDGIEEGNEASKGDAGEGQ

SEQ ID NO: 902 - DNA, 780 bp, Zea mays
  CDS (1)..(780)
atggccgccgccgccgccgccgccggcacccgggaggagatggtctacatggccaagctagcggagcaggcggagcggtacgaggagatggtcgagttcatggagaaggtcgcggccgccgcagagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgcgcgtcgaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgccggaccgcgcctgctcgctggccaagcaggccttcgacgaagctatttcagagctggatagtcttggggaagagtcgtacaaggatagcaccctcatcatgcagcttcttcgtgacaacctcaccttgtggacttccgacatgcaggaggatggtggcgatgaaatgcgggatgcaaacaagcctgacgaggagcagtag

SEQ ID NO: 903 - protein, 259 aa, Zea mays
MAAAAAAAGTREEMVYMAKLAEQAERYEEMVEFMEKVAAAAELTVEERNLLSVAYKNVIGARRASWRIVSSIEHKEETRGAAGHAAAARGYRARVEAELSGICAGILRLLDERLVPAAAAVDARVFYLKMKGDYHRYLAEFKTGAERKDAADSTLAAYQAAQDIAVKELPPTHPIRLGLALNFSVFYYEILSSPDRACSLAKQAFDEAISELDSLGEESYKDSTLIMQLLRDNLTLWTSDMQEDGGDEMRDANKPDEEQ

SEQ ID NO: 904 - DNA, 837 bp, Zea mays
  CDS (1)..(837)
atgtatatttgcagatccggcgtactgcaaattttgaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgcgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcgcccaagcgcgactcgagtgaggggcagtaa

SEQ ID NO: 905 - protein, 278 aa, Zea mays
MYICRSGVLQILKLNCKMASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 906 - DNA, 807 bp, Zea mays
  CDS (1)..(807)
atgtcgccgtcggagccgacgcgggaggagagcgtgtacatggccaagctggcagagcaggcggagcggtacgaggagatggtcgagttcatggagcgcgtcgcgcgctccgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaa

SEQ ID NO: 907 - protein, 268 aa, Zea mays
MSPSEPTREESVYMAKLAEQAERYEEMVEFMERVARSAGGAGGGDELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDAGDEIKEAAAAPKESAPEGQ

SEQ ID NO: 908 - DNA, 24 bp, Artificial sequence
  primer
atgtcaaccagtcgtgaagattct

SEQ ID NO: 909 - DNA, 23 bp, Artificial sequence
  primer
ttactttggtgcttcaccttcgg

SEQ ID NO: 910 - protein, 248 aa, Artificial sequence
  consensus sequence
  Variant (3)..(3): Xaa in position 3 is any amino acid
  Variant (4)..(4): Xaa in position 4 is any or no amino acid
  Variant (7)..(7): Xaa in position 7 is any amino acid
  Variant (17)..(17): Xaa in position 17 is any amino acid
  Variant (18)..(20): Xaa in position 18 to 20 is any or no amino acid
  Variant (22)..(22): Xaa in position 22 is any amino acid
  Variant (26)..(26): Xaa in position 26 is any amino acid
  Variant (27)..(27): Xaa in position 27 is any or no amino acid
  Variant (29)..(35): Xaa in position 29 to 35 is any amino acid
  Variant (36)..(42): Xaa in position 36 to 42 is any or no amino acid
  Variant (55)..(55): Xaa in position 55 is any amino acid
  Variant (62)..(62): Xaa in position 62 is any amino acid
  Variant (70)..(70): Xaa in position 70 is any amino acid
  Variant (79)..(79): Xaa in position 79 is any amino acid
  Variant (80)..(80): Xaa in position 80 is any or no amino acid
  Variant (82)..(82): Xaa in position 82 is any amino acid
  Variant (83)..(83): Xaa in position 83 is any or no amino acid
  Variant (85)..(87): Xaa in position 85 to 87 is any amino acid
  Variant (89)..(90): Xaa in position 89 to 90 is any amino acid
  Variant (92)..(93): Xaa in position 92 to 93 is any amino acid
  Variant (96)..(96): Xaa in position 96 is any amino acid
  Variant (98)..(98): Xaa in position 98 is any amino acid
  Variant (100)..(100): Xaa in position 100 is any amino acid
  Variant (103)..(104): Xaa in position 103 to 104 is any amino acid
  Variant (107)..(107): Xaa in position 107 is any amino acid
  Variant (108)..(109): Xaa in position 108 to 109 is any or no amino acid
  Variant (112)..(117): Xaa in position 112 to 117 is any amino acid
  Variant (119)..(119): Xaa in position 119 is any amino acid
  Variant (121)..(125): Xaa in position 121 to 125 is any amino acid
  Variant (126)..(126): Xaa in position 126 is any or no amino acid
  Variant (128)..(128): Xaa in position 128 is any amino acid
  Variant (129)..(131): Xaa in position 129 to 131 is any or no amino acid
  Variant (135)..(135): Xaa in position 135 is any amino acid
  Variant (142)..(142): Xaa in position 142 is any amino acid
  Variant (150)..(150): Xaa in position 150 is any amino acid
  Variant (152)..(153): Xaa in position 152 to 153 is any amino acid
  Variant (154)..(154): Xaa in position 154 is any or no amino acid
  Variant (157)..(157): Xaa in position 157 is any amino acid
  Variant (160)..(164): Xaa in position 160 to 164 is any amino acid
  Variant (167)..(168): Xaa in position 167 to 168 is any amino acid
  Variant (170)..(172): Xaa in position 170 to 172 is any amino acid
  Variant (174)..(174): Xaa in position 174 is any amino acid
  Variant (175)..(176): Xaa in position 175 to 176 is any or no amino acid
  Variant (178)..(178): Xaa in position 178 is any amino acid
  Variant (203)..(203): Xaa in position 203 is any amino acid
  Variant (204)..(204): Xaa in position 204 is any or no amino acid
  Variant (207)..(207): Xaa in position 207 is any amino acid
  Variant (215)..(215): Xaa in position 215 is any amino acid
  Variant (218)..(218): Xaa in position 218 is any amino acid
  Variant (222)..(222): Xaa in position 222 is any amino acid
  Variant (224)..(224): Xaa in position 224 is any amino acid
REXXVYXAKLAEQAERXXXXYXEMVXXMXXXXXXXXXXXXXXELTVEERNLLSVXYKNVIGXRRASWRIXSSIEQKEEXXGXXNXXXVXXIXXYRXKXEXELXXICXXXILXXXXXXLXPXXXXXXSXXXXVFYXKMKGDYXRYLAEFKXGXXXRKXAAXXXXXAYXXAXXXAXXXLXPTHPIRLGLALNFSVFYYEILNSPXXACXLAKQAFDXAIXELDXLXEESYKDSTLIMQLLRDNLTLWTSD

SEQ ID NO: 911 - protein, 28 aa, Artificial sequence
  protein pattern
  Variant (7)..(7): Xaa in position 7 is Ala, Gly or Val
  Variant (14)..(14): Xaa in position 14 is Ala or Ser
  Variant (15)..(15): Xaa in position 15 is any amino acid
  Variant (18)..(18): Xaa in position 18 is Ala or Ser
  Variant (21)..(21): Xaa in position 21 is any amino acid
  Variant (22)..(22): Xaa in position 22 is Phe, Ile, Leu, Met or Val
  Variant (23)..(23): Xaa in position 23 is Ser or Thr
  Variant (27)..(27): Xaa in position 27 is any amino acid
RNLLSVXYKNVIGXXRAXWRXXXSIEXK

SEQ ID NO: 912 - protein, 23 aa, Artificial sequence
  protein pattern
  Variant (3)..(3): Xaa in position 3 is Ser or Thr
  Variant (5)..(5): Xaa in position 5 is Gly, Asn or Ser
LDXLXEESYKDSTLIMQLLRDNL

SEQ ID NO: 913 - protein, 15 aa, Artificial sequence
  protein pattern
  Variant (2)..(2): Xaa in position 2 is Ala, Asp, Glu or Gly
  Variant (3)..(3): Xaa in position 3 is any amino acid
  Variant (6)..(6): Xaa in position 6 is any amino acid
  Variant (10)..(10): Xaa in position 10 is any amino acid
  Variant (13)..(13): Xaa in position 13 is Asp or Gly
  Variant (14)..(14): Xaa in position 14 is any amino acid
  Variant (15)..(15): Xaa in position 15 is Ala or Gly
PXXACXLAKXAFXXX

SEQ ID NO: 914 - protein, 25 aa, Artificial sequence
  protein pattern
  Variant (2)..(2): Xaa in position 2 is Leu or Met
  Variant (3)..(3): Xaa in position 3 is any amino acid
  Variant (4)..(4): Xaa in position 4 is Ile, Leu or Val
  Variant (5)..(5): Xaa in position 5 is Ile or Leu
  Variant (6)..(6): Xaa in position 6 is Asp or Glu
  Variant (7)..(8): Xaa in position 7 to 8 is any amino acid
  Variant (10)..(10): Xaa in position 10 is Ile or Val
  Variant (11)..(11): Xaa in position 11 is Ala, Gly or Pro
  Variant (12)..(12): Xaa in position 12 is any amino acid
  Variant (13)..(13): Xaa in position 13 is Ala, Cys, Ser, Thr or Val
  Variant (14)..(16): Xaa in position 14 to 16 is any amino acid
  Variant (17)..(17): Xaa in position 17 is Asp or Glu
  Variant (18)..(18): Xaa in position 18 is Ala or Ser
  Variant (19)..(19): Xaa in position 19 is any amino acid
  Variant (23)..(23): Xaa in position 23 is any amino acid
IXXXXXXXLXXXXXXXXXXVFYXKM

SEQ ID NO: 915 - protein, 16 aa, Artificial sequence
  protein pattern
  Variant (9)..(9): Xaa in position 9 is any or no amino acid
  Variant (11)..(11): Xaa in position 11 is any or no amino acid
  Variant (14)..(15): Xaa in position 14 to 15 is any amino acid
LAEQAERYXEXMVXXM

SEQ ID NO: 916 - protein, 8 aa, Artificial sequence
  protein pattern
  Variant (7)..(7): Xaa in position 7 is any amino acid
  Variant (8)..(8): Xaa in position 8 is Glu, Asn, Pro, Gln, Ser or Thr
TLWTSDXX

SEQ ID NO: 917 - DNA, 2391 bp, Saccharomyces cerevisiae
  CDS (1)..(2391)
atggtttgctgcttatgggtgcttctagcattgttgcttcatctcgatcatgtagcatgcgaagacgatgcgtactcattcacttctaaagaacttaaggcttacaagcaggaagtgaaggagctgttttatttcggcttcgacaattatttagagcatgggtatccatatgatgaggtaaaacccatttcatgcgttcctaagaagagaaactttgaagatcctactgatcaaggcaccaacgatatattgggcaattttacaatcactttaatagattctttaaccactattgctatactggaagaccggccgcagtttttgaaagctgttcgacttgttgaaaggacatttcctgatggcaatttcgatattgattccacaatacaagtttttgaaattactatacgtgttatcggatcactactatcatcacatctttatgctacggatcccacaaaggcagtgtatttaggggacgattatgatggctcactgttacgtctcgcccagaatatggcagataggctcttacctgcatatttaacgtctaccggattacctatgccacggagaaacatcaaacgaaaatgggatgtctctgaatttccagaatttttggagacagagaataatgtggccgctatggcgtctcccatgttcgaattcactattttatcttacttgacaggcgatcccaagtatgagaaagttaccagatacgcatttgataaaacatggtctcttagaactggtttggatttgctacccatgtcctttcaccccgaaaaactaacaccatatacgcccatgactggaatcggcgcctccatcgactcccttttcgaatacgctttgaaaggtgctattttatttgatgattcagaattaatggaagtttggaacgtagcatacgaggcattaaagactaactgtaaaaacgattggttttttgctaatgtaatggctgacacagggcatttgtttgttccctggattgattctttgagtgcttttttctccggtttacaggtgcttgctggtgatttggatgatgccatagcgaaccatttaatgtttttaaaaatgtggaacacctttggcggtattcctgaaaggtggaactttagtcctccggagtttcccccactatctccattagagcgatcgggagctgttgctttggataatatcctccccttagaatggtacccattaagaccggaattttttgagtcaacctatttcttatatagagctacaaaagacccgttttacttaaatattggggtacatctgctaaaagacctcaagcaacgatttaagtctaactgcggatttgcaggtttccaaaatgtaatcacgggcgaactgcaagatagaatggaaacatttgtgttgagtgaaactttgaaatacctgtatttattatttgatgaagagaacgaattacataacagcgctagtgacgtaattttcagtacagaagcccatccaatgtggttgccccaagaagtgaggtccaactataaacgtaacgctaaatttaacaactctgtctactcgtcgcacttggaaatttgccagaaaaaggacagggaacaagctggagagaacacattgagccaaagaattgtggggttcgccaaatcgatctttcataaaggtccaccagacgaagaggctactgatccaattatagactataccattgatactgaacttcccggtacatgctctataaagcctcatcatgtaattggtgacgaattttggtattctccaatgttgagcaattttgacagattattcgagattgactcccggttcgctgccacgctaattaaaccttcacacatgcataactataatgcaattgaactagaacctggattttataacaggtggtccaatccgcaatttagcacgtgcctgatcccacccaccaccgaaattttcgaactactattcgaccttcctggatatcatcagttgaatccattaatgttagaaaacaaaactattacatttgaaacctttggaggtaggtcaaggttgaagatcgaaaaattgcaaatctaccaaattgattactatggagacttaatcactgcatcgacattccaagacgtctcccgcaaggatattttctcgaatgcatgcgatgcagtggcaagcttgtattctcccacttatctttacagagtagtagccatcaacggacgcatattgcctcgccatggaagtgtacaaatcaagaaacatagtcctgtgctcacttccaatggcacaagagaggaagacgaattcaaaatggatggcatcgggattaatgaccattcccaactcatgttagaatgcacgcccatcatcaacttatttattgtatga

SEQ ID NO: 918 - protein, 796 aa, Saccharomyces cerevisiae
MVCCLWVLLALLLHLDHVACEDDAYSFTSKELKAYKQEVKELFYFGFDNYLEHGYPYDEVKPISCVPKKRNFEDPTDQGTNDILGNFTITLIDSLTTIAILEDRPQFLKAVRLVERTFPDGNFDIDSTIQVFEITIRVIGSLLSSHLYATDPTKAVYLGDDYDGSLLRLAQNMADRLLPAYLTSTGLPMPRRNIKRKWDVSEFPEFLETENNVAAMASPMFEFTILSYLTGDPKYEKVTRYAFDKTWSLRTGLDLLPMSFHPEKLTPYTPMTGIGASIDSLFEYALKGAILFDDSELMEVWNVAYEALKTNCKNDWFFANVMADTGHLFVPWIDSLSAFFSGLQVLAGDLDDAIANHLMFLKMWNTFGGIPERWNFSPPEFPPLSPLERSGAVALDNILPLEWYPLRPEFFESTYFLYRATKDPFYLNIGVHLLKDLKQRFKSNCGFAGFQNVITGELQDRMETFVLSETLKYLYLLFDEENELHNSASDVIFSTEAHPMWLPQEVRSNYKRNAKFNNSVYSSHLEICQKKDREQAGENTLSQRIVGFAKSIFHKGPPDEEATDPIIDYTIDTELPGTCSIKPHHVIGDEFWYSPMLSNFDRLFEIDSRFAATLIKPSHMHNYNAIELEPGFYNRWSNPQFSTCLIPPTTEIFELLFDLPGYHQLNPLMLENKTITFETFGGRSRLKIEKLQIYQIDYYGDLITASTFQDVSRKDIFSNACDAVASLYSPTYLYRVVAINGRILPRHGSVQIKKHSPVLTSNGTREEDEFKMDGIGINDHSQLMLECTPIINLFIV

SEQ ID NO: 919 - DNA, 2055 bp, Oryza sativa (japonica cultivar-group)
  CDS (1)..(2055)
atgcccacctcgggcccggacgcgatgcagccggcgctgcgacggcggcggcggcgccaaggcttcctcctccccttcgcctgcctctccgccgccctcatcgccgctgccctgctccccggcgccgctttcgccgatggcgtcacgccctccgaggcccgccggctccgcgacgaggtcaaagatatgttctatcatgcatttgatgggtacatgcaacatgcttttccacttgatgaattgcggcctttaagttgccaaggagaagattcacttggtggctatgcacttactcttatagactctttggataccttggctttactaggggataaggagagatttgatgctgccgtggagtgggttggtaagaatgtccgctttgatattaataaaactgtctctgtttttgaaaccaacatacgcattcttgggggtctgctatcagctcacctgattgccagtgattatgcaactggaatgagaattcaatcttatgatgatcagttgcttcatttagcggctgacttagctcaaagattgctacctgcatttgacactccaacaggtattccatttggatcagtaaatttattgtatggagtcgatgaaaatgaaagcaagataacttcaacagctggtggtggcactttgacactggaatttggtgtcctgagtcgtttgactaatgatagcgtttatgaacgagttacaaaaaactctgtgcgtggaatatgggcacgcaggtcgaaacttgaccttgttggtgcccatataaatgtatttactggtgaatggacacagaaggatgcaggaattggcacaagcattgactcattctatgagtatcttctaaaggcgtatttattatttggagatgaagaatatttgtatatatttcaggaggcttacaaggctgccatgcattatctccatcatgatccctggtatgtggaggtaaatatgaattctggtgctactgtttggccactattcaacagtctccaggcattctggccaggacttcaggtgttagctggagatgttgatcctgccattcgaactcatgctgccttcttcagtgtatggaaaaaatatggcttcaccccagaagggtttaatcttgctacatccactgttcagaatggacaaaggagctacccgctgcggcctgaattgattgaaagcacatattggctgttcaaggctactagagattataggtaccttgatgttggaagggatatattagcaagccttcaatatggtgctaaatgtccatgtggttactgccatatttcagatgtagaaacccaccagcaggatgaccacatggagagttttttccttgcagaaacagtcaaatatctctggcttctttttgatttagctgcaggccctgataatattgttgaaaatgggccatataaatacatatttagtacagaaggtcatctgttgcctgctactcctcagataaccttgttagatgagcattgcttgtatgctggagcattctgcaatggtactgcaggccatggatatggtaccggtgatagttctaataagcatcaaaatgcaaactctgttccgttcgatgatagtcgaacaccttccgatcaatctttatccaatattttgtctacgacaagagggtacatcaagggagtttgtccaggattaactcatgcccagaaacttggcatatcatactctgccgaggaggataactcaatacagcagaattctggaagtagtgagaatcttgatgaatcacacgtgatcaaatccagtgtccaagctcaatcaagttctgttatattgatatcgcatccagtcgcaagccaaactgaggagcctacgtcgggcagaagtcagtacaatgcaaacattgtggcaactgctgagtctgtagggactgatactgccggcgcctcatcccaccccgaggatcttgttaaggaaactgagagcgtctctgaacagaaagaaatcaatgacaaagagatcgcttctcagggtagtcaaccgaccgaaggaagatacctgacctaa

SEQ ID NO: 920 - protein, 684 aa, Oryza sativa (japonica cultivar-group)
MPTSGPDAMQPALRRRRRRQGFLLPFACLSAALIAAALLPGAAFADGVTPSEARRLRDEVKDMFYHAFDGYMQHAFPLDELRPLSCQGEDSLGGYALTLIDSLDTLALLGDKERFDAAVEWVGKNVRFDINKTVSVFETNIRILGGLLSAHLIASDYATGMRIQSYDDQLLHLAADLAQRLLPAFDTPTGIPFGSVNLLYGVDENESKITSTAGGGTLTLEFGVLSRLTNDSVYERVTKNSVRGIWARRSKLDLVGAHINVFTGEWTQKDAGIGTSIDSFYEYLLKAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYGAKCPCGYCHISDVETHQQDDHMESFFLAETVKYLWLLFDLAAGPDNIVENGPYKYIFSTEGHLLPATPQITLLDEHCLYAGAFCNGTAGHGYGTGDSSNKHQNANSVPFDDSRTPSDQSLSNILSTTRGYIKGVCPGLTHAQKLGISYSAEEDNSIQQNSGSSENLDESHVIKSSVQAQSSSVILISHPVASQTEEPTSGRSQYNANIVATAESVGTDTAGASSHPEDLVKETESVSEQKEINDKEIASQGSQPTEGRYLT

SEQ ID NO: 921 - DNA, 1758 bp, Oryza sativa (japonica cultivar-group)
  CDS (1)..(1758)
atgcgacctcctccccggccgcgccgcccagtgccggcgcggctcgtcgccgctgcggtcctcctctcggctctcgccgggggagccgcggcgggcgccgccatcgccggcgatgggtacgggcgcggcaggaggctgtacatgaggaacaaggtcctggagatgttttaccatgcttatgacaactatatgacttatgcatttccacatgatgaattgaagcctctaaccaaaagtttcactgactcccttagtgagcttggcaacctaaatcttgaacatttgccaaatgattacaatggatctgcacttacactagtcgaatcgttgtcaagtcttgttgtcttaggtaacctcacggagtttgaaagaggagttctctggctttcagagaacctaacatttgatgttgatgctcgaataaatctttttgagtgcaacataagacttcttggggggcttatttctggtcatattcttgcaaaggagcacagcagtcatcttaaagatggaccatatcaggaccagttactacatcttgctgaaaatttaggaagtcgttttctaccagcttttgagacacctactggattgccatacgcatggatcaatcttaagtatggagtgatggaaaatgaaacaactgagacaagcacatcagggtgtggttctctgattcttgaaatgggtgcattatcacgtttgacgggtgattctagatatgaggctgcagctcttcgtgctcttcgtaagttgtggagcatgagaagttcactaaatcttgtaggcacaacccttgatgtcttgactggcaagtggattgaatattcgtcaggcattggtgctggagttgattcattttatgagtatttgattaaagcgtatgttcttttcggaagcgaagaatactgggatatgtttcattcagcttaccttgcagtgcagaagtatttccgacatggcccatggtatcatgaggctgatatgaggaccggagaagcaacacactggcaactaactagccttcaagccttctggccaggtcttcagacacttctaggagatgttgctgctgcaaatatatcacatcgtgaattttacaatgtatggcaaaggtttggtgttctgccggaaagatatcttttggacttcggaatgttgcatcctacagagaagtattatcctttacgtccagagtttgctgagtctacattttatctttatcaagcaactaaagatccttggtatctagaagttggtgaagctatcattggatcccttaattactatactaaagtggatggaggttttgctagtgtcagggatgtttcgacaatgaaacttgaagatcatcaacatagcttctttctttcagaaacctgcaaatatctttttcttctctacgatgattcattcttgaggaaccaaaattacatatttaccacggagggtcacccccttccaataaggagcacatggcacgagataatcccgacaacgcatgttcccagcaactggacattcgttaaggatgacagccaacccttccgtgtgagcgcattgtcgtctcaagtttgtccagaaacgattttccggcaaagcgttggctccccgtgggagagtgcatgccatgtaccagacgtgttacctacccacagatgcaggaccgatgatgactgtggagtggaggccgtatcatgcaggagaagaacttgcagtatggctggctactgcggcttgtggctgggggtttattag

SEQ ID NO: 922 - protein, 585 aa, Oryza sativa (japonica cultivar-group)
MRPPPRPRRPVPARLVAAAVLLSALAGGAAAGAAIAGDGYGRGRRLYMRNKVLEMFYHAYDNYMTYAFPHDELKPLTKSFTDSLSELGNLNLEHLPNDYNGSALTLVESLSSLVVLGNLTEFERGVLWLSENLTFDVDARINLFECNIRLLGGLISGHILAKEHSSHLKDGPYQDQLLHLAENLGSRFLPAFETPTGLPYAWINLKYGVMENETTETSTSGCGSLILEMGALSRLTGDSRYEAAALRALRKLWSMRSSLNLVGTTLDVLTGKWIEYSSGIGAGVDSFYEYLIKAYVLFGSEEYWDMFHSAYLAVQKYFRHGPWYHEADMRTGEATHWQLTSLQAFWPGLQTLLGDVAAANISHREFYNVWQRFGVLPERYLLDFGMLHPTEKYYPLRPEFAESTFYLYQATKDPWYLEVGEAIIGSLNYYTKVDGGFASVRDVSTMKLEDHQHSFFLSETCKYLFLLYDDSFLRNQNYIFTTEGHPLPIRSTWHEIIPTTHVPSNWTFVKDDSQPFRVSALSSQVCPETIFRQSVGSPWESACHVPDVLPTHRCRTDDDCGVEAVSCRRRTCSMAGYCGLWLGVY

SEQ ID NO: 923 - DNA, 1875 bp, Arabidopsis thaliana
  CDS (1)..(1875)
atggactcaaatttcaagtggcttttgtttgccatcttgatctctctgacattttcgggttttgttcttcaccatggagttctcgctgaaagtgttaagcctgatgaagctaaacagcttagagacgaggtacgtgggatgttttatcatgcctttgatggatatatgaacaatgcgtttccactcgatgaattgagaccgttatcttgccaaggagaagatactcttggaggctatgcgttgactctgattgactcgttggatacattagctttacttggtgaccgagagcgcttcacttcttctgttgaatggattggtaaaaatcttcagtttaatataaataaaacagtctctgtgtttgagacaactatccgagtccttggggggttactatctgctcatctgattgcaagtgattatgcaacgggcatgagaattccatcttacaacaatgaattactagttttggctgagaatttggcacggagaatgcttcctgcatttgatacaccgactggaatcccatttggatctgtgaatttgatgtacggtgttgacaaacatgaaagcaagataacatcaactgccggtggtggtactttgtctttagagtttggcgtgcttagtcgtttaacaaatgatcctgttttcgaacaagttgcaaagaatgcggtgaggggactatgggcacgtcgttcaaatctcgacttggttggtgctcacatcaatgtctttacaggtgaatggacacagaaggatgctggtataggaacaagcattgattccttctatgagtatctactcaaggcttatatactatttggggatgaggaatatctatacatttttcaagaagcttatagatctgcaatgcagtaccttcacaaggatccttggtatgtagaagtcaatatggattccgcagctattgtctggccagtatttaacagccttcaagctttctggccaggacttcaggttttagctggagacgttgatccagcaataagaactcacactgccttctttagcgtctggaaacgatatggtttcacccctgagggttttaatcttgctacacttagtgtccagtatgggcaaaagagttatcccttaaggccggaattaatcgagagtacatactggttgtacaaagctaccagagatcccaggtatcttgatgcaggacgtgactttgtggctagtttgcaatacggggcaaaatgtccttgcggttattgtcacatcacagatgtagaactgcataaacaagaagatcacatggagagcttcttcctcgcagaaacggtgaagtacttatggctactctttgacttagctgttgactcggataacctcgtagacaatggcccttacaagtacatcttcagtactgagggtcatctcttaccaataacaccacaaatatctctagctcgggaacattgctcttactttggtggatactgtccaagcaattccacaaaactagaacaagaagtccttggagaagacagtagtaacgatgatcacagtaacgattatccttaccacgaatcttttccagttaccggtttgataaagggtttatgtccaggactaacacatgctcagaaatatggtttttcgtatgttctaccggagaagacagatcgtgaagatgttaatcaacctaaaccggtagttacaagcagttcaattgtgttaatctcggatcaaacagtggagaagagaccacaggaagaagaaggatttacttctcagtctgaaccaataatgacaatctctggtggtagtagcaacgaccaaacaggtcaagagctaaccttgttagagtcagaaactgatgatcaaagatcatactcttcttaa

SEQ ID NO: 924 - protein, 624 aa, Arabidopsis thaliana
MDSNFKWLLFAILISLTFSGFVLHHGVLAESVKPDEAKQLRDEVRGMFYHAFDGYMNNAFPLDELRPLSCQGEDTLGGYALTLIDSLDTLALLGDRERFTSSVEWIGKNLQFNINKTVSVFETTIRVLGGLLSAHLIASDYATGMRIPSYNNELLVLAENLARRMLPAFDTPTGIPFGSVNLMYGVDKHESKITSTAGGGTLSLEFGVLSRLTNDPVFEQVAKNAVRGLWARRSNLDLVGAHINVFTGEWTQKDAGIGTSIDSFYEYLLKAYILFGDEEYLYIFQEAYRSAMQYLHKDPWYVEVNMDSAAIVWPVFNSLQAFWPGLQVLAGDVDPAIRTHTAFFSVWKRYGFTPEGFNLATLSVQYGQKSYPLRPELIESTYWLYKATRDPRYLDAGRDFVASLQYGAKCPCGYCHITDVELHKQEDHMESFFLAETVKYLWLLFDLAVDSDNLVDNGPYKYIFSTEGHLLPITPQISLAREHCSYFGGYCPSNSTKLEQEVLGEDSSNDDHSNDYPYHESFPVTGLIKGLCPGLTHAQKYGFSYVLPEKTDREDVNQPKPVVTSSSIVLISDQTVEKRPQEEEGFTSQSEPIMTISGGSSNDQTGQELTLLESETDDQRSYSS

SEQ ID NO: 925 - DNA, 1725 bp, Arabidopsis thaliana
  CDS (1)..(1725)
atgtcttgtcctatccatcctaggcgtctcttcctctgcttgcttatttctctcactttcttcgtcgtcgacccttcatcgcagcatatcgaggtcaagaagaaacaaatgcgagagaaagtacgcgagatgttctatcatgcgtatgacaattacatgacttatgcatttccgcatgatgagctaaagcctctaactaaaagtttcacagactccctcagtgagcttggaaatcttaagcttgaacacctgccaacagattataatggatcagctgttactcttgttgaatcattatccagccttgctatattggggaacagtacagaatttgaaaagggggttctctggctctcagaaaatcttactttcgatattgatgcccgggtcaacctttttgagtgcaatataagagttcttggaggacttatctctgctcatcttcttgcaattgatccaaataataggttgattcagggttcctacaacaatcagcttcttcgattagctgaagaccttggaaaacgttttttacccgcgtttgaaacacctacaggattaccatatgcatggattaatttgaagaatggagtaatggagaatgagacaactgaaacaagcacttcaggatgtggttctctcgttcttgaaatgggagcattgtcacggctcactggtgacccgaggtttgaatcagctgcactacgtgcgcttcgtcagctatggaggatgcgaagttcgttagatctgcttgggacaacattggatgtggtaactggggaatggatagagtactcctctagcattggagctggggttgactctttctatgaatacctcttgaaggcttatattctttttggaaaagaagactactggcgaatgtttcattctgcttatctggcatctcagaagtacttcagacatgggccttggtaccatgaagctaatatgtggagtggaaaaccaacttactggcagctcacaagtcttcaggcgttttggcctggtctgcaggttcttgttggagatattgcagctgcaaattcatcgcatcgtgagtttttccatgtatgggaaaagtttggtgtattacctgagaggtatctactcgatcatcaaataatacatccgacaatgaagtactatccactacgtcctgaattagcagaatccacgttctacctttaccaagctacaaaagatccatggtatctagatgttggtgaatcaatggtaaaatctcttaatctctacacaaaggtgccagggggatttgcaagtgttagagatgtgacgaccatgcaattggaagatcatcagcacagtttctttctcgctgaaacgtgcaagtacctatatctcctcttcgatgactcatttgtggccaaaaggaattatatatttacaaccgagggccatcctatacaggttgtgagctcctggcatgagaaactaccagaaacttatttctcaggcaactggaccctttcaaagagtggagcatgggaaagtcgagctagcgcattgtcactacaagtctgtccactgatatctcttaactctagacatcctgagcaacaaagagagagtgcttgccatgttcttgacgagcaaatcaatcataagtgttggagcaacaaagagtgcggagttgatgccactacttgtagactaagaacctgcagcggggttggatactgcggcttatggaatcccttataa

SEQ ID NO: 926 - protein, 574 aa, Arabidopsis thaliana
MSCPIHPRRLFLCLLISLTFFVVDPSSQHIEVKKKQMREKVREMFYHAYDNYMTYAFPHDELKPLTKSFTDSLSELGNLKLEHLPTDYNGSAVTLVESLSSLAILGNSTEFEKGVLWLSENLTFDIDARVNLFECNIRVLGGLISAHLLAIDPNNRLIQGSYNNQLLRLAEDLGKRFLPAFETPTGLPYAWINLKNGVMENETTETSTSGCGSLVLEMGALSRLTGDPRFESAALRALRQLWRMRSSLDLLGTTLDVVTGEWIEYSSSIGAGVDSFYEYLLKAYILFGKEDYWRMFHSAYLASQKYFRHGPWYHEANMWSGKPTYWQLTSLQAFWPGLQVLVGDIAAANSSHREFFHVWEKFGVLPERYLLDHQIIHPTMKYYPLRPELAESTFYLYQATKDPWYLDVGESMVKSLNLYTKVPGGFASVRDVTTMQLEDHQHSFFLAETCKYLYLLFDDSFVAKRNYIFTTEGHPIQVVSSWHEKLPETYFSGNWTLSKSGAWESRASALSLQVCPLISLNSRHPEQQRESACHVLDEQINHKCWSNKECGVDATTCRLRTCSGVGYCGLWNPL

SEQ ID NO: 927 - DNA, 2430 bp, Candida glabrata CBS 138
  CDS (1)..(2430)
atgctgatcactgtcttatggctatgcacattgtgtgtagtactggcgagaccggaattaaattataaagagcggacttttaccaaatgggaattggatgaatacaaagcggaagtcaaagagttaatttattttggactggatgagtatttaggcaaagggtttccttacgacgaaataaggccaataagttgcaaaccaaagacaaggaattttaaggacctttatgatactggaaccaatgatgtgttaggaaatttcacaacgactctaatagactctttgaccacagtggcagttcttggtgatagagacaggtttaagtccttagtcgatttagttgactcaacttacccaaatggatttgatatggattctactgttcaagtctttgaaacaacaattagaataataggtggtttactctcaagtcacttgtacgcaacagacccaagtaagaaggtatatttgggcaaaaaagattataatggttgccttctgaaattggcaaaagacatgggagatagattattgccgtcttacttaaccaagacaggtttgccagttccaagaataaatttgaaatacaaatttcatggaataacaccagacttagtcaacgaaaacaatgctgcagctctaagttgtcctatgtttgagtttacattactttcctatttaacacatgacgctaagtatgaagagatcacgaagtatgctttcaaaaaaacatgggatttaaggtccgaaataggcttagtaccgatgtctttcaatccccaatattcgtattcatttggaggcgtaactggtataggtgcctcaattgattcgttttatgaatacgcactgaaaggttcaatcctatttgatgataattatcttcttgatgtttggcatagttcatacgatgcaataagaactcacgccaaggaagattggtattttaatacaatcggaacgagagacggccataaagccaccaattgggtggattccttgagtgcttttttccccggattgcaagttctggctggaaacattgaggactcggtttaccagcatatgctgtttttgaaattatgggatacttttggtggtattcctgaaagatggatgatggatggaatatatagttttagaccgctagaactgccctggtatccactgcgtccagagtttgttgaatccacttatttcttatatagagccaccaaggatcctttttatctaaatgttggatatcgaatcctccaagatttcaaatttagatttaagaaagagtgtggatttggtggtatgcaggatttaattagtggtgagccacaagatagaatggagacatttgttttgagtgaaacactaaagtacttatacttattatttgatgaagaaaatgaaatacatgccgatagaggtaatatcatttttagtacagaggcccatccgatgtggattacctatgaaatgaaaagagactataatgaaaagaagttcttcactgataaaacctatttggaacacttagaagaggttcaactttttgattgggataaaaaactgagggataataacgaaaagaataaggaattgttgaacaaatatgcagatgtattgaaaagaattaacaagtttagaaataaaaccaaagaggaactttctggcctgatgaaagaaaaaaaggaagaactggaagagaatggcatagttgagtctcacaacgctgaaattggacatagtcaatttaaggacgtgtgtaaggtaagcaaatatcgtcaaaatgatgctgggttttcattttctaatatcatgtcatcatttaaaagaatatcagagccggagaggatattcaacacaacactcataaagcctaattatctagatgattatgcaccatttgagtttgataaacagttctacgataggtggtgtccacgcaatgcatcatcatctcttgctgctacaacattaccatttgatattgttttagaacttccaggacaatatgaattatatcaatacccaaatgggactgttaatgcgatgaagcttggaaacaaaaggaagttacgtcttgaaagaataactcgtggcgatattgacgtgtatggagaatttgttagcgatgcagatttctctggagttaactgggacttagttcgacaaggaaatgctaagtatgaaaatggcactgcactaaagaataataaaagcctctatagagtagtgaagattgatggtgttgttatacctaggaaacaaatgctattcgttaattccacattgttcaaagaggtagtaagtttcgaggaactttatgaagatcctgaaatattgcataagagagacatcttacgtgcatttggtgtcaataaggatggctacttaattttcaatgacaccgttgtaagcaactgtaaaattatttaa

SEQ ID NO: 928 - protein, 809 aa, Candida glabrata CBS 138
MLITVLWLCTLCVVLARPELNYKERTFTKWELDEYKAEVKELIYFGLDEYLGKGFPYDEIRPISCKPKTRNFKDLYDTGTNDVLGNFTTTLIDSLTTVAVLGDRDRFKSLVDLVDSTYPNGFDMDSTVQVFETTIRIIGGLLSSHLYATDPSKKVYLGKKDYNGCLLKLAKDMGDRLLPSYLTKTGLPVPRINLKYKFHGITPDLVNENNAAALSCPMFEFTLLSYLTHDAKYEEITKYAFKKTWDLRSEIGLVPMSFNPQYSYSFGGVTGIGASIDSFYEYALKGSILFDDNYLLDVWHSSYDAIRTHAKEDWYFNTIGTRDGHKATNWVDSLSAFFPGLQVLAGNIEDSVYQHMLFLKLWDTFGGIPERWMMDGIYSFRPLELPWYPLRPEFVESTYFLYRATKDPFYLNVGYRILQDFKFRFKKECGFGGMQDLISGEPQDRMETFVLSETLKYLYLLFDEENEIHADRGNIIFSTEAHPMWITYEMKRDYNEKKFFTDKTYLEHLEEVQLFDWDKKLRDNNEKNKELLNKYADVLKRINKFRNKTKEELSGLMKEKKEELEENGIVESHNAEIGHSQFKDVCKVSKYRQNDAGFSFSNIMSSFKRISEPERIFNTTLIKPNYLDDYAPFEFDKQFYDRWCPRNASSSLAATTLPFDIVLELPGQYELYQYPNGTVNAMKLGNKRKLRLERITRGDIDVYGEFVSDADFSGVNWDLVRQGNAKYENGTALKNNKSLYRVVKIDGVVIPRKQMLFVNSTLFKEVVSFEELYEDPEILHKRDILRAFGVNKDGYLIFNDTVVSNCKII

SEQ ID NO: 929 - DNA, 2295 bp, Kluyveromyces lactis NRRL Y-1140
  CDS (1)..(2295)
atggaactgaatctcatttctttatggtttttcatatgggtcattctggtaagaactgttgactgttttaaagccgagccgtactctttcaccaagaacgaattgaaccaatataaggaccaagtcaaggagttattctatcatggattcaattcttatttagaatatggatacccgtatgatgaggtactacccatcgcgtgcgttcctatgaaacggagattcgatgatccttacgataccaataccaacgatgtcttgggtaatttcacgaccactttagtcgattcatttacgacactcgctgtattgggcgataagaagggattcgctgatgcaatcaatttatttcataaaacggtgcccgaaacttttgatattgactctacggtgcaattgtttgaaactacaattcgattactcggtgggatgatgtctgcgcatatatatgcaacagacccacgcaccaaggtttacttgggtaaagataactatgatggatttttgctacgaagatgtattgccctaggtgataagttgcttatggcatacctatctcccacaggtttacctgtacccaggataaatctccgttacggtactcggattgatcccaaacttattgaggagaataatgctgctgcgacagcatctccattgtttgaattcaggctgctttcgatgttgacgttgaatgatacttaccgcgaagtctctgaattttcattcaacagaacctgggatcttagatcagaattgaatctcgttccaatgtcgttcagtccatacgataccacgatatacaacgaggttacaggtattggtgcatcgattgattcattttacgaaactgctcttaagggttccatcttattcgatgattcgtggctctatagtgtgtgggaaactgcaatatccgcccttaactcttactcaaagacagattggttctacagtaacgttggagtatctcatggtaaaactgtcgttctttggatagattcgttaagtgctttctttcctggtctactgactttagatggaaggctggaagatgcaaggaagaaacacataatgttttccaaactatggtctacatacggtggtatcccagaaagatggaactttgtgcaatcgccaccgaccaccgaagaattagactcaccctcattgtcgatagatttagaatggtatccattgagaccggagttcattgaatcgacgtattacctttacagagccactaaagacgtttattatttgaatatcggtattcgaattctaaaagatctacagcatcgcttcaagactaggtgtggatttgcggggctacaggatgtgactactggagaagttcaagaccgaatggaatcatttgtcctaggggagacgttgaagtatctgtatttattgttcgatgaggataacgaattgcatacaacgctatggaatcatattttcagtacagaagcgcatccattctggatcgatgtgggtttaaagagacgttacgaatcatacaggagggaagcagacccacctcatgttactacagaaatgtaccagttccatttgctaaaggcgaaaaactggatgagaaggaccaaatctcctaacaggagaattaaccatgctaagaagaaactagatggccaatgtatttctcctgaactggcgtacaccaagagacaatcgaatagacaaggtttccaagattccgacgtgctatccgatccaaaactgtttgaaatagatttcagatatcaggctaccttggaacaacctgcatggaacaaaggatacatacctttcgagctaacaccagaactatactctcattggtctttctcccaacagaaaatttgtctggtcccattgacaaaagcattcgaaggaaccataggaagcagagacccggactcaacactgatatcgacacaccaatggtcttctgacgctcgaatgtaccggttccaatcaatctacggtatcaagatcgctttcctcgattttacatggcacccgaactctattgaagtgcaggaccctaactcgaaattcgatctatatgatgtcttgaacaagcaaaactgtaaacccaaagacgatacaagcatacatacctacacagtaaccgcaatagatggcattgaccttggtgacaacgacgtagtcgttgtcaataaatcaagcctcttcttcgatgactcgagcaaagagagctacatctcgataaatcgcaaatctcaactgctcatcaactgcataccaataactaatatcttcgttttgtaa

SEQ ID NO: 930 - protein, 764 aa, Kluyveromyces lactis NRRL Y-1140
MELNLISLWFFIWVILVRTVDCFKAEPYSFTKNELNQYKDQVKELFYHGFNSYLEYGYPYDEVLPIACVPMKRRFDDPYDTNTNDVLGNFTTTLVDSFTTLAVLGDKKGFADAINLFHKTVPETFDIDSTVQLFETTIRLLGGMMSAHIYATDPRTKVYLGKDNYDGFLLRRCIALGDKLLMAYLSPTGLPVPRINLRYGTRIDPKLIEENNAAATASPLFEFRLLSMLTLNDTYREVSEFSFNRTWDLRSELNLVPMSFSPYDTTIYNEVTGIGASIDSFYETALKGSILFDDSWLYSVWETAISALNSYSKTDWFYSNVGVSHGKTVVLWIDSLSAFFPGLLTLDGRLEDARKKHIMFSKLWSTYGGIPERWNFVQSPPTTEELDSPSLSIDLEWYPLRPEFIESTYYLYRATKDVYYLNIGIRILKDLQHRFKTRCGFAGLQDVTTGEVQDRMESFVLGETLKYLYLLFDEDNELHTTLWNHIFSTEAHPFWIDVGLKRRYESYRREADPPHVTTEMYQFHLLKAKNWMRRTKSPNRRINHAKKKLDGQCISPELAYTKRQSNRQGFQDSDVLSDPKLFEIDFRYQATLEQPAWNKGYIPFELTPELYSHWSFSQQKICLVPLTKAFEGTIGSRDPDSTLISTHQWSSDARMYRFQSIYGIKIAFLDFTWHPNSIEVQDPNSKFDLYDVLNKQNCKPKDDTSIHTYTVTAIDGIDLGDNDVVVVNKSSLFFDDSSKESYISINRKSQLLINCIPITNIFVL

SEQ ID NO: 931 - DNA, 2541 bp, Debaryomyces hansenii CBS767
  CDS (1)..(2541)
atgttctatacttcaataaacaatcgaattgcacttgtgacatgtatacttgcgtgtttctgttgcgtgcaatcattgaaataccaatacgaatcatccttcactccaaatcatatacaatatttgaaaaatgagacgagacttctattcaaacatgcatggtcgtcatacatgcaatatggatttccagcagatgaggtattaccggatacgtgtgagccttatggcccagattacaataatgtcgataacgtggtaagaaatgatgctttgggcaatacttctctgacgattctagacaatttggatactttaatgataatggaagaatgggaagagttagagagggctttagaataccttaaatcagaagagaagaccttatttaataaagatacaatagtgcaagtttttgaaactaccattcggtcgttaggtgggcttttatcgacacatctacttttgacagatgttactaaaggcaataaaatattgccatcaagataccaaaaattcaaggaaatatctgataactatgatgggtccttatcaaatatggcatatgatttgggacttaagttacttccagccttcaagacatccacagaaatacccgttcctcggattaatttggcaaaaggggtcttaaaagtaccatcaaatcttcaaaaagaaacttgtacatctggtgctgcgtcgccggttcttgaatttactcttctctcaaagctctcaggagacccgcaatttgaatactattcacaattgacgttttggaaactttggtcttccagactggcgcttgatttaatgccaatgtcaatagatccaattgcaaataaatggaaggatcaaattacaggaataggagcttccgttgattcattttatgagtatgcggctaaggcatctatactatttaatgatgattatatgtggcatgtatttaaaacctcgtataaagcattactagcccacctggtccaaggaggtggagataatgaaggagtgatgatatttggaaatgtaggggttaatgatggctcattggcttctatatggatagatctgctcggtgcattttggtcgggtctacaagtcttgactgggcaattgcaagatgcaattaaaacgcacttgatgtacttaaaattatgggatcattttgacctgattcctgaaagatggaactttttactaaataaatctcaattagagaacgatgattctgaagcgataatgcttgagtggtatccactaaggcccgagtttatcgagtctacatattacttatatagagcgactcgagacccaatgtacctacagatcggagctagagtacttgaattattacaaactaagtacaagacaatttgcggattccatggattacaggacataagaacaggaaattttcagaatagaatggagaccttcgttatgagtgaaacattgaagtatttaatgttattatttgatgctgataatgagatatttcttcatacaagcatgatgagcaataagaactggattttttcaaccgaagcgcatcctatgtggtttgataaacgattagatccatacaacttcacacattccagatctgccgataaacaaaacatgggtacgttgaaaaacctgctttttgctaagatgaagtcaaagtttagtagaagcaagcggaaattgaccactgctgatgaaaagacattctaccgaaacattactacaccacgagtgatcacatacgagatgcccggaataatagaaaatggggatatacacaagatcgatccattggaaagtaagtttgacaaatgtgaagtaaacgtatttaataataagccatcgatgttaacagtatccgggtattaccaattgagctctttcttctatccagatcatgcattcaaatactccctaataaagccacgttatcttctgaaatcggctcttgatggaagctgtgtagaattgacgccgtctttcctcagaatttttgcaatgtcaggacctgataatactaccaaataccatcaccagtgtcctagaacatcgaccactacataccttgaactagttttaggaaatatcgaaaaagcccaaagtgtcgagatttcaagattaaagtataagagaaagcaaccaactgagtatatttctcttcaagaagatgatttatgggttcctgacttttcctcgattagactaaagattgagaaattatcgtctggcttgatcgattccgaaaatatgttaatcactgactcattcatacaatccattagagttgacgattataatgccgagataggaatgtctgccgcgaatcaatctgtttctactacaaaggatatcctgttggtactcagaatcaagaaaatcaacggtatatctgttaagcccggccaggttgtatggacattaccatttgaaattaatacatcaatcataggtgactcatcaattggggttgcaagtgacaatagagtagtattacaaggcaatgtagttgaaaacttgaaggtatggtatggttaa

SEQ ID NO: 932 - protein, 846 aa, Debaryomyces hansenii CBS767
MFYTSINNRIALVTCILACFCCVQSLKYQYESSFTPNHIQYLKNETRLLFKHAWSSYMQYGFPADEVLPDTCEPYGPDYNNVDNVVRNDALGNTSLTILDNLDTLMIMEEWEELERALEYLKSEEKTLFNKDTIVQVFETTIRSLGGLLSTHLLLTDVTKGNKILPSRYQKFKEISDNYDGSLSNMAYDLGLKLLPAFKTSTEIPVPRINLAKGVLKVPSNLQKETCTSGAASPVLEFTLLSKLSGDPQFEYYSQLTFWKLWSSRLALDLMPMSIDPIANKWKDQITGIGASVDSFYEYAAKASILFNDDYMWHVFKTSYKALLAHLVQGGGDNEGVMIFGNVGVNDGSLASIWIDLLGAFWSGLQVLTGQLQDAIKTHLMYLKLWDHFDLIPERWNFLLNKSQLENDDSEAIMLEWYPLRPEFIESTYYLYRATRDPMYLQIGARVLELLQTKYKTICGFHGLQDIRTGNFQNRMETFVMSETLKYLMLLFDADNEIFLHTSMMSNKNWIFSTEAHPMWFDKRLDPYNFTHSRSADKQNMGTLKNLLFAKMKSKFSRSKRKLTTADEKTFYRNITTPRVITYEMPGIIENGDIHKIDPLESKFDKCEVNVFNNKPSMLTVSGYYQLSSFFYPDHAFKYSLIKPRYLLKSALDGSCVELTPSFLRIFAMSGPDNTTKYHHQCPRTSTTTYLELVLGNIEKAQSVEISRLKYKRKQPTEYISLQEDDLWVPDFSSIRLKIEKLSSGLIDSENMLITDSFIQSIRVDDYNAEIGMSAANQSVSTTKDILLVLRIKKINGISVKPGQVVWTLPFEINTSIIGDSSIGVASDNRVVLQGNVVENLKVWYG

SEQ ID NO: 933 - DNA, 2529 bp, Candida albicans SC5314
  CDS (1)..(2529): transl_table=12
atgtttttggggctatttcataattacatattcttggtaatactaagtctaaaaataatccccataaatgcatattctccatataattcatcattcacatctgaacatatacgatatttacaaaatgaaacacaagcattatttgatcattcatggaaatcatatatgaaatatggtttcccatttgatgaaataaccccaatcagttgtgaacctttaggacctgattttgatgactatgaaaataccgttagaaatgatgctagagggaatatatcactgatggtattagataatatcgatacattaataatatttgaacgatgggatgaattagaatatattttgaaatatcttctggataataaacaagattttttcaatcaagatactgtggtacaagtgtttgaaacttgtattcgtcatttaggtggattattatcggctcatttattattaaccgacattaccaataaaccaatcacattatcaacaaaatatcaaccattacgtgaaatttcaaacaaatataatgggtttttattggacatggctcatgatttaggattaagattaattccttcttatcaaacatcaacgacaaatatcccattaccaagaattaatttagcttatggtttgaaaaaagtcccacccaaattacaacgtgatgcatgtacttcaggggtaatgactccagttttagaattcactctattatcaagattaactggagatcgacaatttgaatattattcacaattatcattttggaaactttggtcactgaaactggcattaaatctattacctatgacaattgatcctattgctaatcaatggaaagatagtattaccggaataggtgctagtattgattcattttatgaatatgctgctaaactggcaattttatttaatgatgattatatgtggacagttttcaaaacttcatatcgagcattattgagtcatctggctcaaggtggtaaaggtacgatgattttccctaatgtggggatttatgatggggttgttttcagtccttggatagatctgttaggagcattttggtcaggattacaagttttaactgggcaattacaagacgccataaagactcatgtggtttatttaaaaatatgggactttttcgatctgattccagaaagatggatatataaccatcagcaccatcatcaaggtaataagaaagttaaacgtaataagaaaaaattcaaagcagaagattccattgatttggaatggtacccgttgagaccagaatttattgaatcaacttattatttatatcgtgccactaaagatccaatgtatttacaaataggggaaagagtattaaatttattaggtgatagatataaagcaccatgtggattaagtggattacaagatgttagaactgcagaaagacaagatcgaatggaatcatttgttgttggtgaaactttgaaatatttatatttattatttgatactaaagatgaaattttcttacacaattccactataatgcaaaataaaaattggattttctccactgaagcacatccattatggttaaataaaaaaatcgatcttattggtgattctttgacacaatcatcaaatgaaatatcatcggcaataatgggtgaaaaaccttatcataaaaatagtttaaaacccaataaagatttactcaaaataccaaattcagcgtttataagaaatattacattacctcaaccagaattggttgatattgaaggtataacggaggatgtatcccatattgccaaaaaactgccctttgcgggtcgatttgatacatgtcaattaaatccttggaataaatctgttgattcatttcttgaatcaagttattataaatggccctatttgtttaatgctgattatgcatttgaaaattcatttagaaaaccaagatatttgagtcaaactaatttagatggcagttatattgaattaacaaaagaattttacaataaatttactatgttcaatggagccaacttgatttgtcctcgtacttcaactacagcagtttatgaagtgttttggggagatatcaaacaatgcgaatacattgaagtttcagaaatttatcataccaagttttctaatgaatcgttaatggcaccgggtgatatttggataccgtctttgaacggattacgcgttgtattggaagaattggtacctgggaaagtagatacatttaataatgttgttactgaagaacagcttcttgcattacaggatagtaataataatgaagactataataacaataacgacgattacaggattagattagtaaattctggtttaagaattaaacgagtcaatggtgttgttattggtgaaggggtaactttatggacgctaccatttgaaccactggaacaatcgaatgaagaagacgggatgataggaataactgaagatgctagagtagttatacaaggtaaagtagttgaaaatttatttgtttggtatggatag

SEQ ID NO: 934 - protein, 842 aa, Candida albicans SC5314
MFLGLFHNYIFLVILSLKIIPINAYSPYNSSFTSEHIRYLQNETQALFDHSWKSYMKYGFPFDEITPISCEPLGPDFDDYENTVRNDARGNISSMVLDNIDTLIIFERWDELEYILKYLSDNKQDFFNQDTVVQVFETCIRHLGGLLSAHLLLTDITNKPITLSTKYQPLREISNKYNGFLLDMAHDLGLRLIPSYQTSTTNIPLPRINLAYGLKKVPPKLQRDACTSGVMTPVLEFTLLSRLTGDRQFEYYSQLSFWKLWSSKSALNLLPMTIDPIANQWKDSITGIGASIDSFYEYAAKSAILFNDDYMWTVFKTSYRALLSHSAQGGKGTMIFPNVGIYDGVVFSPWIDSLGAFWSGLQVLTGQLQDAIKTHVVYLKIWDFFDSIPERWIYNHQHHHQGNKKVKRNKKKFKAEDSIDLEWYPLRPEFIESTYYLYRATKDPMYLQIGERVLNLLGDRYKAPCGLSGLQDVRTAERQDRMESFVVGETLKYLYLLFDTKDEIFLHNSTIMQNKNWIFSTEAHPLWLNKKIDLIGDSLTQSSNEISSAIMGEKPYHKNSLKPNKDLLKIPNSAFIRNITLPQPELVDIEGITEDVSHIAKKSPFAGRFDTCQLNPWNKSVDSFLESSYYKWPYLFNADYAFENSFRKPRYLSQTNLDGSYIELTKEFYNKFTMFNGANLICPRTSTTAVYEVFWGDIKQCEYIEVSEIYHTKFSNESLMAPGDIWIPSLNGLRVVLEELVPGKVDTFNNVVTEEQLLALQDSNNNEDYNNNNDDYRIRLVNSGLRIKRVNGVVIGEGVTLWTLPFEPSEQSNEEDGMIGITEDARVVIQGKVVENLFVWYG

SEQ ID NO: 935 - DNA, 1713 bp, Medicago truncatula
  CDS (1)..(1713)
atgattcctcgtcgctactttttgacatgtctccttatctttcttctcgtactttccaccttctccttctctcactctcaaccccattggtcttccaagaaaaaacgcctcggagaaaaagttcgcaatatgtttcaccatgcctatgacaactatatgactcatgcatttccgcacgatgagctaaaacctctcacgaaaactttcaccgattccctaagcgagctgggaaatttgaagcttgaacgtttgccgcaagactacaatggttctgccctttcgctaattgaatcactgtctagccttgtgattatgggcaacaataccgaattcgagaagggagtacgctggctttcagaaaatctaaaatttgacgttgatgctcgcattaatctttttgagtgcaacattagagttcttggaggacttgtctctgctcatttactggcatctgattcttcaaagaagttgctacaaggatcttacaagaatgagctactaggcctggctgaagatttagggaaacgttttctaccagcgttcaatacgcctactggattaccatatgcatggattaacttgaagtatggagtaatggagaatgagactacagaaacaagcacttcagggtgtggttcgttgattcttgaaatgggtgctttatcaaaactgactggtgaccccatatatgaatcagtagctttacgagctctccgtaagctatggagtatgcagagcttattaaaattatttggaaccacacttgacgtgtcaactgggcaatggattgaacattcttcaggaattggagctggtgtagattccttctatgaatatctacttaaagctcatatccttttcggaaaggaggactattggagaatgtttcattctgcttatgttgcagtgcagaagcatttcagacacggtccctggtaccacgaagctgatatgaggacaggaagagcaacttattggcagcttacaagtcttcaagcattttggcctggcctacaggttcttattggggatatatctgctgctaattcatctcaccgtgagttcttctatgtgtggaagaaatttggagtgctgccagagaggtatttgctggaccatcagatgcttcatcctactgaaaaatattatccgttacgccctgagtttgctgagtcaacattctacttatatcaagctactaaagatccatggtatattgaagttggcgaattaatagtcaattcccttaatttacacacaagagtagaaggtgggtttgcaagcatcaaggatgtgacaactatgcagttagaagatcatcaacatagtttttttcttgctgaaacgtgtaaatatttgtatcttctctttgatgattcatttatggtcgacagtaattacgtatttaccactgaaggtcatccccttccagtactaagcacttggcatgaagagcttccacaaacatacattccaactaattggacaactctgaagagacaaccagcaaatcgagccagtgcaatgtcattgcaagtatgtcctgctatgactttaaattcaggtcaacatatagagagtgcttgccacatctccgatgttcgtagtgatcataggtgtttgactgataacgattgtggagttgatgcaactacctgtagaagaagatcatgtagcatggctggttattgtggactatggctcttcatttga

SEQ ID NO: 936 - protein, 570 aa, Medicago truncatula
MIPRRYFLTCLLIFLLVLSTFSFSHSQPHWSSKKKRLGEKVRNMFHHAYDNYMTHAFPHDELKPLTKTFTDSLSELGNLKLERLPQDYNGSALSLIESLSSLVIMGNNTEFEKGVRWLSENLKFDVDARINLFECNIRVLGGLVSAHLLASDSSKKLLQGSYKNELLGLAEDLGKRFLPAFNTPTGLPYAWINLKYGVMENETTETSTSGCGSLILEMGALSKLTGDPIYESVALRALRKLWSMQSLLKLFGTTLDVSTGQWIEHSSGIGAGVDSFYEYLLKAHILFGKEDYWRMFHSAYVAVQKHFRHGPWYHEADMRTGRATYWQLTSLQAFWPGLQVLIGDISAANSSHREFFYVWKKFGVLPERYLLDHQMLHPTEKYYPLRPEFAESTFYLYQATKDPWYIEVGELIVNSLNLHTRVEGGFASIKDVTTMQLEDHQHSFFLAETCKYLYLLFDDSFMVDSNYVFTTEGHPLPVLSTWHEELPQTYIPTNWTTLKRQPANRASAMSLQVCPAMTLNSGQHIESACHISDVRSDHRCLTDNDCGVDATTCRRRSCSMAGYCGLWLFI

SEQ ID NO: 937 - DNA, 2925 bp, Aspergillus oryzae
  CDS (1)..(2925)
atgcggtcgggatgttggtacttacagatgcccttcctccgtgcagaatgggtgatgaattggatcatgttgctctcgctgtggcttaccatggcttggggtatgaggacagatcagcttaatgaactcagaaaggacactgagcatatgttctaccacggtttcgacaactacattacgcatgcctttcccgaagacgagctacgccctctatcctgccgtccgctagttcgcgaccgagatacccttgcgaatgcaggattgaacgacgttctggggaattactcattgaccttgatcgacagcctatcttcactagcgatactgtcatctagcccagacgatggtgcaagagcttgggcacatttccaggatggtgtgagggactttgtgaagctgtacggtgatggctcagatggccctgctggccagggcgaaagaagccgcgggtttgacatagacagtaaagttcaagtcttcgagacggtcattcggggactaggcggactacttagcgctcatttgttttctgtgggcgatcttcccattacgatatacagccctcctgaagccgaggtcgcattcgccaaagcttgggataagacttcattccccctaaatacacagggaatcaaatgggagaatggattcgtttacaatggccaatttttgcgacttgctgttgatctggcgaatcgtctgttgcctgccttctatactgagaccggtcttccttatccccgtgtcaatctgcgatatggagtccgacggcacccattctatgcaaactcgccgctaaatgccgccttctcgtgcgacaatactaaagatcacgagaattgtaagtctcgtcgcattccattggtagaaacgacggagacatgcagcgcgggcgctggcagcttagtcttggagtttactgtcttgagccggcttaccggagatggccggtatgaggagttgggtaaaagagccttttgggcggtttgggcaagaagaagtgatattgggttagtcggggcaggcatcgatgcagaatcgggtaaatgggttcatccttacacagggatcggtgcaggaattgacagcttctttgaatatgctttcaaatcgtatatcctgctgtcatcaggggaacggttcccgcgcgatctcaatagttcgtggcatgccttcgacaatgactttccaccactaagcgagtacgagaattctgcagaagcctttttgcaagcctggcaagaatcacacgcttcagtaaagcgtcatttgtatcgtggagaaggctatcagcacccacatttaatccaaggagatgttttcactggcgccacgcgggcgttttggatcgatagcctgagcgccttttacccaggtctcctaagcttggcaggagagatagatgaggccgtagggattcatcttctgacaacggctgtttggacccggttttcaggcctccctgaaagatggaatgtcgttacgggggacatagaggggggtctggcatggtacagtggccggcccgaatttgctgaatcaacgttttatctctatcaagccaccaaggacccttggtacttacatgttggcgagatggtactacgcgatcttaaaagacggtgctggactaaatgcggctgggctggccttcaagacgtccgcagtgactatgcgaagggccgcccaagcgtgacaatggctgatttgtcttcaccgacgaattacacattcttcccttggactttgccagctgagttagtgcctttcaatgcaacgagctcaccaatgacagttcgccccacacttgacatttcgttcccgtctcttcccggcatgttcttggggtccggctccttggaacgagtccaagatggcattctcatcaaggccatcggagggctccggttgagcatggttcaagatgtttccccacagaatgaggctggcacgaaaaatgcagagtttcgaatacaagtgattaacaatgtaccgcttggaaaagacgagaaggtatatatctcacgggagatcacattcgatgtcctggatcccactgatccgaatttcactcgcgtgcgcgactccgcaatgatcgacatcgtcattgacgttatcccagagaacctccgccgaaggaatcattcaggtgatccacagggatcgactgctgagcatagcccaaagcatatcatcggcgagtcctccgctgacgacaaacttggagccgtagatccgtcggcgtcgagcgtaaagagtgctttatcgtcctttgtgaatcatgtgtcctggttactctgggacgagtctcaaccccaatctgcctggccggctgcggagaaaaagccatttctacgattaacgttacccgctgctatggcttctggtttaggctctgcgcccatgcctgatgtagaggactcctctacattttctgtcacgggggatgtccccaaaagtcgactcccatggtctacgatctacttcgccgatgagctctgtgaccatcggatcctacgtgacatcgcacaaactcaccaagtgcttgtcatcaagcgaggcgggtgcagtttctcgcaaaagctgaggagtatcgctgcatatccaccctcacgacatgcgctaaggctcgttattgttgtctcctacgaggaggagccaatagacgagaatttagaaccacaagttaatcctttctcgagcctagctgccgtccgcgcggagccatatcttgttcggccataccttgacgaaactcaaatgaccgccggaggggtgcctcgtcgtcatctaatcagcctggtcatggtcggtggcggagcggaaacatatgaactactccgccaagccacgggcgtcggcatcaagcgacggtatactgtgcgatcgcagggcataccagttagtaacctatatatcatctag

SEQ ID NO: 938 - protein, 974 aa, Aspergillus oryzae
MRSGCWYLQMPFLRAEWVMNWIMLLSLWLTMAWGMRTDQLNELRKDTEHMFYHGFDNYITHAFPEDELRPLSCRPLVRDRDTLANAGLNDVLGNYSLTLIDSLSSLAILSSSPDDGARAWAHFQDGVRDFVKLYGDGSDGPAGQGERSRGFDIDSKVQVFETVIRGLGGLLSAHLFSVGDLPITIYSPPEAEVAFAKAWDKTSFPLNTQGIKWENGFVYNGQFLRLAVDLANRLLPAFYTETGLPYPRVNLRYGVRRHPFYANSPLNAAFSCDNTKDHENCKSRRIPLVETTETCSAGAGSLVLEFTVLSRLTGDGRYEELGKRAFWAVWARRSDIGLVGAGIDAESGKWVHPYTGIGAGIDSFFEYAFKSYILLSSGERFPRDLNSSWHAFDNDFPPLSEYENSAEAFLQAWQESHASVKRHLYRGEGYQHPHLIQGDVFTGATRAFWIDSLSAFYPGLLSLAGEIDEAVGIHLLTTAVWTRFSGLPERWNVVTGDIEGGLAWYSGRPEFAESTFYLYQATKDPWYLHVGEMVLRDLKRRCWTKCGWAGLQDVRSDYAKGRPSVTMADLSSPTNYTFFPWTLPAELVPFNATSSPMTVRPTLDISFPSLPGMFLGSGSLERVQDGILIKAIGGLRLSMVQDVSPQNEAGTKNAEFRIQVINNVPLGKDEKVYISREITFDVLDPTDPNFTRVRDSAMIDIVIDVIPENLRRRNHSGDPQGSTAEHSPKHIIGESSADDKLGAVDPSASSVKSALSSFVNHVSWLLWDESQPQSAWPAAEKKPFLRLTLPAAMASGLGSAPMPDVEDSSTFSVTGDVPKSRLPWSTIYFADELCDHRILRDIAQTHQVLVIKRGGCSFSQKLRSIAAYPPSRHALRLVIVVSYEEEPIDENLEPQVNPFSSLAAVRAEPYLVRPYLDETQMTAGGVPRRHLISLVMVGGGAETYELLRQATGVGIKRRYTVRSQGIPVSNLYII

SEQ ID NO: 939 - DNA, 2485 bp, Oryza sativa subsp
  CDS (54)..(2084)
gcgtgctctgtatcattattaccatcccgatgcccacctcgggcccggacgcgatgcagccggcgctgcgacggcggcggcggcgccaaggcttcctcctccccttcgcctgcctctccgccgccctcatcgccgctgccctgctccccggcgccgctttcgccgatggcgtcacgccctccgaggcccgccggctccgcgacgaggtcaaagatatgttctatcatgcatttgatgggtacatgcaacatgcttttccacttgatgaattgcggcctttaagttgccaaggagaagattcacttggtggctatgcacttactcttatagactctttggataccttggctttactaggggataaggagagatttgatgctgccgtggagtgggttggtaagaatgtccgctttgatattaataaaactgtctctgtttttgaaaccaacatacgcattcttgggggtctgctatcagctcacctgattgccagtgattatgcaactggaatgagaattcaatcttatgatgatcagttgcttcatttagcggctgacttagctcaaagattgctacctgcatttgacactccaacaggtattccatttggatcagtaaatttattgtatggagtcgatgaaaatgaaagcaagataacttcaacagctggtggtggcactttgacactggaatttggtgtcctgagtcgtttgactaatgatagcgtttatgaacgagttacaaaaaactctgtgcgtggaatatgggcacgcaggtcgaaacttgaccttgttggtgcccatataaatgtatttactggtgaatggacacagaaggatgcaggaattggcacaagcattgactcattctatgagtatcttctaaaggcgtatttattatttggagatgaagaatatttgtatatatttcaggaggcttacaaggctgccatgcattatctccatcatgatccctggtatgtggaggtaaatatgaattctggtgctactgtttggccactattcaacagtctccaggcattctggccaggacttcaggtgttagctggagatgttgatcctgccattcgaactcatgctgccttcttcagtgtatggaaaaaatatggcttcaccccagaagggtttaatcttgctacatccactgttcagaatggacaaaggagctacccgctgcggcctgaattgattgaaagcacatattggctgttcaaggctactagagattataggtaccttgatgttggaagggatatattagcaagccttcaatatggtgctaaatgtccatgtggttactgccatatttcagatgtagaaacccaccagcaggatgaccacatggagagttttttccttgcagaaacagtcaaatatctctggcttctttttgatttagctgcaggccctgataatattgttgaaaatgggccatataaatacatatttagtacagaaggtcatctgttgcctgctactcctcagataaccttgttagatgagcattgcttgtatgctggagcattctgcaatggtactgcaggccatggatatggtaccggtgatagttctaataagcatcaaaatgcaaactctgttccgttcgatgatagtcgaacaccttccgatcaatctttatccaatattttgtctacgacaagagggtacatcaagggagtttgtccaggattaactcatgcccagaaacttggcatatcatactctgccgaggaggataactcaatacagcagaattctggaagtagtgagaatcttgatgaatcacacgtgatcaaatccagtgtccaagctcaatcaagttctgttatattgatatcgcatccagtcgcaagccaaactgaggagcctacgtcgggcagaagtcagtacaatgcaaacattgtggcaactgctgagtctgtagggactgatactgccggcgcctcatcccaccccgaggatcttgttaaggaaactgagagcgtctctgaacagaaagaaatcaatgacaaagagatcgcttctcagggtagtcaaccgaccgaaggaagatacctgacctaatgtaggaacgaaaactttcacttaaactggataccatcatttcagggcttaccatattacaagtctgcacgtcaggttacaaaacaacaagtgttgatacaaggcccatagatcagtacctcctgaccacagttgaattatagtgaaaatgaaaaatctcgcaatgggactacccttgagtggatctgtggtctcgatacacaacatttggatttaccacaaggcatcagctgtgttctttctgacaaatttagaacgagcattccttgattcattctgtttgtaactttgtactggtccgatagattcttctgatcaaatagcggctgtatagtattgtacactagagcaatcaacaaactgaatgtccaaatgactcatacatgggccagattccatcc

SEQ ID NO: 940 - protein, 676 aa, Oryza sativa subsp
MQPALRRRRRRQGFLLPFACLSAALIAAALLPGAAFADGVTPSEARRLRDEVKDMFYHAFDGYMQHAFPLDELRPLSCQGEDSLGGYALTLIDSLDTLALLGDKERFDAAVEWVGKNVRFDINKTVSVFETNIRILGGLLSAHLIASDYATGMRIQSYDDQLLHLAADLAQRLLPAFDTPTGIPFGSVNLLYGVDENESKITSTAGGGTLTLEFGVLSRLTNDSVYERVTKNSVRGIWARRSKLDLVGAHINVFTGEWTQKDAGIGTSIDSFYEYLLKAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYGAKCPCGYCHISDVETHQQDDHMESFFLAETVKYLWLLFDLAAGPDNIVENGPYKYIFSTEGHLLPATPQITLLDEHCLYAGAFCNGTAGHGYGTGDSSNKHQNANSVPFDDSRTPSDQSLSNILSTTRGYIKGVCPGLTHAQKLGISYSAEEDNSIQQNSGSSENLDESHVIKSSVQAQSSSVILISHPVASQTEEPTSGRSQYNANIVATAESVGTDTAGASSHPEDLVKETESVSEQKEINDKEIASQGSQPTEGRYLT

SEQ ID NO: 941 - DNA, 24 bp, Artificial sequence
  primer
atggtttgctgcttatgggtgctt

SEQ ID NO: 942 - DNA, 27 bp, Artificial sequence
  primer
tcatacaataaataagttgatgatggg

SEQ ID NO: 943 - protein, 585 aa, Artificial sequence
  consensus sequence
  Variant (2)..(2): Xaa in position 2 is any amino acid
  Variant (4)..(7): Xaa in position 4 to 7 is any amino acid
  Variant (9)..(12): Xaa in position 9 to 12 is any amino acid
  Variant (15)..(15): Xaa in position 15 is any amino acid
  Variant (18)..(19): Xaa in position 18 to 19 is any amino acid
  Variant (21)..(34): Xaa in position 21 to 34 is any amino acid
  Variant (35)..(49): Xaa in position 35 to 49 is any or no amino acid
  Variant (52)..(53): Xaa in position 52 to 53 is any amino acid
  Variant (56)..(57): Xaa in position 56 to 57 is any amino acid
  Variant (59)..(79): Xaa in position 59 to 79 is any amino acid
  Variant (80)..(102): Xaa in position 80 to 102 is any or no amino acid
  Variant (104)..(111): Xaa in position 104 to 111 is any amino acid
  Variant (114)..(115): Xaa in position 114 to 115 is any amino acid
  Variant (118)..(118): Xaa in position 118 is any amino acid
  Variant (123)..(123): Xaa in position 123 is any amino acid
  Variant (125)..(125): Xaa in position 125 is any amino acid
  Variant (128)..(130): Xaa in position 128 to 130 is any amino acid
  Variant (132)..(140): Xaa in position 132 to 140 is any amino acid
  Variant (141)..(170): Xaa in position 141 to 170 is any or no amino acid
  Variant (172)..(174): Xaa in position 172 to 174 is any amino acid
  Variant (177)..(178): Xaa in position 177 to 178 is any amino acid
  Variant (180)..(181): Xaa in position 180 to 181 is any amino acid
  Variant (183)..(184): Xaa in position 183 to 184 is any amino acid
  Variant (186)..(186): Xaa in position 186 is any amino acid
  Variant (190)..(191): Xaa in position 190 to 191 is any amino acid
  Variant (193)..(193): Xaa in position 193 is any amino acid
  Variant (194)..(194): Xaa in position 194 is any or no amino acid
  Variant (197)..(197): Xaa in position 197 is any amino acid
  Variant (199)..(202): Xaa in position 199 to 202 is any amino acid
  Variant (205)..(226): Xaa in position 205 to 226 is any amino acid
  Variant (227)..(257): Xaa in position 227 to 257 is any or no amino acid
  Variant (259)..(261): Xaa in position 259 to 261 is any amino acid
  Variant (264)..(264): Xaa in position 264 is any amino acid
  Variant (267)..(267): Xaa in position 267 is any amino acid
  Variant (269)..(271): Xaa in position 269 to 271 is any amino acid
  Variant (273)..(282): Xaa in position 273 to 282 is any amino acid
  Variant (284)..(285): Xaa in position 284 to 285 is any amino acid
  Variant (288)..(288): Xaa in position 288 is any amino acid
  Variant (290)..(290): Xaa in position 290 is any amino acid
  Variant (292)..(308): Xaa in position 292 to 308 is any amino acid
  Variant (312)..(314): Xaa in position 312 to 314 is any amino acid
  Variant (321)..(322): Xaa in position 321 to 322 is any amino acid
  Variant (324)..(326): Xaa in position 324 to 326 is any amino acid
  Variant (329)..(340): Xaa in position 329 to 340 is any amino acid
  Variant (341)..(369): Xaa in position 341 to 369 is any or no amino acid
  Variant (371)..(371): Xaa in position 371 is any amino acid
  Variant (373)..(390): Xaa in position 373 to 390 is any amino acid
  Variant (391)..(397): Xaa in position 391 to 397 is any or no amino acid
  Variant (399)..(406): Xaa in position 399 to 406 is any amino acid
  Variant (409)..(409): Xaa in position 409 is any amino acid
  Variant (412)..(413): Xaa in position 412 to 413 is any amino acid
  Variant (417)..(417): Xaa in position 417 is any amino acid
  Variant (419)..(419): Xaa in position 419 is any amino acid
  Variant (421)..(424): Xaa in position 421 to 424 is any amino acid
  Variant (426)..(428): Xaa in position 426 to 428 is any amino acid
  Variant (430)..(435): Xaa in position 430 to 435 is any amino acid
  Variant (437)..(442): Xaa in position 437 to 442 is any amino acid
  Variant (445)..(459): Xaa in position 445 to 459 is any amino acid
  Variant (460)..(477): Xaa in position 460 to 477 is any or no amino acid
  Variant (484)..(485): Xaa in position 484 to 485 is any amino acid
  Variant (489)..(490): Xaa in position 489 to 490 is any amino acid
  Variant (493)..(493): Xaa in position 493 is any amino acid
  Variant (496)..(496): Xaa in position 496 is any amino acid
  Variant (498)..(499): Xaa in position 498 to 499 is any amino acid
  Variant (502)..(503): Xaa in position 502 to 503 is any amino acid
  Variant (505)..(510): Xaa in position 505 to 510 is any amino acid
  Variant (512)..(515): Xaa in position 512 to 515 is any amino acid
  Variant (517)..(519): Xaa in position 517 to 519 is any amino acid
  Variant (521)..(525): Xaa in position 521 to 525 is any amino acid
  Variant (528)..(533): Xaa in position 528 to 533 is any amino acid
  Variant (535)..(538): Xaa in position 535 to 538 is any amino acid
  Variant (540)..(542): Xaa in position 540 to 542 is any amino acid
  Variant (545)..(545): Xaa in position 545 is any amino acid
  Variant (549)..(549): Xaa in position 549 is any amino acid
  Variant (554)..(562): Xaa in position 554 to 562 is any amino acid
  Variant (563)..(578): Xaa in position 563 to 578 is any or no amino acid
  Variant (581)..(581): Xaa in position 581 is any amino acid
  Variant (584)..(584): Xaa in position 584 is any amino acid
FXHXXXXYXXXXFPXDEXXPXXXXXXXXXXXXXXXXXXXXXXXXXXXXXTLXXSLXXLXXXXXXXXXXXXXXXXXXXXXXXXXXXXXXXXXXXXXXXXXXXXFXXXXXXXXFEXXIRXLGGLXSXHLXXXDXXXXXXXXXXXXXXXXXXXXXXXXXXXXXXXXXXXXXXXYXXXLLXXAXXLXXRXLPAXXTXXTGXPXXXXNLXXXXXXXXXXXXXXXXXXXXXXXXXXXXXXXXXXXXXXXXXXXXXXXXXXXXXEXXXLSXLTXDXXXEXXXXXXXXXXWXXRSXLXLXXXXXXXXXXXXXXXXXGIGXXXDSFYEYXXKXXXLFXXXXXXXXXXXXXXXXXXXXXXXXXXXXXXXXXXXXXXXXXYXAXXXXXXXXXXXXXXXXXXXXXXXXXGXXXXXXXXSLXAFXXGLQXLXGXXXXAXXXHXXXXXXWXXXXXXPEXXXXXXXXXXXXXXXXXXXXXXXXXXXXXXXXXYPLRPEXXESTXXLYXATXDXXYLXXGXXXXXXLXXXXKXXXGXXXXXDVXXXXXXDXXXXFXXXETXKYLXLLFDXXXXXXXXXXXXXXXXXXXXXXXXXIFXTEXH

SEQ ID NO: 944 - protein, 36 aa, Artificial sequence
  protein pattern
  Variant (2)..(2): Xaa in position 2 is any or no amino acid
  Variant (8)..(8): Xaa in position 8 is Phe or Leu
  Variant (9)..(9): Xaa in position 9 is any amino acid
  Variant (13)..(13): Xaa in position 13 is any or no amino acid
  Variant (15)..(15): Xaa in position 15 is any or no amino acid
  Variant (17)..(17): Xaa in position 17 is Phe or Tyr
  Variant (18)..(18): Xaa in position 18 is any amino acid
  Variant (21)..(21): Xaa in position 21 is Lys or Arg
  Variant (23)..(24): Xaa in position 23 to 24 is any amino acid
  Variant (27)..(27): Xaa in position 27 is Asp, Glu, Asn or Gln
  Variant (28)..(28): Xaa in position 28 is Ala, Ile or Val
  Variant (30)..(31): Xaa in position 30 to 31 is any amino acid
  Variant (32)..(32): Xaa in position 32 is Phe, Ile, Leu, Met or Val
  Variant (33)..(33): Xaa in position 33 is Ile, Leu or Val
  Variant (34)..(35): Xaa in position 34 to 35 is any amino acid
  Variant (36)..(36): Xaa in position 36 is Phe or Leu
YXPLRPEXXESTXYXLXXATXDXXYLXXGXXXXXXX

SEQ ID NO: 945 - protein, 40 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Phe or Trp
  Variant (7)..(7): Xaa in position 7 is Pro or Ser
  Variant (11)..(11): Xaa in position 11 is Thr or Val
  Variant (13)..(13): Xaa in position 13 is any amino acid
  Variant (15)..(15): Xaa in position 15 is Asp, Asn or Gln
  Variant (16)..(16): Xaa in position 16 is Ile, Leu or Val
  Variant (17)..(17): Xaa in position 17 is Ala, Asp, Glu, Gln or Ser
  Variant (18)..(18): Xaa in position 18 is Ala, Asp or Pro
  Variant (19)..(19): Xaa in position 19 is Ala or Ser
  Variant (20)..(21): Xaa in position 20 to 21 is any amino acid
  Variant (22)..(22): Xaa in position 22 is Asn, Gln, Ser or Thr
  Variant (24)..(25): Xaa in position 24 to 25 is any amino acid
  Variant (26)..(26): Xaa in position 26 is Phe or Tyr
  Variant (27)..(28): Xaa in position 27 to 28 is any amino acid
  Variant (29)..(29): Xaa in position 29 is Ile, Leu, Met or Val
  Variant (31)..(32): Xaa in position 31 to 32 is any amino acid
  Variant (33)..(33): Xaa in position 33 is Phe or Tyr
  Variant (34)..(34): Xaa in position 34 is Asp or Gly
  Variant (35)..(36): Xaa in position 35 to 36 is any amino acid
  Variant (39)..(39): Xaa in position 39 is any amino acid
  Variant (40)..(40): Xaa in position 40 is Phe, Trp or Tyr
LXXXFXXGLQXLXGXXXXXXXXHXXXXXXWXXXXXXPEXX

SEQ ID NO: 946 - protein, 27 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is any amino acid
  Variant (8)..(8): Xaa in position 8 is Phe or His
  Variant (9)..(9): Xaa in position 9 is Ala, Gly or Ser
  Variant (10)..(10): Xaa in position 10 is Phe, Trp or Tyr
  Variant (11)..(11): Xaa in position 11 is any amino acid
  Variant (12)..(12): Xaa in position 12 is Gly, Asn or Ser
  Variant (14)..(14): Xaa in position 14 is Ile, Leu or Met
  Variant (15)..(16): Xaa in position 15 to 16 is any amino acid
  Variant (17)..(17): Xaa in position 17 is Ala or Gly
  Variant (18)..(18): Xaa in position 18 is Phe or Tyr
  Variant (20)..(20): Xaa in position 20 is any amino acid
  Variant (23)..(23): Xaa in position 23 is Ile, Leu or Val
  Variant (24)..(24): Xaa in position 24 is any amino acid
  Variant (26)..(26): Xaa in position 26 is any amino acid
  Variant (27)..(27): Xaa in position 27 is Ala, Ser or Thr
EXXXXFXXXXXXYXXXXXPXDEXXPXX

SEQ ID NO: 947 - protein, 53 aa, Artificial sequence
  protein pattern
  Variant (2)..(2): Xaa in position 2 is Asn or Thr
  Variant (3)..(3): Xaa in position 3 is any amino acid
  Variant (4)..(4): Xaa in position 4 is Ala, Ser, Thr or Val
  Variant (5)..(7): Xaa in position 5 to 7 is any amino acid
  Variant (8)..(8): Xaa in position 8 is Ala, Gly or Ser
  Variant (9)..(9): Xaa in position 9 is Cys, Ser or Thr
  Variant (10)..(10): Xaa in position 10 is Ala, Leu or Pro
  Variant (11)..(12): Xaa in position 11 to 12 is any amino acid
  Variant (13)..(13): Xaa in position 13 is Glu or Gly
  Variant (14)..(16): Xaa in position 14 to 16 is any amino acid
  Variant (18)..(22): Xaa in position 18 to 22 is any or no amino acid
  Variant (24)..(24): Xaa in position 24 is any amino acid
  Variant (26)..(26): Xaa in position 26 is Ser or Thr
  Variant (27)..(27): Xaa in position 27 is any amino acid
  Variant (28)..(28): Xaa in position 28 is Asp or Asn
  Variant (29)..(29): Xaa in position 29 is Ala, Asp, Gly, Pro or Ser
  Variant (30)..(30): Xaa in position 30 is any amino acid
  Variant (31)..(31): Xaa in position 31 is Phe or Tyr
  Variant (32)..(32): Xaa in position 32 is Glu or Arg
  Variant (33)..(34): Xaa in position 33 to 34 is any amino acid
  Variant (35)..(35): Xaa in position 35 is Ala, Gly, Ser or Thr
  Variant (36)..(37): Xaa in position 36 to 37 is any amino acid
  Variant (38)..(38): Xaa in position 38 is Ala, Ser or Thr
  Variant (39)..(39): Xaa in position 39 is Phe, Leu or Val
  Variant (40)..(42): Xaa in position 40 to 42 is any amino acid
  Variant (44)..(45): Xaa in position 44 to 45 is any amino acid
  Variant (46)..(46): Xaa in position 46 is Gln or Arg
  Variant (47)..(48): Xaa in position 47 to 48 is any amino acid
  Variant (49)..(49): Xaa in position 49 is Ile or Leu
  Variant (50)..(50): Xaa in position 50 is any amino acid
  Variant (52)..(52): Xaa in position 52 is Phe, Leu, Met or Val
  Variant (53)..(53): Xaa in position 53 is Gly or Pro
EXXXXXXXXXXXXXXXLXXXXXSXLXXXXXXXXXXXXXXXXXWXXXXXXXLXX

SEQ ID NO: 948 - protein, 26 aa, Artificial sequence
  protein pattern
  Variant (2)..(5): Xaa in position 2 to 5 is any or no amino acid
  Variant (7)..(10): Xaa in position 7 to 10 is any amino acid
  Variant (11)..(11): Xaa in position 11 is any or no amino acid
  Variant (13)..(13): Xaa in position 13 is Phe or Val
  Variant (14)..(14): Xaa in position 14 is Leu or Val
  Variant (15)..(15): Xaa in position 15 is Ala, Gly or Ser
  Variant (18)..(18): Xaa in position 18 is any amino acid
  Variant (22)..(22): Xaa in position 22 is Phe, Trp or Tyr
  Variant (25)..(25): Xaa in position 25 is Phe or Tyr
EXXXXDXXXXXFXXXETXKYLXLLXD

SEQ ID NO: 949 - protein, 25 aa, Artificial sequence
  protein pattern
  Variant (2)..(2): Xaa in position 2 is any amino acid
  Variant (3)..(3): Xaa in position 3 is Asp, Gly or Asn
  Variant (4)..(4): Xaa in position 4 is any amino acid
  Variant (5)..(5): Xaa in position 5 is Phe or Leu
  Variant (7)..(7): Xaa in position 7 is any amino acid
  Variant (8)..(8): Xaa in position 8 is Leu or Met
  Variant (10)..(10): Xaa in position 10 is any amino acid
  Variant (11)..(11): Xaa in position 11 is Asp or Asn
  Variant (12)..(12): Xaa in position 12 is Leu or Met
  Variant (13)..(13): Xaa in position 13 is Ala or Gly
  Variant (14)..(14): Xaa in position 14 is any amino acid
  Variant (16)..(16): Xaa in position 16 is any or no amino acid
  Variant (18)..(18): Xaa in position 18 is any or no amino acid
  Variant (20)..(20): Xaa in position 20 is Ala or Ser
  Variant (21)..(21): Xaa in position 21 is Phe or Tyr
  Variant (22)..(22): Xaa in position 22 is any amino acid
  Variant (24)..(24): Xaa in position 24 is any amino acid
YXXXXLXXAXXXXXRXLXPXXXTXT

SEQ ID NO: 950 - protein, 22 aa, Artificial sequence
  protein pattern
  Variant (2)..(5): Xaa in position 2 to 5 is any amino acid
  Variant (6)..(6): Xaa in position 6 is any or no amino acid
  Variant (8)..(8): Xaa in position 8 is Ile or Val
  Variant (9)..(9): Xaa in position 9 is Asp or Glu
  Variant (11)..(13): Xaa in position 11 to 13 is any or no amino acid
  Variant (15)..(15): Xaa in position 15 is Ala, Asp, Ser, Thr or Val
  Variant (16)..(16): Xaa in position 16 is Ser, Thr or Val
  Variant (17)..(17): Xaa in position 17 is Ile, Leu or Val
  Variant (18)..(18): Xaa in position 18 is Ala, Gly or Val
  Variant (19)..(21): Xaa in position 19 to 21 is any amino acid
  Variant (22)..(22): Xaa in position 22 is Asp, Glu, Gly, Asn or Ser
GXXXXXLXXSXXXLXXXXXXXX

SEQ ID NO: 951 - protein, 15 aa, Artificial sequence
  protein pattern
  Variant (2)..(2): Xaa in position 2 is any amino acid
  Variant (3)..(6): Xaa in position 3 to 6 is any or no amino acid
  Variant (9)..(9): Xaa in position 9 is Ser or Thr
  Variant (12)..(12): Xaa in position 12 is Ala or Gly
  Variant (14)..(14): Xaa in position 14 is Leu or Pro
  Variant (15)..(15): Xaa in position 15 is Phe, Ile, Leu or Met
NXXXXXIFXTEXHXX

SEQ ID NO: 952 - DNA, 459 bp, Saccharomyces cerevisiae
  CDS (1)..(459)
atgtggtttcctcagatcattgctgggatggctgctggtggtgccgctagtgctatgactccaggcaaggttctctttactaatgctttgggtttaggctgttccagatctagggggttgtttttggaaatgtttggtactgctgtgttgtgtttaacagttttgatgactgctgttgaaaaacgtgaaactaactttatggctgcgcttccaattggtatttctttattcatggctcacatggctttgaccggttacactggtaccggtgtcaaccctgcaagatctctgggtgccgccgttgctgccagatatttccctcattaccactggatctactggattagcccacttttgggtgccttcttagcctggtcagtgtggcaattattacaaatccttgattacactacatacgttaatgccgaaaaggcggcaggtcaaaagaaggaagactga

SEQ ID NO: 953 - protein, 152 aa, Saccharomyces cerevisiae
MWFPQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWISPLLGAFLAWSVWQLLQILDYTTYVNAEKAAGQKKED

SEQ ID NO: 954 - DNA, 867 bp, Oryza sativa (japonica cultivar-group)
  CDS (1)..(867)
atggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcgcccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccgatccttgccccactgccaatcgggtttgcggtgttcttggttcacctggccaccatccccatcaccggcaccggcatcaacccagcgaggagccttggcgctgccatcatctacaacaggggccatgcctgggatgaccattggatcttctgggttggccccttcattggcgctgcccttgctgccatctaccaccaggtggtcatcagggcaattccattcaagagcaggtcgtaa

SEQ ID NO: 955 - protein, 288 aa, Oryza sativa (japonica cultivar-group)
MEGKEEDVRLGANKFSERQPIGTAAQGSDDKDYKEPPPAPLFEPGELKSWSFYRAGIAEFMATFLFLYITVLTVMGVNNSTSKCATVGIQGIAWSFGGMIFALVYCTAGISGAHINPAVTFGLFLARKLSLTRALFYMVMQCLGAICGAGVVKGFQKGLYETTGGGANVVAPGYTKGDGLGAEIVGTFILVYTVFSATDAKRNARDSHVPILAPLPIGFAVFLVHLATIPITGTGINPARSLGAAIIYNRGHAWDDHWIFWVGPFIGAALAAIYHQVVIRAIPFKSRS

SEQ ID NO: 956 - DNA, 918 bp, Saccharomyces cerevisiae
  CDS (1)..(918)
atgtcttcgaacgattcgaacgataccgacaagcaacatacacgtctggatcctaccggtgtggacgacgcctacatccctccggagcagccggaaacaaagcaccatcgctttaaaatctctagggacaccctgagagaccactttatcgctgcggtcggtgagttctgcggcacattcatgtttttatggtgcgcttacgttatctgcaatgtcgctaaccatgatgtcgcactcgttgcagcgcctgacggttcccatccgggtcaattgattatgattgccatcggtttcggattttccgtcatgttttctatctggtgttttgccggtgtctctggtggggctttgaatcctgctatgtcgctttcgctgtgcttggcgagagccgtctctcctacaagatgtgtcgttatgtgggtttcgcagattgttgctggaatggccgctggaggcgctgcaagcgccatgacacctggtgaagtcctctttgccaattctttgggcctgggctgctctaggacgaggggtctgttcctggagatgttcggcaccgctatcctatgtttaacagtcttaatgacggctgtggagaagcgtgaaaccaactttatggctgcgctgcccatcggcatctccctgtttatcgcacacgtcgctttgactgcatacacaggcacaggtgtcaaccctgcgaggtccttgggtgctgctgtcgcagccagatacttccctcattaccactggatttattggattggcacgctgttaggatccattttagcatggtctgtatggcaattattgcaaatcttagactacacaacctacgttaccgctgaaaaggctgccagcaccaaggaaaaagctcaaaaaaaaggtgaaaccagcagttcctctgctgtggctgaagtctaa

SEQ ID NO: 957 - protein, 305 aa, Saccharomyces cerevisiae
MSSNDSNDTDKQHTRLDPTGVDDAYIPPEQPETKHHRFKISRDTLRDHFIAAVGEFCGTFMFLWCAYVICNVANHDVALVAAPDGSHPGQLIMIAIGFGFSVMFSIWCFAGVSGGALNPAMSLSLCLARAVSPTRCVVMWVSQIVAGMAAGGAASAMTPGEVLFANSLGLGCSRTRGLFLEMFGTAILCLTVLMTAVEKRETNFMAALPIGISLFIAHVALTAYTGTGVNPARSLGAAVAARYFPHYHWIYWIGTLLGSILAWSVWQLLQILDYTTYVTAEKAASTKEKAQKKGETSSSSAVAEV

SEQ ID NO: 958 - DNA, 678 bp, Mesorhizobium loti MAFF303099
  CDS (1)..(678): transl_table=11
atgaaaacttatctggctgaagttctaggcacatttctgttggtgttcatcggcacggcgtcggtggtgacgggcggcttcggcggcgcgctgccgctcggccaggaaggtatcggtctggcattcggcatcggcctcatcgccgcggcctatgcgatcggcccgatttcgggcgcacatctcaatccggcggtgacactcggcgtcttcctcgccggccggctgccggccaaggacgtcatcccctactggatcgcgcagatcattggcgccatcctggcttcgctggcgctgtggatcattgtttccggccaggccggcggccacaccggcggtttcggcgccaatggctgggacgagacgaaatggggcatgagctcggccttcctgtgggaactgatcggcaccttcaccttcgtcacggtgatcctcggcgttaccgctgaaaagcactcgacggcgtttgccggcctggtcatcggcctgacgctggccggcattcacttcgccatgatcccggtcaccggcacctcggtcaatccggcccgctccatcggcccggctctgttcaccggcggtgccgcgctcagccagctctggctgttcatcgtcgccccgctgatcggcggcgccatcgccggcgtcgtcgccaaggcacgcatcttcgagaaggattga

SEQ ID NO: 959 - protein, 225 aa, Mesorhizobium loti MAFF303099
MKTYLAEVLGTFLLVFIGTASVVTGGFGGALPLGQEGIGLAFGIGLIAAAYAIGPISGAHLNPAVTLGVFLAGRLPAKDVIPYWIAQIIGAILASLALWIIVSGQAGGHTGGFGANGWDETKWGMSSAFLWELIGTFTFVTVILGVTAEKHSTAFAGLVIGLTLAGIHFAMIPVTGTSVNPARSIGPALFTGGAALSQLWLFIVAPLIGGAIAGVVAKARIFEKD

SEQ ID NO: 960 - DNA, 666 bp, Enterococcus faecalis V583
  CDS (1)..(666): transl_table=11
gtgaaaaaagcaatagcagaatgtttaggaacatttattcttgtcttttttgggacaggaacagccgttctaggaaatggtatggaagggattggaacaacggggattgccttagcatttgggttaacaatcgttgctgctgcctatagtattggcacaatttcaggtgcacatctaaacccagctgtttctataggaatgtggcttaataaacgaatgacaacaatggaactaatctactatgtagtgggacaaattgttggtggcttgattgcctcatttgctttattaagcattctaaaaggtgctggtaaaagtattgagaacttaggtcaaaatggcgtaggggaattaagtgttgctggtgcattgacagtcgaaattattttaacatttatttttgttttagttgtcatgacagttacaagtgctaagaaaggcaatgcttcattagcaggaatcgtaattgggttaacactaacaatgattcacttagtcggcattcctttgacaggaacttctgtcaacccagctcgtagcatcgcgccagccgtttttgcgggtggttcagcgttatctgagttgtggatttttatcgttgcgccattaattggtggattattagccgctcttgtagcaaaattcgtcttagatacggaagaatag

SEQ ID NO: 961 - protein, 221 aa, Enterococcus faecalis V583
MKKAIAECLGTFILVFFGTGTAVLGNGMEGIGTTGIALAFGLTIVAAAYSIGTISGAHLNPAVSIGMWLNKRMTTMELIYYVVGQIVGGLIASFALLSILKGAGKSIENLGQNGVGELSVAGALTVEIILTFIFVLVVMTVTSAKKGNASLAGIVIGLTLTMIHLVGIPLTGTSVNPARSIAPAVFAGGSALSELWIFIVAPLIGGLLAALVAKFVLDTEE

SEQ ID NO: 962 - DNA, 666 bp, Bacillus anthracis str. Ames
  CDS (1)..(666): transl_table=11
atgttaaaaaaagcaatcgctgaatttattggtacatttgtactggtattattcggaactggagtagctgtcattggcggcggaattgaaggaattgggacattaggaatcgctatggctttcggtctatctattgtggctatggcatatagcatcggaacaatttctggatgtcacattaacccagcagtatcagtagctatgttcatcaataaaagaatgaacgctatggaactttgttattatgtattagctcaaattttaggtggtttattaggagctgcaacattggtaacaattttacaatccgctaaaacacctttagataatttaggacaaaatggttttggaactcttggtttatctggagcatttctagttgaatttattttaactttcgtattcattttagtaatcgtcgctgtaacaggtaaaaaaggcagttcttctctagcaggattagtaattggtttcacattagttttagtccacttattaggtattccgttaactgggacttctgttaacccagctcgtagtatcgcaccagctttattcgttggcggagaagcactttctcaactatgggtattcatcgttgcaccaattcttggcggtatcgtagcagctatcgtaggcaaatttattttaaatactgaaaaataa

SEQ ID NO: 963 - protein, 221 aa, Bacillus anthracis str. Ames
MLKKAIAEFIGTFVLVLFGTGVAVIGGGIEGIGTLGIAMAFGLSIVAMAYSIGTISGCHINPAVSVAMFINKRMNAMELCYYVLAQILGGLLGAATLVTILQSAKTPLDNLGQNGFGTLGLSGAFLVEFILTFVFILVIVAVTGKKGSSSLAGLVIGFTLVLVHLLGIPLTGTSVNPARSIAPALFVGGEALSQLWVFIVAPILGGIVAAIVGKFILNTEK

SEQ ID NO: 964 - DNA, 837 bp, Magnaporthe grisea 70-15
  CDS (1)..(837)
atggacgagactaccccgcagcaccacaagggcgcaatgctcggccacgccgatggccaggctgggccacaccgccagacgcttcggcaccacctcgtcgcggcgctgggcgagtttgtcggcacctttttgttcctcttcttcggctacgcgagccactccatgatcgccacggcggagcggccgacccccgagggcctccgcgacggctacagcgcccaggcgaccgtctttatagccctggcctacgccatggccatattggttaccgtgtgggccatgtatcgcatcagcggagggctgtttaaccctgctataactctaggcctgggcctggcgggccagctgccgtggattcgcatcgccgtcctcttccccacccagctcgtggcgtccatatgcgccggggccgtcatagaggccatgctgccggggcccatctcgcgggtcaatacaaagctggccccggacgtcagcgtgacgcagggcgtgttcctcgagatgttcttcaccgcctacctgctcttcgtcgtgctcatggtcgcggccgagaagtccaaggacacctacatcgcccctgtcgccattggcctggccgcctttgtcgcccttattccaggtgcttactacacgggtgcttccctcaaccctgcccgaagctttggctgtgccgtcgctggcctccagttcccagagaatcattggatctactgggtcgggccgtttctgggctcggccttgggtgcagggttctatcggcttttgaagtttttgaactacgaggaggcgaatccgggacaagactctgattatcccctgtataaccaaagggtgtag

SEQ ID NO: 965 - protein, 278 aa, Magnaporthe grisea 70-15
MDETTPQHHKGAMLGHADGQAGPHRQTLRHHLVAALGEFVGTFLFLFFGYASHSMIATAERPTPEGLRDGYSAQATVFIALAYAMAILVTVWAMYRISGGLFNPAITLGLGLAGQLPWIRIAVLFPTQLVASICAGAVIEAMLPGPISRVNTKLAPDVSVTQGVFLEMFFTAYLLFVVLMVAAEKSKDTYIAPVAIGLAAFVALIPGAYYTGASLNPARSFGCAVAGLQFPENHWIYWVGPFLGSALGAGFYRLLKFLNYEEANPGQDSDYPLYNQRV

SEQ ID NO: 966 - DNA, 1611 bp, Magnaporthe grisea 70-15
  CDS (1)..(1611)
atggcatcaaatcctgatccaggagttctcagtccgcaggaggccattcatgcatccacgcaagcgacatccacggtagcagcgtccacggtggcggcgtccacgcaagcgccatctcccgatcttcccatatcccagcctcaaccccaacctcagcagccatcaccaccactcccaacatctccatcacagttggagcaagcgcatgcctttgcagaacctgaggtccctccgcctctgctccctactccaaaatcagctacgttcgcgcgaagtacacaaggaggctcatcgcggcgccgccgacgaagccgcagcaggaaccgagctggcacggcgaccagcgcaaacaacccctattttccaggagatcaagcctcgacacggaggcttcgctacagtatagatgaatatgaagatgagggcctgcgcaacgaaattggtcgtcaccctgacggccggtcaatgcctcgagcacgcccgcctcgtgcatacctcaaccaccctgcctacgcaaacctagactcgcccgccaagccctacaccgaggatcccaagggccatcgagaattcgattatgaggtcgatcccaatacccggcagcagtatgaagaggagtatgcctacggcactggggtttcacatggacctgggatggcaggacctcagcctttcatgcgattcggcccgacgtccaacgccagccactacggccccgacagtcaggctcccaggatcaactggaaagatttgagccgcgaggagcgcaccgaggtcctgcggctgccatggacgcagtggatgaacagcaacgtcaagaatcactttgtcgcgatgctcggagagctgatcggaacaaccatgttcctcttcttcgcatttgcgggcgtcgaggttgctaacattggcctgccgtcatcagcccccttcaacttggccaagcagctgtacatttcgctaagctttggcttctcgctcatggtcaacgtgtggatcttctttcgcatcagtggcgcccagttcaacccggccgttaccctggcactctggatgactggtgcggtcgatgcggtccgaggtgtctgcctggttatttcacagctctgcggtggtatgcttgctagcgttatcgtgaggttcctctttccgcaaaggttcagcgtacggactagcctctcgcagaacacatctcttgttcagggggtctttatcgaggccttgctcacgtcggagctcgtcttcaccatcctgatgctggccaaggagaagcacaaggccacatacatggcgcctgtcggaattggtttggctctctggatcgatcacatggttggtgtgccgttcaccggggctgggattaaccccgcgcgcagcttcggaccctgtgtcgttaccgcgacttttgagcccgaacattggatatactgggttggaccgggcattggagccctgatcgccgtggctttctacaagctgatcaaggttttggagtacgagatggccaaccctggtgccgatggagatgcggacaatgatccaactcagaatccggccaaaagggcagagctggcagccggaagaaggttcgcgggtggctttgatgccaagtaa

SEQ ID NO: 967 - protein, 536 aa, Magnaporthe grisea 70-15
MASNPDPGVLSPQEAIHASTQATSTVAASTVAASTQAPSPDLPISQPQPQPQQPSPPLPTSPSQLEQAHAFAEPEVPPPLLPTPKSATFARSTQGGSSRRRRRSRSRNRAGTATSANNPYFPGDQASTRRLRYSIDEYEDEGLRNEIGRHPDGRSMPRARPPRAYLNHPAYANLDSPAKPYTEDPKGHREFDYEVDPNTRQQYEEEYAYGTGVSHGPGMAGPQPFMRFGPTSNASHYGPDSQAPRINWKDLSREERTEVLRLPWTQWMNSNVKNHFVAMLGELIGTTMFLFFAFAGVEVANIGLPSSAPFNLAKQLYISLSFGFSLMVNVWIFFRISGAQFNPAVTLALWMTGAVDAVRGVCLVISQLCGGMLASVIVRFLFPQRFSVRTSLSQNTSLVQGVFIEALLTSELVFTILMLAKEKHKATYMAPVGIGLALWIDHMVGVPFTGAGINPARSFGPCVVTATFEPEHWIYWVGPGIGALIAVAFYKLIKVLEYEMANPGADGDADNDPTQNPAKRAELAAGRRFAGGFDAK

SEQ ID NO: 968 - DNA, 825 bp, Magnaporthe grisea 70-15
  CDS (1)..(825)
atggcgctgtctcctatcctccgcaaccacggcacggccgcactcgccgagcttgttggaaccttccttttcctcttctttgccttctccgccgccggggtcgccaatgctgtgccgcctgagtttagcgatggcattgcggtgcccaatattgcagcgcttctgtacatatcgtttgcctttggcatctccctgatggtcaacgtctttgccttttaccgcatctcgggtggtcaattcaaccctgctaaattcgtcaaggtctcgacggcactttgcttggttggcgcaatcccgccgttgcgtgccgggttctgcattgtgggccagattgttggcggcatcattgccgccgccgcggtcgacggtctctaccctacgttcctgaacgtcgaaaccactctgggatctggcgtctcgccggcccagggtgtctttatcgaaatgttcctcacaacgcagttgatcttggtcattctcctgttggcagttgagaagcacaggttgacatacctagctccacttggcatcggctttgccctcttcgtgacgcatcttgctggtgtatacttcactggagcctctctcaacccggctcgttccctgggtccagccgtcatcaaccgcagcttcccttcctaccactggatatactggatcggtcccatgctcggcgctctccttgcatcgggattctacacccttctcgatttctgcaagtggaagcaggtcaaccctggccaagactgggacggcattggcgagaaagaggctcagagggacgacttcgacggagcccgcgatcccttgacgagggtcgcttga

SEQ ID NO: 969 - protein, 274 aa, Magnaporthe grisea 70-15
MALSPILRNHGTAALAELVGTFLFLFFAFSAAGVANAVPPEFSDGIAVPNIAALLYISFAFGISLMVNVFAFYRISGGQFNPAKFVKVSTALCLVGAIPPLRAGFCIVGQIVGGIIAAAAVDGLYPTFLNVETTLGSGVSPAQGVFIEMFLTTQLILVILLLAVEKHRLTYLAPLGIGFALFVTHLAGVYFTGASLNPARSLGPAVINRSFPSYHWIYWIGPMLGALLASGFYTLLDFCKWKQVNPGQDWDGIGEKEAQRDDFDGARDPLTRVA

SEQ ID NO: 970 - DNA, 957 bp, Gibberella zeae PH-1
  CDS (1)..(957)
atggttcaattcggctctcgggctaacacgaacatgactggcttgccaactgagcaagctgtcgaggaccgtcgtgtaggcaatcccaagcgtgaccgcatgagaaacgccctcgtcatcgtcctaggagaattctgcggaacattcatgttcttactgctctctttcatcggtgcccagactgccctcgtcaccaacagtccctcggatgctggttcccctttgctgccttttagtttgatgtacattgctgcctcttttggtactgctctcgccgtcaatgtctggatcttttatcgtgtcagtggtggcatgtttaacccggctgtgactcttggtttagttctcgtcggcgctgtgacacctatccatgcactcctcatcatccctacacagcttgtcgctgccatcaccgctgcaggcatcacggatgcactccttcccggcaagcttctcgtcaccaatgctctcggcaacgggacaagcgttgctcagggtgtcttcatcgagatgttcctcacttctcagctcgtcctgacagtctacttcctcgccgtcgagaagcaccgcagcacccatcttgcccccatcggcattggtatctccgtcttcatcgcccacatctgtgcgaccaactggacgggcacatccatcaaccctgcccgatccttcggtccttctgtcgtcgcgggcttccacggttacgactggatctactacatcgggccctttatgggttctctcctggctttcggctgctacaagatctttaaggtgctcgagtatcagactgccaacccgggacaggatgacgataatcttgacaggtctggccaccatcacttcttcggccacagaaaggaacccatgccccacactcacactgacaacatcgagcccaaggatcatggagttcctcagagaaatgacagcgtcattgatgatcagatggtctag

SEQ ID NO: 971 - protein, 318 aa, Gibberella zeae PH-1
MVQFGSRANTNMTGLPTEQAVEDRRVGNPKRDRMRNALVIVLGEFCGTFMFLLLSFIGAQTALVTNSPSDAGSPLLPFSLMYIAASFGTALAVNVWIFYRVSGGMFNPAVTLGLVLVGAVTPIHALLIIPTQLVAAITAAGITDALLPGKLLVTNALGNGTSVAQGVFIEMFLTSQLVLTVYFLAVEKHRSTHLAPIGIGISVFIAHICATNWTGTSINPARSFGPSVVAGFHGYDWIYYIGPFMGSLLAFGCYKIFKVLEYQTANPGQDDDNLDRSGHHHFFGHRKEPMPHTHTDNIEPKDHGVPQRNDSVIDDQMV

SEQ ID NO: 972 - DNA, 861 bp, Gibberella zeae PH-1
  CDS (1)..(861)
atggcagatacctacggcatgaacggccacaatggccacgtcaaagatcgccgcagtagctcaatgaatggtcgaaatcgtctttacgctcaacaagagccgcaaagaacgactcacctcagcgagttcggtaagcatatggtagcagcatctggagagtttgtgggcacctttctattcttgtactttggctatgctggaaacattgttgccgttctccaagagcccatctcagggccgaacggcaccttggccaacaacactgtcatgtacatagccatggcgtacggattctctcttttggtcaacgtttggactttctaccgaatcagtggtggactctttaatcctgctgtcacctttggcctctgcctctctggtcaactaccatggatacgtgcactatttctgtttccctcccagatcattgctgcaatgtgcgcgggcggtcttgttaatgccatgttccctggaagtgcctctatcgcaaacacgacacttggacccaacacttccattgcgcaaggtgtctttcttgaaatgttcttcactgcccagttggtctttgttgtcttgatgcttgctgctgagaagtctcgcgacacctttctggcccctgttggcataggcctggcccttttcgtcgcacttatcccaggagtcttcgtaactggcggatcagctaatcctgtccgatcctttggctgcgctgttggttctagagactttcctggctaccactggatctactgggttggaccccttcttggcgctgcacttgctgctgggtatttccggcttgtcaagatgatgcactacgaggaagcaaaccctggacaggacagcccggttgacgtatga

SEQ ID NO: 973 - protein, 286 aa, Gibberella zeae PH-1
MADTYGMNGHNGHVKDRRSSSMNGRNRLYAQQEPQRTTHLSEFGKHMVAASGEFVGTFLFLYFGYAGNIVAVLQEPISGPNGTLANNTVMYIAMAYGFSLLVNVWTFYRISGGLFNPAVTFGLCLSGQLPWIRALFLFPSQIIAAMCAGGLVNAMFPGSASIANTTLGPNTSIAQGVFLEMFFTAQLVFVVLMLAAEKSRDTFLAPVGIGLALFVALIPGVFVTGGSANPVRSFGCAVGSRDFPGYHWIYWVGPLLGAALAAGYFRLVKMMHYEEANPGQDSPVDV

SEQ ID NO: 974 - DNA, 1644 bp, Gibberella zeae PH-1
  CDS (1)..(1644)
atgtcctcatccatactcaataatcgctcggctcgcagtacgcctgccggagccaaccctgctttcaaccctcccgccgaagcctccagctcttcgacccaatctggagttccatacatccgggaaaactctccagaggccgagagcataccttccaacccagctatgacacctatcatcactcatggggatagcctcgcctctcccggcggccgaaactccgaggccgatactgtcgtgcctctccagcctgccgtcagccaagatgccattcgatctcgtcccggttctcgcaccggcaactttgtcacacccaaggccgctcgcttctctcaggatggtgcagagccaataatgcaatactcgagcggctcagtaaaatctgctcgtcgtcgcacacgtgagcgtgaagattacgacttcgatcaggctgccgactatgctcctatgagtgaatatgaacgctattaccgcaacgaaggtcgcaatgaccgtgataggtacactcgaagaggtccttacccacctcctacattcatgaaccgtcgtcgagcaccccctcttgactcggacgaggagttttacagcagtgacgaccctcgtatacctcccaacgacagacggaggatgatggatgaagaggcaggctaccctggtcgacctcatgctttccgacgcacttccactctcaacggcttcaacatcaccacaggcaagcttcagtggaacgagttgagccgacaggagaagtccgagatcatgcgtcttccattgacacagtggatgaactcgaatttcaagaaccacttcgttgctggtgtaggagagtttattggcaccactatgttccttttctttgcctttgctggtacagaggtcgccaacatccaggccgacaccaccaacaggaccaccactggtgaatctaccggtagtctcaacgtttccaaactcctctacatctctatcatcttcggtttctctctcatggtcaacgtctgggtcttcttccgtatcagtggtggcctgttcaaccctgctgtcaccatggccatgttgatggtcaaggccatcagcgtcacaagagccattgttctgttcctcgctcaaattctcgggtctatgcttgcctctgttgttgtacgctacctcttccctgaaacattcaacgttcgaaccactcttggtggcggtgcatctctggtccagggtgtcttcatcgaggctcttcttactgctgaactggtctttactatctttatgcttgccaaggagaagcaccgagccactttcattgctcccgtcggtattggtctggctcttttcatcgctgagatggtcggagtccagttcactggaggttctctcaaccctgcacgtagctttggtccttgtgtcatcaccggtagcttcgataccgagcactggatctactgggttggacccgctatcggttctctgatcgccgtgtgcttctactggttcatcaagaccctggaatacgagatggccaatcctggcgccgacggtgacgatctcaacgaccctaccaagaaccctgaaaagcgagcagagatccaagcttccaagccagttcccacagccgcctttggctctggcaagaccgcttctattctcagttag

SEQ ID NO: 975 - protein, 547 aa, Gibberella zeae PH-1
MSSSILNNRSARSTPAGANPAFNPPAEASSSSTQSGVPYIRENSPEAESIPSNPAMTPIITHGDSLASPGGRNSEADTVVPLQPAVSQDAIRSRPGSRTGNFVTPKAARFSQDGAEPIMQYSSGSVKSARRRTREREDYDFDQAADYAPMSEYERYYRNEGRNDRDRYTRRGPYPPPTFMNRRRAPPLDSDEEFYSSDDPRIPPNDRRRMMDEEAGYPGRPHAFRRTSTLNGFNITTGKLQWNELSRQEKSEIMRLPLTQWMNSNFKNHFVAGVGEFIGTTMFLFFAFAGTEVANIQADTTNRTTTGESTGSLNVSKLLYISIIFGFSLMVNVWVFFRISGGLFNPAVTMAMLMVKAISVTRAIVLFLAQILGSMLASVVVRYLFPETFNVRTTLGGGASLVQGVFIEALLTAELVFTIFMLAKEKHRATFIAPVGIGLALFIAEMVGVQFTGGSLNPARSFGPCVITGSFDTEHWIYWVGPAIGSLIAVCFYWFIKTLEYEMANPGADGDDLNDPTKNPEKRAEIQASKPVPTAAFGSGKTASILS

SEQ ID NO: 976 - DNA, 882 bp, Candida glabrata CBS 138
  CDS (1)..(882)
atggactctgatttggaaattcaaaacaagacacaggtcgaacatgtcgacaagatgggggactcagatgttcctgaatctgtttccaacagcgctaacatgctgaggtcaagattcaatattggcccagactctgttagaaaccacgtgatcgcatttatgggtgagttatgcggtactttcatgttcttgtggtgtgcctatgttattgctaacattgctaaccatgatgtctctttaaaggacagtccaccacatggttctcacccaggtcaattgatcatgattgccttgggtttcggtttttccgttatgttttctatttggtgtttcgtcggtgtctccggtggtgcacttaacccagctgtctctctatccttagccttggccagagctatcaccccaaccagatgtgttgtcatgtggattgctcaaatacttggtggtatggctgctggtggtgctgcttctgctatgactccaggtccagtcaagttcgacaacggtctagggctaggctgttctagaaccagaggtttgtttttggaaatgttcggtaccgctattctatgtctaactgtcttaatgactgccgttgaaaagggtgaatctaactttatgtgtgctcttccaattggtatttctctatttatcggccatcttgccctaaccgcctacactggtaccggtgtcaacccagctagatcttttggtgctgctctagctaagagatatttcccacactaccactggatctactggattggtccattattgggtgctatcttggcttggtttgtctggcaagttctacaatggctagactacgctaactatgttgccagagagaaggaggccgctgaaaaggccaagacccattaa

SEQ ID NO: 977 - protein, 293 aa, Candida glabrata CBS 138
MDSDLEIQNKTQVEHVDKMGDSDVPESVSNSANMLRSRFNIGPDSVRNHVIAFMGELCGTFMFLWCAYVIANIANHDVSLKDSPPHGSHPGQLIMIALGFGFSVMFSIWCFVGVSGGALNPAVSLSLALARAITPTRCVVMWIAQILGGMAAGGAASAMTPGPVKFDNGLGLGCSRTRGLFLEMFGTAILCLTVLMTAVEKGESNFMCALPIGISLFIGHLALTAYTGTGVNPARSFGAALAKRYFPHYHWIYWIGPLLGAILAWFVWQVLQWLDYANYVAREKEAAEKAKTH

SEQ ID NO: 978 - DNA, 873 bp, Candida glabrata CBS 138
  CDS (1)..(873)
atggaaacagaacatcaggcagacaaaaatgcggaattgggttatgacagtggatcaaccgttgctccccccaataaatatagtacattacgctctaggttcaatttaggacctgacactatgagaaatcatgttattgccttttttggggagttggttggcacattcatgtttttatggtgtgcctatgttattgcaaatattgcaaatcatgatgtcttgttagatgtatatccagatggttcccatccaggccaattgataatgattgcgctgggttttgggttctcagtgatgttttcaatctggtgttttgcaggtgtttctggtggtgctttaaatccagctgtgtctctatcactagcactttcaagaactattacaccaatgagatgtatagtgatgtgggttgctcaaatgttaggaggtatggctgctggtggagctgctagtggtatgactccaggtcctgttttgtacgcaaacactttaggcaacggctgttcaagaactagaggtttgtttttagaaatgtttggcacaactattttatgtttaacagtactaatgacagctgtggagaaaggtgagtccaatttcatgtgtgcattgccaattggtatatctctgtttattgggcatcttgcattaaccggttacacaggaacaggtgttaatcctgcaagatcatttggagcagccttggcagcaagatccttcccagtgtatcactggatctactggattggtcctctactaggtgctattttggcctggttcgtgtggcaagtgcttcaatggttagactatagcagctacgtaaccagagaaaaggaagcagctgctaaaacaaaggtaatggttgaaccctaa

SEQ ID NO: 979 - protein, 290 aa, Candida glabrata CBS 138
METEHQADKNAELGYDSGSTVAPPNKYSTLRSRFNLGPDTMRNHVIAFFGELVGTFMFLWCAYVIANIANHDVLLDVYPDGSHPGQLIMIALGFGFSVMFSIWCFAGVSGGALNPAVSLSLALSRTITPMRCIVMWVAQMLGGMAAGGAASGMTPGPVLYANTLGNGCSRTRGLFLEMFGTTILCLTVLMTAVEKGESNFMCALPIGISLFIGHLALTGYTGTGVNPARSFGAALAARSFPVYHWIYWIGPLLGAILAWFVWQVLQWLDYSSYVTREKEAAAKTKVMVEP

SEQ ID NO: 980 - DNA, 582 bp, Kluyveromyces lactis NRRL Y-1140
  CDS (1)..(582)
atgatcgctttgggtttcggtttctccgtcatgtttgccgttttcatcttcttcagagtctctggtggtaatttgaacccagctgttactttgactttggtcttgacaaacgtcatcccatggccaagagctcttgtcatgtggatcagtcaaatggttgccggtatggctgctgcaggtgctgcttctgccatgaccccaggtgaaatcttattcgctaacggtctaggtggtggtgcttccagatccagaggtgttttcttggaagccttcggtaccgcaatcctatgtaccaccgttttgttcatggccgttgaaaagcataaggctaccccaatggctccattcgccattggtattgcattgtttgttggtcacttgatctgtgtttactacaccggtgccggtttgaacccagccagatctttcggtccatgtatcgctgctgcctctttccctaactaccattggatttactggattggtccaggtcttggtgccatcatgtctgccgctttgtggcacatcttgaagttcttgaattatgagaactgtaacccaggtcaagatgatatcctataa

SEQ ID NO: 981 - protein, 193 aa, Kluyveromyces lactis NRRL Y-1140
MIALGFGFSVMFAVFIFFRVSGGNLNPAVTLTLVLTNVIPWPRALVMWISQMVAGMAAAGAASAMTPGEILFANGLGGGASRSRGVFLEAFGTAILCTTVLFMAVEKHKATPMAPFAIGIALFVGHLICVYYTGAGLNPARSFGPCIAAASFPNYHWIYWIGPGLGAIMSAALWHILKFLNYENCNPGQDDIL

SEQ ID NO: 982 - DNA, 933 bp, Debaryomyces hansenii CBS767
  CDS (1)..(933)
atggatagcacattaggaagtgattccttagaaccagaaaagagaactacgatcgactcggaaggattaaatcaccgtaacccagaaagatttgaaggggaaaataggttatcaccggatcttgaggctcagggtattgaagaagaagctttggctgttaatccggcccgtgagccattatacaagttcacgattttttttactgaagatgaaaaaagagtctctatttatggtgcggagttctttggtacatatgtcttcttgctatcagcatatctagtagctagtgttgctaacctgcaagcaattgcagcagaagatggtttttatgcccctcgtgtttataatatttcatttggtttcgggatttcattattagtggttgcggcttgtacttcgaacttttcaggtggtcaccttaatcctgcagttgtttggggtctatttttaaatggaaatattagtatgtttaggttcttactagaaagtttggttcaagtaattgctgggatggcagcggcgggaactgcctctgcaatgtaccctggccctgtcacatttgccaatgcgaaagatgcatctgttagtgttagtagaggattgttcttagaagcattcggtgttgcgttgcttgtgttcactgttctctttactgccattgaagtaagtccattcggtgggatggcatacctaccaattggattatcattgttcttgggtcatatgatttgtgttccaactacaggagcaggattgaatccagcaagatcttttggcccagcaatcgcagcaagagattttccagggtatcattggatttactggcttggtccagttattggaggagctgttgcagtggtagcatataagatgatcaagcttggtcaccgtggtactatacttcaagaagctagaatgaagagtaacagctaa

SEQ ID NO: 983 - protein, 310 aa, Debaryomyces hansenii CBS767
MDSTLGSDSLEPEKRTTIDSEGLNHRNPERFEGENRLSPDLEAQGIEEEALAVNPAREPLYKFTIFFTEDEKRVSIYGAEFFGTYVFLLSAYLVASVANLQAIAAEDGFYAPRVYNISFGFGISLLVVAACTSNFSGGHLNPAVVWGLFLNGNISMFRFLLESLVQVIAGMAAAGTASAMYPGPVTFANAKDASVSVSRGLFLEAFGVALLVFTVLFTAIEVSPFGGMAYLPIGLSLFLGHMICVPTTGAGLNPARSFGPAIAARDFPGYHWIYWLGPVIGGAVAVVAYKMIKLGHRGTILQEARMKSNS

SEQ ID NO: 984 - DNA, 855 bp, Yarrowia lipolytica CLIB122
  CDS (1)..(855)
atgaccaaggagtctgtgcacaatctgcccaccgtttccacctctcagcccgctgagcccgtggacgccatcccccccaccgcctacgtccccccggatgaggcctacacccggtctcgacctatgggtctcggtgagaacatgcgaaacctcttcattgcctgcattggtgagtttgtcggtaccttcatgttcctgctgttcgcttacctgattgccaccgtcgccaactacgacaaaaccgtcgccggccccaacgccgccaagatcatcatgatctccttcggcttcggcttctccctcctcgtcaacgtcttcatcttcttccgagtctccggaggtcagttcaacccttgtgtcactctcgccctcacccttgttggtgccgttcctcccgtccgagctctgtgcttggccatcacccagctcctcgccggtatggccgctgctggtgtcgccgacgccctgacccccggccccgtcaccttcatcaacactctcggtgacggtgtgtcccgaaccagaggaatgtggatcgagatgttctgcactgcccagctgtgtctgaccgtgctgttcctcgccgtcgagaagcaccgagccaccttcatggctcccttccccattggaatgtctctcttcattggccatctggttgccgtcttccccaccggcgctggtatcaaccccgctcgatctctgggcccctgcattgttggaaagtctttcccccactaccactggatctactgggtcggtcctatcctcggttccatcttctctgttggtctctaccacaccctcaagttccttgactacgagacctccaaccccggccaggacaaccaggactaa

SEQ ID NO: 985 - protein, 284 aa, Yarrowia lipolytica CLIB122
MTKESVHNLPTVSTSQPAEPVDAIPPTAYVPPDEAYTRSRPMGLGENMRNLFIACIGEFVGTFMFLLFAYLIATVANYDKTVAGPNAAKIIMISFGFGFSLLVNVFIFFRVSGGQFNPCVTLALTLVGAVPPVRALCLAITQLLAGMAAAGVADALTPGPVTFINTLGDGVSRTRGMWIEMFCTAQLCLTVLFLAVEKHRATFMAPFPIGMSLFIGHLVAVFPTGAGINPARSLGPCIVGKSFPHYHWIYWVGPILGSIFSVGLYHTLKFLDYETSNPGQDNQD

SEQ ID NO: 986 - DNA, 822 bp, Candida albicans SC5314
  CDS (1)..(822): transl_table=12
atggttgccgaaagttctagcattgataatactcctaacgacgttgaagctcaaagaccagtctatgaaccaaaatatgacgattctgtcaatgtgtcgccattgaaaaaccatatgattgcctttttaggggaattttttggtacatttatctttttatgggttgcatttgttattgctcaaattgctaaccaagacccaaccatcccagataaaggttctgatccaatgcaattgattatgatttcatttggtttcggtttcggggttatgatgggtgtatttatgtttttcagagtttctggtggtaatttgaatcctgctgttactttaactttagttttggctcaagctgtcccaccaattagaggtcttttcatgatggttgctcaaatgattgctggtatggctgctgctggtgccgcttctgctatgactcctggtccaattgcttttactaacggtttaggtggtggtgcttctaaagccagaggggtgtttttggaagcttttggtacttgtatcttgtgtttaaccgttttaatgatggccgttgaaaaatcaagagctacttttatggctccattcgtcattggtatttcattgtttttgggacatttaatttgtgtttactacactggtgctggtttgaacccagctagatcttttggtccatgtgttgctgctagatccttcccagtttatcactggatctattgggttggtccaattctcggttcagttatagcctttgccatttggaaaatcttcaaaatcttgaaatacgaaacttgtaacccaggtcaagattctgatgcttaa

SEQ ID NO: 987 - protein, 273 aa, Candida albicans SC5314
MVAESSSIDNTPNDVEAQRPVYEPKYDDSVNVSPLKNHMIAFLGEFFGTFIFLWVAFVIAQIANQDPTIPDKGSDPMQLIMISFGFGFGVMMGVFMFFRVSGGNLNPAVTLTLVLAQAVPPIRGLFMMVAQMIAGMAAAGAASAMTPGPIAFTNGLGGGASKARGVFLEAFGTCILCLTVLMMAVEKSRATFMAPFVIGISLFLGHLICVYYTGAGLNPARSFGPCVAARSFPVYHWIYWVGPILGSVIAFAIWKIFKILKYETCNPGQDSDA

SEQ ID NO: 988 - DNA, 1263 bp, Ustilago maydis 521
  CDS (1)..(1263)
atgtcgagcgttgaaaatactccgcctactgtcacagcgcctccaggctctggcggtcgcctctccaccgatagcgctttctcgcagagccgaccacgtcgactgtccatgctgcgatttgagcgtcataagcaccatggtgcttccggcaacccgcttccacaccgacgccatgcctttggcaaacccagcttctcgggcttccaacaacacttcatggctggactcggcgaacttatcggcaccaccatgttcctcttcctcgccgaaggaggtgccaagacggcacagctttcggtttcggcggcgcagaacgaaaccgccacacctctgagcaacgagacaatcatgtttatcgctttgtcgtttggaatgtcgttgttggtctcggcttggatgttttacaggatcacgggcggtctctttaacccagccatcaccatcgccttgtggtgggtgggcgttttgacctcatgtcgagccttggttctgttcatcgcgcagatcctgggaggtatcgcaggtgccgccctggtgctgggcttaactccaaccaacagcatcagccaagtgactacgacactgcagccagggataagcctggctcagggtttcttgatcgagatgctcctcacgtcgatcttggtgttttccgtcctcatgttggctgtcgagaagcatagagcaacctaccttgcacctgtcggcatcggactgacgctcctcgctgctcacctgttcggcgtcgtgtggacgggatgcggcatgaatcctgctcgatcgttcgggcccgctgttgtcgctggtgaattcaactcggaccactggatctactggatcggaccgcttgcgggaggtatactcgctgttgcctacttctccttcctcaaggtgctcaagtacaactcggtcgtcatggaccaagactcggacaaggagatcaccggtctgaagcccatgcacgttcgaatctggaacctggtacggcacagacagaaccccggtgcactcaacccagagagttcgacgcactacgacaagtcagcgaggcagaactttgacaaggaggagaccgaagcctttgaggagagggaggcaattcgaaagcaaatgatggacaaacccgtctttgacggccatgcccacgaggcggccaacggtaggatgagcgagaggaacaatgcagagctcatgtcgactagcaccggcagcactgctcgtctctcgagcggcggacatcagggcgccatcttgcccaaatga

SEQ ID NO: 989 - protein, 420 aa, Ustilago maydis 521
MSSVENTPPTVTAPPGSGGRLSTDSAFSQSRPRRLSMLRFERHKHHGASGNPLPHRRHAFGKPSFSGFQQHFMAGLGELIGTTMFLFLAEGGAKTAQLSVSAAQNETATPLSNETIMFIALSFGMSLLVSAWMFYRITGGLFNPAITIALWWVGVLTSCRALVLFIAQILGGIAGAALVLGLTPTNSISQVTTTLQPGISLAQGFLIEMLLTSILVFSVLMLAVEKHRATYLAPVGIGLTLLAAHLFGVVWTGCGMNPARSFGPAVVAGEFNSDHWIYWIGPLAGGILAVAYFSFLKVLKYNSVVMDQDSDKEITGLKPMHVRIWNLVRHRQNPGALNPESSTHYDKSARQNFDKEETEAFEEREAIRKQMMDKPVFDGHAHEAANGRMSERNNAELMSTSTGSTARLSSGGHQGAILPK

SEQ ID NO: 990 - DNA, 1512 bp, Ustilago maydis 521
  CDS (1)..(1512)
atgaccaccatccaaaagccacagcagctttctcgcaccaccaacatgatggcagagagagttcattggagtggcgggcaacgcggtacaggtctcaagactgatgatcgatctttcacctatttgcaacggctgacattcacagcgaatcccaagcctcctgctgctggcagcggcgtctacaatgtaggaggcaagcaaccgacgcacatgtgtcaagctgatcgcggttgcacagacactactttagttcatggcgcacgcaagcgcgaagagcaccagtcgggtctcgcactggctcgcactggcgctccggtgccaagcggagatagcaatgtgcgtgagatggtagcacagccatccatgttttcgctcggcgaccgcacgcaggagcagcccactatgctcgaacggcgcgagagcagcatgatcgaagagcagctgccatcgttcatgcaggtcgaccaaaccgagcacaaacatcgacatcactaccgcgctgcacttcgacgtcggctcgtgctcaaaaataatgtgattgcgttcgtctccgagtttatcggtacggttttgttcctcttgttctcgttcatcattgccagccaggcatccaacgctcaagctgccacgcagagagatagtgaggctacgtcgctcgcgcagaacgcaccggtggacacgtcggcgttgttgttttcctcgctcggcttcggcttctccctcgcggtcaacgcttggacgttctaccgtgtttctggtggcctcttcaatccggcggttaccctggcgttgtttttgacgggaactttgggaaagctccagctggttcacttgaccatcgcccaattcgctggtggtatcgccgctgctgcgcttgctgacggcctgctacctggccgtctcaacgcgcgaactacgctggccaacggtacgagcgtcgtgcaaggattcttgtttgaatttttcttgacgagccagctgatcctggcgatcttcttgcttgccgccgagaagcaccgaggcacgttccttgcgcctgtcggcatcggccttgctctcttcttggccgaattggctggcaccaactacaccggaggctcgctcaaccctgcgcgtacgctgggaccgaatacggtgctcgccacatttcaacaatacgactggatctactggatcgctccgtactcggcggcgatcgtcacatcgggcttctacatgctgctcaagtacttgcagtacgaatccgccaatataggtcaagattcagacgacaccaaacaggtcttcaaggacacgtacggaaatgtggttggtgtcctcgagactatggctgcttccgagttctcgttcgtcagccaagtggctccaccagccgaagccgaaatccaagccctcgtcaacatcgacccttccaaacccgccttgactgcggctcgaacaaaaatgcccacacagaatcaaaaggccgcagccaaccttggccccgctaccgtccacaacaacctcgcttga

SEQ ID NO: 991 - protein, 503 aa, Ustilago maydis 521
MTTIQKPQQLSRTTNMMAERVHWSGGQRGTGLKTDDRSFTYLQRLTFTANPKPPAAGSGVYNVGGKQPTHMCQADRGCTDTTLVHGARKREEHQSGLALARTGAPVPSGDSNVREMVAQPSMFSLGDRTQEQPTMLERRESSMIEEQLPSFMQVDQTEHKHRHHYRAALRRRLVLKNNVIAFVSEFIGTVLFLLFSFIIASQASNAQAATQRDSEATSLAQNAPVDTSALLFSSLGFGFSLAVNAWTFYRVSGGLFNPAVTLALFLTGTLGKLQLVHLTIAQFAGGIAAAALADGLLPGRLNARTTLANGTSVVQGFLFEFFLTSQLILAIFLLAAEKHRGTFLAPVGIGLALFLAELAGTNYTGGSLNPARTLGPNTVLATFQQYDWIYWIAPYSAAIVTSGFYMLLKYLQYESANIGQDSDDTKQVFKDTYGNVVGVLETMAASEFSFVSQVAPPAEAEIQALVNIDPSKPALTAARTKMPTQNQKAAANLGPATVHNNLA

SEQ ID NO: 992 - DNA, 1116 bp, Cryptococcus neoformans var. neoformans B-3501A
  CDS (1)..(1116)
atgcctgacttagttgtgaccacacaagagctacgcccctccagtcctgtctatggtcacgcgcgaacgataataaagaataatttcgtggccatggcaggagaatacgtcggaaccactcttttcatgctatgttgtcttggaggtacccatgttgcactactgccagagaagtccgtgacgggcgacttgtcgcagccgctaaacacttccagccttttttacatttccttgtccattgggctctctctgacggttaatgtttggattttctttcgggtttccggaggcttattcaacccagccgtgtcgttggggatggtgcttgccgggtgcttgccacctatgaaaggcgccttgttaacagtggcccaggttttgggtggtataactggagcggcaatcatcaacgtcctacttccgggagagctaaatgctggaacaacactaggtggaggagcttctattgcccagggactgttcattgaagccatccttaccgcgctgctaatgttgacggttttctttacggctgccgagaagaatgaggcaacattcctgtctccgcttgctattgggatggcgcttttcattgctgagatggttggagtgccatacagtggcggagctttgaatcctgtccgaagcttaggaccagctgtggtaactcataacttccctggatatcattggatctactgggtcggtcccgccctcgggtctgttcttgcgacatgcttttactctttgctcaagtatcttgaatatgaatctgtccccggacccggagaagcgccccacgtccctccgttttggcgcttacccgctcgagggtatctatcgacgttgtcacacccattcgcgaaaagagcaagcactggaacttattcccatgaagacgacccagaaaagggtttacgatctggcaaagattcccaagctaataccgataacccaacaagagtaaacaggcctggatcgggtgatgcggagattcagagtcctgttgaagatacgacgatggcgaacgcaagattggacagaatcgaaatgctattgacacaattgatgcaggtgcgcacgtccgagggtacgcagaaatcacctgctgtataa

SEQ ID NO: 993 - protein, 371 aa, Cryptococcus neoformans var. neoformans B-3501A
MPDLVVTTQELRPSSPVYGHARTIIKNNFVAMAGEYVGTTLFMLCCLGGTHVALLPEKSVTGDLSQPLNTSSLFYISLSIGLSLTVNVWIFFRVSGGLFNPAVSLGMVLAGCLPPMKGALLTVAQVLGGITGAAIINVLLPGELNAGTTLGGGASIAQGLFIEAILTALLMLTVFFTAAEKNEATFLSPLAIGMALFIAEMVGVPYSGGALNPVRSLGPAVVTHNFPGYHWIYWVGPALGSVLATCFYSLLKYLEYESVPGPGEAPHVPPFWRLPARGYLSTLSHPFAKRASTGTYSHEDDPEKGLRSGKDSQANTDNPTRVNRPGSGDAEIQSPVEDTTMANARLDRIEMLLTQLMQVRTSEGTQKSPAV

SEQ ID NO: 994 - DNA, 828 bp, Mycobacterium sp. JLS
  CDS (1)..(828): transl_table=11
atgcgagagccgaccatgatgcatcgggtggccgccgagttcatcggaacgttctggctcgtcttcggcggctgcggcagcgcggtattcgccgccaagtacacctcggccgacggctacgcgttcggcatcgggttcctcggcgtctcgctcgccttcggtctcacggtgctcaccggcgtgtacgcgttcgggacgatctccggcgggcacttcaaccctgcggtcacgctgggcgcggcactggcccggcgggtcgaatggcgtgtgctgccggcctactggctcacccaggtgatcgccggcgtggcggccggactcgtcatctacgtcatcgccaaggggcgtgaggggtggaccgccaccgggaacatggccgccaacggatacgccaaccactcgccggcgggctattcgctgctggccgtcgtcatcgccgaggtcctgctgacgggcatcttcctcctggtgatcctcggcgccaccgacacccgcgccccgaaggggttcgccgggctggccatcgggctgaccctgacgctgatccacctgatctcgatcccgatctcgaacacctcggtgaaccccgcccgctccaccggcgtggcgttcttcaacggcaacgaggcgcccgcgcagctgtgggtgttctggatcgccccccttctcggcgccgccatcgccggcgcggcctacccgtacctgttcgggcggcacgaggaactggccgatcggccggtgcgcgacgaaacgctggacgcccaggtgcgcgccgaggacgtcgcggacgcgcgcgtcgaacgcggtcccgacccagaggtccggtag

SEQ ID NO: 995 - protein, 275 aa, Mycobacterium sp. JLS
MREPTMMHRVAAEFIGTFWLVFGGCGSAVFAAKYTSADGYAFGIGFLGVSLAFGLTVLTGVYAFGTISGGHFNPAVTLGAALARRVEWRVLPAYWLTQVIAGVAAGLVIYVIAKGREGWTATGNMAANGYANHSPAGYSLLAVVIAEVLLTGIFLLVILGATDTRAPKGFAGLAIGLTLTLIHLISIPISNTSVNPARSTGVAFFNGNEAPAQLWVFWIAPLLGAAIAGAAYPYLFGRHEELADRPVRDETLDAQVRAEDVADARVERGPDPEVR

SEQ ID NO: 996 - DNA, 699 bp, Candidatus Protochlamydia amoebophila UWE25
  CDS (1)..(699): transl_table=11
atgaatcttgcatggttattagctgaatttattggaacttttacgttgatttttatcggggtaggcgcaatttgtttaaatgagatgaatcctggcagtgtggggcttgtcggaattgctcttgcacatggacttgccattgctgtgatggtatctaacgttggccatatttcagggggaaaacttaatccagctgtttctataggagtcttaatcggtggaaggtcggactggaaaacaacagtggcagaaatttttgctcagttagcaggtgctgtatttgcagcactatgccttaaaataatctttccaacggatgtcacagaagtgacaaaattaggaacgcctgttttagcagatggagtttctatgggaataggtattatggctgaggcaattttaacatttctcttagtatttaccgtttacgccgctgcagttgatccgaaaggggcttttaaatcaattgctggttttactattggtggtgtaattatctttgatatacttgtaggtggtggattaacaggtgcagccatgaatcctgctcgcgcatttggacctgctcttgtaagcggagaatggatagatcaaattgtttattggattggtccaattcttggtggattgttagctggtttactttatagcaaattgatgttaaaagatttaacaactttatctactccttccgtttaa

SEQ ID NO: 997 - protein, 232 aa, Candidatus Protochlamydia amoebophila UWE25
MNLAWLLAEFIGTFTLIFIGVGAICLNEMNPGSVGLVGIALAHGLAIAVMVSNVGHISGGKLNPAVSIGVLIGGRSDWKTTVAEIFAQLAGAVFAALCLKIIFPTDVTEVTKLGTPVLADGVSMGIGIMAEAILTFLLVFTVYAAAVDPKGAFKSIAGFTIGGVIIFDILVGGGLTGAAMNPARAFGPALVSGEWIDQIVYWIGPILGGLLAGLLYSKLMLKDLTTLSTPSV

SEQ ID NO: 998 - DNA, 696 bp, Silicibacter pomeroyi DSS-3
  CDS (1)..(696): transl_table=11
atgaccaacaaactaattgcagaagttttcggaaccttctggctggtgctcggcggctgtggcagcgccgtgctcgcggccggagttgcggatgtagggatcggctgggcgggcgtcagcctggccttcggtctcaccgtgctgaccatggcctatgccgtcggccatatctcgggtggccatttcaacccggcggtgtcgctgggcctgatggtggcgggccggttcgacggcaaactgctgctgccctactgggcggcacaggtggtcggggccattctggccgcgcttgttctatacatcatcgtctcgggcggcgcgggctttaccggcgttggtggctttgcctccaacggctatggcgaggcctcgccccagggctattcgatgatgtcgggcctggtgatcgaggtggtgctgaccgccttcttcctgatcatcatcctgggcgccacgtccaagggcgccccggcagggttcgcacccatcgccatcggtctgggcctgacgctgatccatctggtgtcgatcccggtgaccaacacctcggtcaaccccgcccgctcgaccggcgtggcgctgtttgccgacggcccggcgctggcacagctctggctgttctgggtggcaccgctgatcggtggcgccctgggggcggtcctgtggaaggtgatcgccggtaaagacgcggattga

SEQ ID NO: 999 - protein, 231 aa, Silicibacter pomeroyi DSS-3
MTNKLIAEVFGTFWLVLGGCGSAVLAAGVADVGIGWAGVSLAFGLTVLTMAYAVGHISGGHFNPAVSLGLMVAGRFDGKLLLPYWAAQVVGAILAALVLYIIVSGGAGFTGVGGFASNGYGEASPQGYSMMSGLVIEVVLTAFFLIIILGATSKGAPAGFAPIAIGLGLTLIHLVSIPVTNTSVNPARSTGVALFADGPALAQLWLFWVAPLIGGALGAVLWKVIAGKDAD

SEQ ID NO: 1000 - DNA, 699 bp, Pseudomonas fluorescens Pf-5
  CDS (1)..(699): transl_table=11
atgtctttgttcaaacgttctgtcaccgaattgctcggtacgttctggctggtcctgggcggttgcggcagcgccgtgctggcggcggcctttcccaacgtcggtatcggcctgctcggggtcgccctggccttcggcctgacggtgctgaccatggccttcgccatcggccatatctccggttgccacctgaaccccgcggtgtccgtcgggctggtggtgggtggacgctttccggccagggaactgccggcctatatcgtcgcgcaggtgatcggcggggtaatcgccgcggcgctgctgtacttcatcgccagcggcaagccggggttcgaactggcctcggggctggcgtccaacggctatggcgcacactcccccgggggctattccatggccgcgggttttgtctgtgagttggtgatgaccctgatgttcgtggtgatcatcctcggcgccaccgacaaacgcgccccggcggggctggcgcccatcgccatcggcctggccctgaccctgatccacctgatctcgatcccggtcaccaacacctcggtcaacccggcccgcagcaccggaccggcgctgatcgtcggcggctgggcgttgcagcagctgtggatgttctggctggcgccgatccttggcgcagtgatcggcggcgtggtctatcgctggctgggcaaggaagacggctga

SEQ ID NO: 1001 - protein, 232 aa, Pseudomonas fluorescens Pf-5
MSLFKRSVTELLGTFWLVLGGCGSAVLAAAFPNVGIGLLGVALAFGLTVLTMAFAIGHISGCHLNPAVSVGLVVGGRFPARELPAYIVAQVIGGVIAAALLYFIASGKPGFELASGLASNGYGAHSPGGYSMAAGFVCELVMTLMFVVIILGATDKRAPAGLAPIAIGLALTLIHLISIPVTNTSVNPARSTGPALIVGGWALQQLWMFWLAPILGAVIGGVVYRWLGKEDG

SEQ ID NO: 1002 - DNA, 696 bp, Pseudomonas fluorescens PfO-1
  CDS (1)..(696): transl_table=11
atgtctcttttcaaacgttcagtcactgagttgttgggtacgttctggttggtgttgggcggctgcggcagtgcggtcattgccgcgtcttcacccttgggaatcggcgtgctgggggtcgccctggcgttcggtctgacggtgttgaccatggcgtttgccatcggccacatcagcggctgtcacctcaacccggccgtgtcggtcggtctggtcgtcggcggtcggttcccggccaaggaactgcctgcctacgtcatcgcccaggtgctcggcgggattctggcagcggccctgctctaccacatcgccagcggcaaggaaggtttcgacatcgccgcgggccttgcctcaaacggttatggcgaacactcgccgggcaaatactcgatggcgtccggcttcgtcaccgaactggtgatgaccgccatgttcgtggtgatcatcctcggcgccaccgacaagcgcgctccggcaggactggcaccgatcgccatcggcctggccctgacgctgatccacctgatctcgattccggtgaccaacacctcggtcaacccggcccgcagcacgggcccggcgctgatggtcggcggctgggccatcgcccagttgtggatgttctgggtcgcgccgctgctcggtgcggtggtcggcggcgtgctctatcgctggctgggcaaggaagacagctga

SEQ ID NO: 1003 - protein, 231 aa, Pseudomonas fluorescens PfO-1
MSLFKRSVTELLGTFWLVLGGCGSAVIAASSPLGIGVLGVALAFGLTVLTMAFAIGHISGCHLNPAVSVGLVVGGRFPAKELPAYVIAQVLGGILAAALLYHIASGKEGFDIAAGLASNGYGEHSPGKYSMASGFVTELVMTAMFVVIILGATDKRAPAGLAPIAIGLALTLIHLISIPVTNTSVNPARSTGPALMVGGWAIAQLWMFWVAPLLGAVVGGVLYRWLGKEDS

SEQ ID NO: 1004 - DNA, 690 bp, Methylobacillus flagellatus KT
  CDS (1)..(690): transl_table=11
atgaatcgatatggtgcggaatttttgggaacattctggctggtgctgggtgggtgtggcagtgcagtattggctgcagcatttccggaggtgggcatcggcctgcatggcgtatcgctggcattcggcttgacggtgcttacgatggcatttgccattggtcatatttccggctgccatttgaatcccgcagtatcgattggtttgtgggcgggcggtcgcttcgcaggcagccagctgctaccctacattgttgcgcaggtgttgggtgcaatagcggctggcggcgtgctttatctcattgcgagcggccaggccggattcgatgtcactgcaggatttgcttccaatggctacggggagcattcgccaggcggatataccatgacggccgcattggtcgcggaagtggtgctcaccgccttcttcctgttcatcatcatgggcgcgactgaccagcgcgcaccagcaggtttcgcaccgattgcgatcggcctgaccttgaccctgatccacttgattagtatccctgtcaccaacacctccgtgaatccggcgcgcagtaccggcgtggccgtatatgcaggtggctgggccgtagaccagctctggctgttctggatcgcgcctatcgtgggtggtgtgatcggtgcctgggtgtatcgcgctgtggcgggcagtaaagcctga

SEQ ID NO: 1005 - protein, 229 aa, Methylobacillus flagellatus KT
MNRYGAEFLGTFWLVLGGCGSAVLAAAFPEVGIGLHGVSLAFGLTVLTMAFAIGHISGCHLNPAVSIGLWAGGRFAGSQLLPYIVAQVLGAIAAGGVLYLIASGQAGFDVTAGFASNGYGEHSPGGYTMTAALVAEVVLTAFFLFIIMGATDQRAPAGFAPIAIGLTLTLIHLISIPVTNTSVNPARSTGVAVYAGGWAVDQLWLFWIAPIVGGVIGAWVYRAVAGSKA

SEQ ID NO: 1006 - DNA, 705 bp, Ralstonia metallidurans CH34
  CDS (1)..(705): transl_table=11
atgaatattggcaaacgattcacggccgaatggctgggcactttctggctggtcttcggcggatgcggcgccgcggttttcgcagccgccttccctaacgttggtatcggtctgctcggcgtatccctcgcgttcggtctgacggtcgtcaccatggcctatgccatcggcccggtctccggctgccacctcaacccggccgtcaccgttggccttgccgtggccggacgcttcccggtcgccgaagcaccgctgtacatcctggcccagttgctcggcgcgatctgcgccgccggcacgctgctatacctggcaagcgccaatcccggcttcgacctgatggccaatggcctggcaaccaatggctacggcgcggcgtcgccgggcggttatgggctgcgagcggtggtaacgaccgagacactgatgaccgcgttcttcctgatcatcatcatcggcgccaccagctacaggcgcacgcgcgcagcagcaccggtggcaattggcctggcgctgacgctgattcacctgatctcgatcccaatctcaaacacgtcggtcaatcccgcacgctcgacgggtccggcgatcatcgttggcggggtagcgattcagcagttgtgggttttctgggtcgcaccaatctgcggcgcgatcctggccggcctgctcggtcgtctgctgttcgtcaacgaagcggactga

SEQ ID NO: 1007 - protein, 234 aa, Ralstonia metallidurans CH34
MNIGKRFTAEWLGTFWLVFGGCGAAVFAAAFPNVGIGLLGVSLAFGLTVVTMAYAIGPVSGCHLNPAVTVGLAVAGRFPVAEAPLYILAQLLGAICAAGTLLYLASANPGFDLMANGLATNGYGAASPGGYGLRAVVTTETLMTAFFLIIIIGATSYRRTRAAAPVAIGLALTLIHLISIPISNTSVNPARSTGPAIIVGGVAIQQLWVFWVAPICGAILAGLLGRLLFVNEAD

SEQ ID NO: 1008 - DNA, 837 bp, Myxococcus xanthus DK 1622
  CDS (1)..(837): transl_table=11
atggatgcatccagggacagggccgcgctggctcgggcgggcaacccccgcaacaacgacgccgtccggaagtacgttgcggagttcatcgggacgttcgtcctggtgttgggtggcgtcggggcggccgtgctggcgggcgaccacatcggcttccaaggtgtcgcgctcgcctttggcctgtcactgctggccatggtgtacgtgattgggcccatctcgggctgccatgtgaatccggcggtgacgctgggcctcttgctgtcggggaagatggagggcaaggacgcggtcggctacgtggtggcgcagtgcgcgggggccatcctcggcgcgggcgtggtgctgctgattgccaagggcatgcccggtgggtactcggcggtgaccgagggactcgcgaccaacgggtacggcgccgcttcacctgacggcttcaacatgggagcggccttcctcacggaggtggcgctcaccttcttgctcgtgctcacggtgctgggcgcgacggatgcgcgcgccccggtgggcttcgcggggctggccattggcctggtgctggcgctcatccacttggtggggattccggtgacgaacacgtctgtgaatccggcgcgcagcctggggccggcggtgttcgcggggagcgtgcccatggggcagctctggctgttcatcgtggcgccgctcctgggaggcgccaccgcggcggcggtgtatcgcacggtgttccggcctgccgtgcccatcagcgcggaggaggccgagcgggcgctgcggcgcgagcgtgaggcgcgaatcgcggaggatcgggcgggcacgcgcgcgcccgtctga

SEQ ID NO: 1009 - protein, 278 aa, Myxococcus xanthus DK 1622
MDASRDRAALARAGNPRNNDAVRKYVAEFIGTFVLVLGGVGAAVLAGDHIGFQGVALAFGLSLLAMVYVIGPISGCHVNPAVTLGLLLSGKMEGKDAVGYVVAQCAGAILGAGVVLLIAKGMPGGYSAVTEGLATNGYGAASPDGFNMGAAFLTEVALTFLLVLTVLGATDARAPVGFAGLAIGLVLALIHLVGIPVTNTSVNPARSLGPAVFAGSVPMGQLWLFIVAPLLGGATAAAVYRTVFRPAVPISAEEAERALRREREARIAEDRAGTRAPV

SEQ ID NO: 1010 - DNA, 705 bp, Mesorhizobium sp. BNC1
  CDS (1)..(705): transl_table=11
atgaaagcctacatagcggaagtatttggcacattctgccttgtatttatcgggtgcggaagtgtggtgctcggcggcttcgggccgctgattcctacggggggagcgctgggcatcgcggttgcctttggtgtggccgtcttggcaatggcttacgcgattggcccggtctcgggtgcgcatctcaatcccgctgtaacgttgggtgcttttcttgccgggcgattgccggcgaaggacgtcgcaccatacatgattgcacaggtcgcgggcggcattctcggcgctctggtgctctggatcattgcctcgggcaaaacgggtggcgcgcccgccaatctcgccgcgaatggctggagcgaatatacgacaagtgctgctttccttggtgaagtcgtggccaccttcatattcgtgatggtgatcctgggcgcgacctccgagcgtcacacgacggtaatggcaggcgctgttatcggtctgacactcaccgcgatccatatctgtttcatcgccgtcaccggtacctcggtcaatccggcccgatcgatcggaccggctctgttctcgggcggcgcggcgatctctaagctgtggctttttatcgtcgctccgctgatcggcggtgctctggccgggctcgtctacaagtcgcatgcgcttgaaaatacgcaggcggaccttttgaagaaggcaaaggcctga

SEQ ID NO: 1011 - protein, 234 aa, Mesorhizobium sp. BNC1
MKAYIAEVFGTFCLVFIGCGSVVLGGFGPLIPTGGALGIAVAFGVAVLAMAYAIGPVSGAHLNPAVTLGAFLAGRLPAKDVAPYMIAQVAGGILGALVLWIIASGKTGGAPANLAANGWSEYTTSAAFLGEVVATFIFVMVILGATSERHTTVMAGAVIGLTLTAIHICFIAVTGTSVNPARSIGPALFSGGAAISKLWLFIVAPLIGGALAGLVYKSHALENTQADLLKKAKA

SEQ ID NO: 1012 - DNA, 696 bp, Shewanella sp. MR-7
  CDS (1)..(696): transl_table=11
atgaatatgtcacaaaaaatggcggcagaatttttgggcactctgtggctcgttcttggcggctgcggcagcgccgttctggcggcggcctttccagaagttgggataggcttacttggggtggcgttagcctttggtttaacggttctgacgatggcgtttgccattggtcatatttcaggttgccacttaaaccccgccgtatcctttggactctgggctggcgggcgttttccggcatcggaactgctaccttatatcattgcccaagtggcgggtggtattgtcggtgcaggcgtattgtacgccatcgcttcagggcaagaaggttttagtctcgcggcgggctttgcttctaacggctttggcgaacattcgcccggcggttacagcatgatgtcggtgttgatctgcgaaatcgtgatgaccttgttctttttattggtgattttaggggcgaccgacgagcgagcacctaaaggctttgcgcctattgcgattggtctgtgtttaactcttatccacttgatcagcattcccgtgtcaaacacctcggtcaatccggcccgcagtacaggccctgcgctgtttgtcggcgattgggccgtatcgcaactgtggattttttgggtcgctcctatccttggtgccattctcgccggcgtgatttaccgttatttcaacgctgctaagtaa

SEQ ID NO: 1013 - protein, 231 aa, Shewanella sp. MR-7
MNMSQKMAAEFLGTLWLVLGGCGSAVLAAAFPEVGIGLLGVALAFGLTVLTMAFAIGHISGCHLNPAVSFGLWAGGRFPASELLPYIIAQVAGGIVGAGVLYAIASGQEGFSLAAGFASNGFGEHSPGGYSMMSVLICEIVMTLFFLLVILGATDERAPKGFAPIAIGLCLTLIHLISIPVSNTSVNPARSTGPALFVGDWAVSQLWIFWVAPILGAILAGVIYRYFNAAK

SEQ ID NO: 1014 - DNA, 681 bp, Hyphomonas neptunium ATCC 15444
  CDS (1)..(681): transl_table=11
atgaaacccctgatcgctgaacttatcggcacattcgccctggtcctgtttggctgtggttctgctgtcctcgccggaggcgaggttggccagttaggtatcgcgttcgctttcggcctggccatcgtcgccatggcctatggcatcggccccatctcgggctgccacgtcaatccggcggtcagcttcggcgccttcatcgccgggcgtatgacgctcaactccatgttccagtactggatcgcccagttcatcggggccgtgctcggcgccgccgtcctctatctcatcgcctcaggcaaggcaggctatgacctggccgcaaacgggcttggccagaatggctggggcgcagggtatctgggcgaatacagcctcgtctcggcgctggtcttcgagattgtcgccaccttcctgttcctcgtcgtgatcctgggcgccacccagaaatccgcgcccggaatggtcgctggcctcgccatcggcctcacgctcgcggtcatccacattgtcggcatccaggtcaccggcgtctcggtaaaccccgcccgcagcttcggccccgccgtcatcgtgggcggcgcggcaatctcccagctctggctgttcttcgtcgccccgcttatcggcgcagcgctcgccggcatcctcttccgccagaaactcctggaaacggaatag

SEQ ID NO: 1015 - protein, 226 aa, Hyphomonas neptunium ATCC 15444
MKPLIAELIGTFALVLFGCGSAVLAGGEVGQLGIAFAFGLAIVAMAYGIGPISGCHVNPAVSFGAFIAGRMTLNSMFQYWIAQFIGAVLGAAVLYLIASGKAGYDLAANGLGQNGWGAGYLGEYSLVSALVFEIVATFLFLVVILGATQKSAPGMVAGLAIGLTLAVIHIVGIQVTGVSVNPARSFGPAVIVGGAAISQLWLFFVAPLIGAALAGILFRQKLLETE

SEQ ID NO: 1016 - DNA, 687 bp, Rhizobium leguminosarum bv. viciae 3841
  CDS (1)..(687): transl_table=11
atgcaaaagagtcttgttgccgaatttctcggcacgttctggctggtcttcggcggatgcggcagtgccgtgctggccgcggcctatcccgagcttgggatcggttttgtcggagtggcctttgcgttcggtctgacggtgctcaccatggcctatgccgtgggcggcatttcgggcggtcatttcaatcccgcggtctcgctcggccttacggtcgccggacggtttccggcggggcgcctcgttccctatatcgtcgtgcaggttgtcggcgccatcgccgcggcggcgctgctttatctcatcgccagcggcaaggcgggtttcgaactcgggggctttgccgccaacggatatggcgatcattctccgggcggttattcactgctttcggcgctgctgatcgaagtgctgctgaccatgttcttcctgatcatcatcctgggatcgaccagcagccgggtgcctgcgggcttcgcgccgcttgcgatcggcctcgggctgacgctgatccatctcgtttctatccctgtgacgaatacctcggtcaatccggcacgttccaccggccaagcgcttttcgtcggcggctgggcgctgcagcagctctggctgttctggattgcgccgcttgcgggtggggcgctcggcgggctcgtctggaaattcctcgacgacgccgactga

SEQ ID NO: 1017 - protein, 228 aa, Rhizobium leguminosarum bv. viciae 3841
MQKSLVAEFLGTFWLVFGGCGSAVLAAAYPELGIGFVGVAFAFGLTVLTMAYAVGGISGGHFNPAVSLGLTVAGRFPAGRLVPYIVVQVVGAIAAAALLYLIASGKAGFELGGFAANGYGDHSPGGYSLLSALLIEVLLTMFFLIIILGSTSSRVPAGFAPLAIGLGLTLIHLVSIPVTNTSVNPARSTGQALFVGGWALQQLWLFWIAPLAGGALGGLVWKFLDDAD

SEQ ID NO: 1018 - DNA, 651 bp, Pediococcus pentosaceus ATCC 25745
  CDS (1)..(651): transl_table=11
atgaagaaatatgtttcagaaattattggtacgttcgtacttgtttttgttggtactgccgctgttacaattggtaaagccgacgttttaggaattggattagcttttggtttggctgttacgattatggcttactctgttggtgcaatttcaggaggacactttaacccagctgttacattaggtatgtggattaataagcgaatcagtggagcagatgctatttattatgttatttcacaatttattggtgctgtcctggcttcaggaatggttaagtatttcctaagtgctatgggagcttcaactagcaatcttggacaaactgattttgcaaaaatctcagcatttccagcactcgtaactgaaactttggtaacattcctatttgtgcttgttatcttgctagttacaagtaaaaagtatggtaatgctaactttgctggtttaattattggattaacgctagcattcatgattattgcatcattgaacttaactggcggttcattgaaccctgctcgtagttttggtcctgcaatcttagttggtggttcagctttatctcactactgggtttacgttgtggctccattattaggtgctgcaattgctgcttttgttgctaaggcaatgggtagcgaagaataa

SEQ ID NO: 1019 - protein, 216 aa, Pediococcus pentosaceus ATCC 25745
MKKYVSEIIGTFVLVFVGTAAVTIGKADVLGIGLAFGLAVTIMAYSVGAISGGHFNPAVTLGMWINKRISGADAIYYVISQFIGAVLASGMVKYFLSAMGASTSNLGQTDFAKISAFPALVTETLVTFLFVLVILLVTSKKYGNANFAGLIIGLTLAFMIIASLNLTGGSLNPARSFGPAILVGGSALSHYWVYVVAPLLGAAIAAFVAKAMGSEE

SEQ ID NO: 1020 - DNA, 774 bp, Mycobacterium smegmatis str. MC2 155
  CDS (1)..(774): transl_table=11
atgcgaacgccaaccatgacccaccgcttgaccgccgagttcgtcggcaccttctggctggtgctcggcggatgtggcagcgcagtcttcgccgcgaagttcgtcgccgacgacggcgtgtctctggggatcggattcctcggcgtcgccttggcgttcggcctgacggtgctcaccggcgtttacgcgttcggcgtcatctcgggcggccacttcaacccggcggtcacgctgggtgccgcactcgccaaacgggtggagtggggtgcggtgctgccgtactggatcgtgcaggtgatcggcggcctgctggccggcctggtgatctatgtggtcgccaagggcaaagaggggtggagcgccatcggcaacatggccgccaacggctacggcgagcactcgcccgggggttactcactggtcgcggtgctgatcgccgagatcgtgctcaccgggatcttcctgctcgtgatcctggggtccaccgacgatcgcgcgcccaaggggttcgcgggcctgtcgatcggcctgacattgaccctgatccacctgatctcgatcccgatctcgaacacgtcggtgaacccggcgcgttcgacggcggtcgcgttcttcaacggcgacggtgcgcccgcgcaactgtgggcgttctggctggcccccctggtcggcgccgccatcgcgggcgtcgcgtatccgtacctgttcggggtggcagaagaactggccgagcgcccggtgcgcgacgacgcgctcgacgaccgacgcggctga

SEQ ID NO: 1021 - protein, 257 aa, Mycobacterium smegmatis str. MC2 155
MRTPTMTHRLTAEFVGTFWLVLGGCGSAVFAAKFVADDGVSLGIGFLGVALAFGLTVLTGVYAFGVISGGHFNPAVTLGAALAKRVEWGAVLPYWIVQVIGGLLAGLVIYVVAKGKEGWSAIGNMAANGYGEHSPGGYSLVAVLIAEIVLTGIFLLVILGSTDDRAPKGFAGLSIGLTLTLIHLISIPISNTSVNPARSTAVAFFNGDGAPAQLWAFWLAPLVGAAIAGVAYPYLFGVAEELAERPVRDDALDDRRG

SEQ ID NO: 1022 - DNA, 828 bp, Mycobacterium sp. KMS
  CDS (1)..(828): transl_table=11
atgcgagagccgaccatgatgcatcgggtggccgccgagttcatcggaacgttctggctggtcttcggcggctgcggcagcgcggtgttcgccgccaagtacacctcggccgacggatacgcgttcggcatcgggttcctcggcgtctcgctcgccttcggtctcacggtgctcaccggcgtgtacgcgttcgggacgatctccggcgggcacttcaaccccgcggtcacgctgggcgcggcactggcccgacgggtcgaatggcgtgtgctgccggcctactggctcacccaggtgatcgccggcgtggcggccggactcgtcatctacgtcatcgccaaggggcgtgaggggtggaccgccaccggaaacatggccgccaacggctacgccaaccactcgccggcgggctattcgctgctggccgtcgtcatcgccgaggtcctgctgacgggcatcttcctcctggtgatcctcggcgccaccgacacccgcgccccgaaggggttcgccgggctggccatcgggctgaccctgaccctgatccacctgatctcgatcccgatctcgaacacctcggtgaaccccgcccgctccaccggcgtggcgttcttcaacggcaacgaggcgcccgcgcagctgtgggtgttctggatcgccccccttctcggcgccgccatcgccggcgcggcctacccgtacctgttcgggcgacacgaggaactggccgatcggccggtccgcgacgaaacgctcgacgcccaggtgcgcgccgaggacgtcgcggacgcgcgcctacgacgtggtcccgacccagaggtccggtag

SEQ ID NO: 1023 - protein, 275 aa, Mycobacterium sp. KMS
MREPTMMHRVAAEFIGTFWLVFGGCGSAVFAAKYTSADGYAFGIGFLGVSLAFGLTVLTGVYAFGTISGGHFNPAVTLGAALARRVEWRVLPAYWLTQVIAGVAAGLVIYVIAKGREGWTATGNMAANGYANHSPAGYSLLAVVIAEVLLTGIFLLVILGATDTRAPKGFAGLAIGLTLTLIHLISIPISNTSVNPARSTGVAFFNGNEAPAQLWVFWIAPLLGAAIAGAAYPYLFGRHEELADRPVRDETLDAQVRAEDVADARLRRGPDPEVR

SEQ ID NO: 1024 - DNA, 741 bp, Magnetospirillum magnetotacticum MS-1
  CDS (1)..(741): transl_table=11
atggatcacgatacgctgcgtcggaccaccgccgagttcttcggcaccttctggttgaccttcggcggctgcggcgccgccgtgctctccgccgcctttccggaactcgggatcggcttcctgggggtggccttcgccttcggcttcaccgtgctcaccatggcctatgccgtcggccacatctccggcggccacttcaatccggcggtcacgctgggcttgtggtcggcccggcgctgcgccaaccggcacgtgctgccctacatcgttgcccaggtgatcggcgcaatcgtggcggccttcgccctctacaccatcgcgtccggcaaggccggctgggttccgaacggcttcgcctcgaacggctacggcgcgctcagccccggcaagtacggcctcgcggcctgcctgctcaccgaggtgctgacgaccttcatcttcctgttcatcatcgtcggcacgacctcgaagggggccgcgaccggctttgccggcattcccatcgggctcgccctggtgctgatccacctgatctcgatcccggtgaccaacacctcggtcaacccggcccgcagcaccggcccggccctgttcgccggcggagaatacgttgcccaactctggatgttctggctcgcccccatcgtcggcgcgatcgcggccggggcgatggcacgctggctctacgagcccgcggatgtggtcgataccaccatcgtcgagcgccgcgccgaggtgtga

SEQ ID NO: 1025 - protein, 246 aa, Magnetospirillum magnetotacticum MS-1
MDHDTLRRTTAEFFGTFWLTFGGCGAAVLSAAFPELGIGFLGVAFAFGFTVLTMAYAVGHISGGHFNPAVTLGLWSARRCANRHVLPYIVAQVIGAIVAAFALYTIASGKAGWVPNGFASNGYGALSPGKYGLAACLLTEVLTTFIFLFIIVGTTSKGAATGFAGIPIGLALVLIHLISIPVTNTSVNPARSTGPALFAGGEYVAQLWMFWLAPIVGAIAAGAMARWLYEPADVVDTTIVERRAEV

SEQ ID NO: 1026 - DNA, 969 bp, Bifidobacterium longum DJO10A
  CDS (1)..(969): transl_table=11
atggaagaaaccaagcaacagccgctggctctgcgcgtgtgcgccgaattggccggcagcttcctgctgtgctttgccatttacgccttctccacatggggttcggccgtgtatggcatcaatatcgtgttcttcgcgttggctaccggcttggcatatgccgcagtcaccgccatcttctcccgcgtgtccggtggccagctgaatccggccatcaccgtagcctccgtgctggtttccaagacgaaaatcctggatggcatcctctatgtgatcgctcaggtcatcggtgccatcgccgctggcttcgccgtggtcaagctgctgcccacatccgagcaggtagctgccaaagtgtggctgactccggccgttaacggtttcgaaaacggctccgtgtcttactcgctgctgacccagtatggcattacgttctcgattacgctggcgattgtcgtcgaggtcgttgcctctctgattgtcgttgccaccgccatgtcttctctgggtgatcacggcgagtcctcggaccgtcatgccattgccatgggtcttgcctatggtctggccaccgccatcagctacccggttaccggtgccggtctcaatcccgcccgttccaccggtatcgcactggccgcgatgaatgagggtcttacgcaaaatccgctgcagcagctgtgggtattctggattagcccggtcttggccgccgctgtggtggcgttggtcatgatcatcgcgcagatgatgaccactcccaaagtgccggctgccgccgatcttccgcagacggatgccgatgcaaacgcggacacgctcgacgatggcgaattcttcgatcaggccgcctcgtctgatggcgattcagcggaaaaagatgttgccgaagagtccaaagaagctgaagtaggtaatcagcaggccgattcccaaggcgatgccgatgaaggagtcgaacgccactga

SEQ ID NO: 1027 - protein, 322 aa, Bifidobacterium longum DJO10A
MEETKQQPLALRVCAELAGSFLLCFAIYAFSTWGSAVYGINIVFFALATGLAYAAVTAIFSRVSGGQLNPAITVASVLVSKTKILDGILYVIAQVIGAIAAGFAVVKLLPTSEQVAAKVWLTPAVNGFENGSVSYSLLTQYGITFSITLAIVVEVVASLIVVATAMSSLGDHGESSDRHAIAMGLAYGLATAISYPVTGAGLNPARSTGIALAAMNEGLTQNPLQQLWVFWISPVLAAAVVALVMIIAQMMTTPKVPAAADLPQTDADANADTLDDGEFFDQAASSDGDSAEKDVAEESKEAEVGNQQADSQGDADEGVERH

SEQ ID NO: 1028 - DNA, 723 bp, Synechococcus sp. WH 5701
  CDS (1)..(723): transl_table=11
atgtcgaggaaattcctcgctgagatgatcggcaccttttggttggtgttcggaggttgcggcagtgctgtcctggccgctgtgtttccttacgaccaagccggggccaatccccttgggctcggtttccttggggtttcgctggctttcggcctcaccttgttgaccatggcttacgccatcggccacatctccggttgccacatcaatccagcggttacgttcggcctctgggccagcggccgccatcctggttcgcagctgcttccttacatcgccgcccaagtgctgggggggctgattgctgggggcctccttctgggcatcgccggtggtcgtcccggcttcgagctgacgggtagcaaccccctcgccaccaacggtttcggggcccactcccccggtggttacggcctggtgtcagctctggtgatcgaggtggttctcaccttcatcttcctgctcatcatcctgggggtcacccacaaggatgcgatcaaggacctggccggcgtgccgatcggcctcagcctggtgctgattcacctgatcagcatcccgatcaccaacacctcggtcaacccggcccgcagcactggcgtggcgttctgggcaggcggcgatgccatgggtcagctgtggctgttctggctggcgccgatcgtcggcgccctgctggccggctgggtgcagcgcaacctgctggatggtccgaaggactga

SEQ ID NO: 1029 - protein, 240 aa, Synechococcus sp. WH 5701
MSRKFLAEMIGTFWLVFGGCGSAVLAAVFPYDQAGANPLGLGFLGVSLAFGLTLLTMAYAIGHISGCHINPAVTFGLWASGRHPGSQLLPYIAAQVLGGLIAGGLLLGIAGGRPGFELTGSNPLATNGFGAHSPGGYGLVSALVIEVVLTFIFLLIILGVTHKDAIKDLAGVPIGLSLVLIHLISIPITNTSVNPARSTGVAFWAGGDAMGQLWLFWLAPIVGALLAGWVQRNLLDGPKD

SEQ ID NO: 1030 - DNA, 690 bp, Photobacterium sp. SKA34
  CDS (1)..(690): transl_table=11
atgagaaaattggttgccgagtttatcggtacattctggttagtactaggtggttgtggtagtgcggttctggctgctgcttatcctgatttaggcatcggtttcctcggtgtagcactagcattcggtttgactgttgtaactatggcatacgcgattggtcatatttctggctgccacttaaacccagcagtgactgttggtctatgggctggtaatcgtttccctactggtgaagttgtaccttatattatctctcaagtacttggcggtatcgctggtgctgctgtactttacgttattgcaagtggtcatgctggtttcgatctagctggcggtttcgcatcgaacggttatggtgaacactcacctggtcactactcattattatcttctttcgttactgaagtagtcatgacgtttatgttcctatttgtgattttaggtgcgacccacaaactagcatcaccacaaatggcaggtttagccattggtcttgccctaacacttattcacctaatcagtattcctgtaacaaacacatcggttaacactgcacgtagtacaggtcctgctttgtttgttggcgattgggcaacatctcaactttggatgttctgggttgcgccacttatcggtgcggttctagctggttggatataccgttggttagcaccaaataacgactaa

SEQ ID NO: 1031 - protein, 229 aa, Photobacterium sp. SKA34
MRKLVAEFIGTFWLVLGGCGSAVLAAAYPDLGIGFLGVALAFGLTVVTMAYAIGHISGCHLNPAVTVGLWAGNRFPTGEVVPYIISQVLGGIAGAAVLYVIASGHAGFDLAGGFASNGYGEHSPGHYSLLSSFVTEVVMTFMFLFVILGATHKLASPQMAGLAIGLALTLIHLISIPVTNTSVNTARSTGPALFVGDWATSQLWMFWVAPLIGAVLAGWIYRWLAPNND

SEQ ID NO: 1032 - DNA, 690 bp, Xanthobacter autotrophicus Py2
  CDS (1)..(690): transl_table=11
atgaacaagtatgtggccgagttcatcggcactgcggtgctggtgctgttcgggtgtgggtctgcggtgctgacgggctacggctcggcgcccatcggcatgctcgccatcgcgttcgccttcggccttgcggtcacctccatggcctatggcatcggccacgtgtcgggctgccacatcaatccggcggtcaccatcggcgtctgggcggcagggcgcctgcccacctctgaggtgcccatgtacatcgtcgcccaggtgctgggcggcatcgccggcgcggccatcctcttcgtcattgcctcgggcaagcttgccggcttcgatgtggcgacctcgggccttggccagaacggctggggcgagggctatatcggcggctacgggctcggcgcggccatcgtggcggagctggtgggcaccttcgtgttcctggtggtgatcctcggctccacctccaaggccggcatcacccaggcggcgggcctcgccatcggcctgtcgctggtgatgatccacatcgtgttcatcccggtcaccggcgtgtcggtgaacccggcccgctccatcggaccggccctgttcgccggcggcaaggccatcagccagctctggctgttcatcgtggtgccgctggtgggtgcttatctggccggcctgctgttcaagctgaaggtgctggaggactga

SEQ ID NO: 1033 - protein, 229 aa, Xanthobacter autotrophicus Py2
MNKYVAEFIGTAVLVLFGCGSAVLTGYGSAPIGMLAIAFAFGLAVTSMAYGIGHVSGCHINPAVTIGVWAAGRLPTSEVPMYIVAQVLGGIAGAAILFVIASGKLAGFDVATSGLGQNGWGEGYIGGYGLGAAIVAELVGTFVFLVVILGSTSKAGITQAAGLAIGLSLVMIHIVFIPVTGVSVNPARSIGPALFAGGKAISQLWLFIVVPLVGAYLAGLLFKLKVLED

SEQ ID NO: 1034 - DNA, 699 bp, Pseudomonas putida GB-1
  CDS (1)..(699): transl_table=11
atgagcatgtccctcggtaaacgcatgggtgccgaactgatcggtaccttctggctggtgcttggtggctgcggcagtgcggtactcgcagccagttcccctgtcggcatcggcgtactcggtgttgccttcgccttcggcctcaccgtgctgaccatggccttcgccatcggccatatctctggctgtcaccttaatcctgctgtgtcctttgggctggtggtgggcgggcgttttcctgccaaagagctgctgccctacgtgattgcgcaagtgatcggcgccatcctggcggcaggagtgatctacctcatcgccagcggcaaggccggtttcgaattgtcctcggggctggcgtccaacggctatgccgaccattcgcccggcggctacacgctgggggcaggctttgtcagtgaagtggtgatgacggcgatgttcctggtggtgatcatgggcgcgaccgattcccgcgcaccagcaggctttgcgcccatcgccatcggtctggccctgaccctgattcacctgatctccatcccggtgaccaatacctcggtcaaccccgcgcgcagcacggggccggcattgttcgttggcggttgggccttgcagcagctgtggctgttctgggtggcgccgctgatcggtgctgcaatcggcggcgcgctgtaccggggcctggcgaaagaaccttag

SEQ ID NO: 1035 - protein, 232 aa, Pseudomonas putida GB-1
MSMSLGKRMGAELIGTFWLVLGGCGSAVLAASSPVGIGVLGVAFAFGLTVLTMAFAIGHISGCHLNPAVSFGLVVGGRFPAKELLPYVIAQVIGAILAAGVIYLIASGKAGFELSSGLASNGYADHSPGGYTLGAGFVSEVVMTAMFLVVIMGATDSRAPAGFAPIAIGLALTLIHLISIPVTNTSVNPARSTGPALFVGGWALQQLWLFWVAPLIGAAIGGALYRGLAKEP

SEQ ID NO: 1036 - DNA, 935 bp, Gossypium hirsutum
  CDS (1)..(870)
atggagggcaaagaagaggatgttagattgggagccaacaagttcacagagaggcaaccaattgggaccgcggctcagagtcaagatgacgggaaagactacactgaaccaccaccggctccatttttcgagcctggcgagttaacctcatggtctttttatagggctgggattgccgagtttgtggcgactttccttttcttgtatatcactattttgactgttatgggagttgttaaggaaaaaactaagtgcccaactgttgggattcaaggaattgcttgggcttttggtggtatgatctttgctcttgtttactgcactgctggcatttcaggtggccatatcaacccggcagtgacttttggactgttcttggcgaggaagctgtcgttgacgagggcaattttctacatggtgatgcagtgtttgggcgccatatgcggggcgggtgtggtgaaaggtttcatggggaagactcagtacggtatgttgggcggcggagctaactcggtggctcatggctacacaaaaggtgatggccttggtgctgaaattgtcggcacctttgttcttgtttacactgtcttctcagccactgacgccaagcgcagcgcccgagactctcatgtccctattctggcaccattgccaattgggttcgcagtgttcttggtacacttagccaccatcccaatcactggaactggtattaacccggctcgtagtcttggtgcagccatcatcttcaacaaggacaagggctgggatgaccattggattttctgggtgggaccattcattggtgcagcactagcagcactctaccacgttgttgtgatcagagccattcctttcaaatcaaagtgatgagattaagatcaagagtcatgattccatgattatgagcttaagttaaacaaaaaaaaaaaaaa

SEQ ID NO: 1037 - protein, 289 aa, Gossypium hirsutum
MEGKEEDVRLGANKFTERQPIGTAAQSQDDGKDYTEPPPAPFFEPGELTSWSFYRAGIAEFVATFLFLYITILTVMGVVKEKTKCPTVGIQGIAWAFGGMIFALVYCTAGISGGHINPAVTFGLFLARKLSLTRAIFYMVMQCLGAICGAGVVKGFMGKTQYGMLGGGANSVAHGYTKGDGLGAEIVGTFVLVYTVFSATDAKRSARDSHVPILAPLPIGFAVFLVHLATIPITGTGINPARSLGAAIIFNKDKGWDDHWIFWVGPFIGAALAALYHVVVIRAIPFKSK

SEQ ID NO: 1038 - DNA, 1105 bp, Gossypium hirsutum
  CDS (1)..(861)
atggctaaggacattgaggttggtggtgagttccaggccaaggactaccatgatcctccacccgctccattggtcgacgctcaggagttagccaagtggtctttttacagggctgtcatagctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtaacctttggacttttcttggctaggaaggtgtcgttggttcgagccatattttacatgggtgctcagtgtttgggagccatatgtgggtgtgggctggtcaaggccttccaaaactcgtactacaaccagtatggaggaggagccaacagcctggctgaaggatacagcactggaactggtttggcggctgaaatcatcggcacctttgtccttgtctacactgttttctctgcaactgatcccaagaggaatgcaagagactcccatatccctgtagtcttggcaccacttcccattgggtttgctgtgttcatggttcacttagccactattcccatcaccggaaccggtatcaacccggctcgtagtttgggggctgctgttatcttcaaccaggacaagatatgggatgaccattggatattctgggtaggaccttttattggagctgccattgccgcaatctatcaccagtttatattgagggcatccggtgctaaagctctgggatccttcaggagcagctttgccatgtaaaatctgttgaagcaagaactgtgcagccatgagttcaaagtaaaggctggcatgcttggatgaatgaaatgaagttttcttcagaccattgaatttgtaaagaataatcaaagtgtaatgcttcttctctatgcatgtggcacttatttttaatgtgcctcaaactttgctttatttaaatggagttcagttccttttcctttttcttaaaaaaatttggaaaaaaaaaaaaaaaaaaaaaaaa

SEQ ID NO: 1039 - protein, 286 aa, Gossypium hirsutum
MAKDIEVGGEFQAKDYHDPPPAPLVDAQELAKWSFYRAVIAEFIATLLFLYITVLTVIGYKTQTDPAKGGEDCGGVGILGIAWAFGGMIFILVYCTAGISGGHINPAVTFGLFLARKVSLVRAIFYMGAQCLGAICGCGLVKAFQNSYYNQYGGGANSLAEGYSTGTGLAAEIIGTFVLVYTVFSATDPKRNARDSHIPVVLAPLPIGFAVFMVHLATIPITGTGINPARSLGAAVIFNQDKIWDDHWIFWVGPFIGAAIAAIYHQFILRASGAKALGSFRSSFAM

SEQ ID NO: 1040 - DNA, 1050 bp, Iris hollandica
  CDS (23)..(1006)
gtgagtttgggggaaaatcgaaatggaggggaaagaggaggatgtgaagctgggcgcgaacaagttctcggagaggcagccgatagggacggcggcgcaggtggcggacgagagcaaggactacaaggagccgccgccggcccccctgttcgagcccggggagctgaagtcgtggtccttctacagggcgggcatcgcggagttcatagccaccttcctcttcctctacataaccatcctcaccgtcatgggcgtctccaagtccaagtccaagtgcgccaccgtcggcatccagggcatcgcctggtccttcggcggcatgatcttcgccctcgtctactgcaccgccggcatctccggtggtcacataaaccctgcagtgaccttcggcctgttcttggcaaggaagttgtccctcaccagggccgtcttctacatggtgatgcagtgcctgggcgcaatctgcggcgccggcgtcgtcaaggggtacgggaagatgctctaccagacccagggcgggggcgccaacgtcgtcgcccccggctacaccaagggcgacggcctcggcgccgagatcgtcggcacctttgtcctcgtctacaccgtcttctccgccaccgacgccaagaggaacgccagggactctcatgtgccgatccttgctcccctgccaattggctttgctgttttccttgtccacttggctaccatccccatcactggcactggcatcaaccctgcaaggagtcttggggctgccatcatctacaacaatgaccatgcttgggatgaccattggattttctgggtgggaccattcattggagctgcacttgctgccatgtaccaccagattgtcatcagagccatcccattcaagagcaggtccttgaaattgtttgtgtttgatcatcatttctgctgcaatgtccctgtcttctctttaaatatttgctatgccaactattatgtactattccagctctgctgtttgttaagtttgtaaatcaagttatgctgtacttaaattccaaaaaaaaaaaaaaaaaa

SEQ ID NO: 1041 - protein, 327 aa, Iris hollandica
MEGKEEDVKLGANKFSERQPIGTAAQVADESKDYKEPPPAPLFEPGELKSWSFYRAGIAEFIATFLFLYITILTVMGVSKSKSKCATVGIQGIAWSFGGMIFALVYCTAGISGGHINPAVTFGLFLARKLSLTRAVFYMVMQCLGAICGAGVVKGYGKMLYQTQGGGANVVAPGYTKGDGLGAEIVGTFVLVYTVFSATDAKRNARDSHVPILAPLPIGFAVFLVHLATIPITGTGINPARSLGAAIIYNNDHAWDDHWIFWVGPFIGAALAAMYHQIVIRAIPFKSRSLKLFVFDHHFCCNVPVFSLNICYANYYVLFQLCCLLSL

SEQ ID NO: 1042 - DNA, 1213 bp, Phaseolus vulgaris
  CDS (32)..(901)
ggaaatccgaggcaagaagaaggaaaaaaacatggaggggaaggagcaggatgtgtcgttgggagcaaacaagtacgccgagagacaacccattggtaccgcggcacagagccaagacgacggcaaggactaccaggcgccaccgccggcgccgctgtttgagccctcggagcttacgtcatggtcgttctacagagcacccatagcagagtttgttgccacttttctgtttctctacatcaccgtcttaaccgtcatgggtgtcctcaggtcccctaccaagtgccaatccgttggtattcaaggaatcgcttgggccttcggtggcatgatcttcgccctcgtttactgcaccgccggaatctcagggggtcacataaaccctgcggttacgtttgggctgttcttggcaaggaaattgtcgttgaccagggcgttgttctacatagtgatgcaagtgttgggtgccatcgccggcgctggagcggtgaagggtttcgagggaaaaaccagattcggtcgattgaacggtggcgctaactttgttgcccctgggtacacaaaaggtgacggacttggtgctgaaattgttggcacctttgtccttgtttacaccgttttctcagccaccgatgccaaacgatgcgcaagagactctcacgtccccattctggcacctttaccaattgggttcgctgtgttcttggttcacttggccaccatccccatcaccggagctggtatcaatcctgctcgtagtctcggtgccgccatcatcttcaacaaagaccttggctgggacgatcactggatcttctgggtgggaccattcatcggtgcggctctcgctgcactctaccaccaggtcgtaatccgcgccattcccttcaagtccaagtgattgaatcaaacggttcatgcttaatcaatcaagttggggaaaaaaatcaagcaatgtttgtgggcttttcggtttcatttctccaatgatctgtttcatctttttttttttttgcttttaatttaaagtcttgtattttgtatgtatagatgtaaacttatgattattaggtggtgcatgtgtcgcgtaatgggccagttatcctctgcttttaagttggcaagaggccagctctatgtgtgatgtacggctgtgattgtgtattattatgcaaaatttaaaaataacagcagagtcatttatgaatctttt

SEQ ID NO: 1043 - protein, 289 aa, Phaseolus vulgaris
MEGKEQDVSLGANKYAERQPIGTAAQSQDDGKDYQAPPPAPLFEPSELTSWSFYRAPIAEFVATFLFLYITVLTVMGVLRSPTKCQSVGIQGIAWAFGGMIFALVYCTAGISGGHINPAVTFGLFLARKLSLTRALFYIVMQVLGAIAGAGAVKGFEGKTRFGRLNGGANFVAPGYTKGDGLGAEIVGTFVLVYTVFSATDAKRCARDSHVPILAPLPIGFAVFLVHLATIPITGAGINPARSLGAAIIFNKDLGWDDHWIFWVGPFIGAALAALYHQVVIRAIPFKSK

SEQ ID NO: 1044 - DNA, 900 bp, Brassica campestris
  CDS (19)..(879)
gaagacgaaactcaagagatggaaggcaaggaagaagatgttagagtcggagctaacaaattccccgagagacaacccatcggtacatcggctcagagcgacaaagactacaaggagccgcctcctgcgccgttgttcgagcccggcgagcttgcgtcgtggtccttctggagagccggaatcgccgagttcatcgccacgtttctcttcctttacatcactgtgttgaccgtcatgggtgtgaagaggtcaccgagcatgtgtgcttccgtcggaatccaaggcatcgcttgggctttcggtggtatgatcttcgctctcgtctactgtacggctggtatctccggtggacacatcaacccagcagtcacgtttggtctgtttcttgcaaggaagctttcgctcacacgagctgtgtactatatagtgatgcagtgcttaggagccatctgtggagctggtgtggtcaaggggttccaaccaaagcagtaccaagctctaggaggtggagctaacacggttgctcctggttacaccaaaggaagtggtctcggtgctgagattattggaacctttgtgctagtttacaccgtcttctcagctactgacgctaagagaaacgctcgtgactctcatgttcctattcttgcacctcttccaatcggattcgctgtgttcttggtccacttggcaaccatcccaatcactggaactggaatcaacccagcaagaagtcttggagctgcaatcatcttcaacaaggacaatgcttgggacgaccattgggtgttttgggttggaccattcatcggcgctgcacttgctgctctttaccacgtgatagtcatcagagccatcccattcaagtccagaagctgattgacttactcttcaaaaaaa

SEQ ID NO: 1045 - protein, 286 aa, Brassica campestris
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1046 - DNA, 1112 bp, Nicotiana excelsior
  CDS (46)..(903)
ccgtcctcaatttgagtaaattttcctgtgaattgagaaaacaaaatggagaacaaagaagaagatgtaagattaggagcaaacaaatattcagagaggcaagcgattgggacggcagcgcagagtgacaaggattatacagagccaccaccagcgccactgtttgaggcaggagaattgacgtcttggtcattctatcgtgctggaattgctgagttcatggccactttcctcttcctttacatcactatcttaacagtgatgggtgtttcaaaatctgaatccaaatgctccactgttggtattcaaggcattgcttgggcttttgggggcatgatttttgcccttgtttactgtactgctggcatttctggaggacacataaatccagctgtgacctttgggctgttcttggcaaggaaattgtcgttgacaagggcagtgttctacatggtgatgcagtgtcttggtgctatatgtggtgctggtgtggtcaaagggttcggcaaaactctttatcaaacaaagggtggtggtgccaatgttgtaaatcatggttacacaaagggatcaggtcttggtgctgagatcgttggcacttttgttcttgtttacactgttttctctgccacagatgctaagcgtagtgctagggattcacatgtccctattttggcaccattgcctattggatttgcggtgttcttggtacacttggccacaattccaatcactggaactggtattaacccagctaggagtcttggcgcagccatcatctacaaccaagaccacgcatgggatgaccactggattttctgggttggacctttcattggagcagcactagcagctctgtaccaacaggtggtgatcagggcaatcccatttaagtccaagtgaaatctcttttaaccacagatttctcaagcttaatcatcatcatctggtcaaagatcaaaagcctaatttctgcccatttcccctttgcattagatcctctttttcttttggttttgttttctataactatgtatttgtaagtctcgtaagtgggagaatgtatctgatgggggcatatttattatctataaaaaggatcttcgcttctc

SEQ ID NO: 1047 - protein, 285 aa, Nicotiana excelsior
MENKEEDVRLGANKYSERQAIGTAAQSDKDYTEPPPAPLFEAGELTSWSFYRAGIAEFMATFLFLYITILTVMGVSKSESKCSTVGIQGIAWAFGGMIFALVYCTAGISGGHINPAVTFGLFLARKLSLTRAVFYMVMQCLGAICGAGVVKGFGKTLYQTKGGGANVVNHGYTKGSGLGAEIVGTFVLVYTVFSATDAKRSARDSHVPILAPLPIGFAVFLVHLATIPITGTGINPARSLGAAIIYNQDHAWDDHWIFWVGPFIGAALAALYQQVVIRAIPFKSK

SEQ ID NO: 1048 - DNA, 1116 bp, Nicotiana excelsior
  CDS (66)..(929)
gttttgtactatcccacttagcacaaaaaagagagaaaaacaagctaagtttagtgagtgttcaaatggcagaaaacaaagaagaagatgttaagcttggagctaacaaattcagagaaacacaaccattaggaacagctgctcaaacagacaaagattacaaagaaccaccaccagctccattgtttgaaccaggggagttatcatcatggtctttttacagagctggaattgcagaatttatggctactttcttgtttttgtacatcactatcttgactgttatgggtcttaaaagatctgatagtctgtgtagttcagttggtattcaaggtgttgcttgggcttttggtggtatgatctttgctttggtttactgcactgctggtatctcaggaggacacatcaacccagctgtgacctttggattgttcttggcaaggaaactgtccttaaccagggctattttctacatggtgatgcaatgccttggtgcaatttgtggtgctggtgttgtgaaaggattcatggttggtccataccagagacttggtggtggtgctaatgttgttaaccctggttacaccaaaggtgatggccttggtgctgaaattattggcacttttgtccttgtttacactgttttctctgctactgatgctaagagaaatgccagagactcacatgttcctattttggcaccacttcccatcggattcgcggtgttcttggttcatttggccaccattcccatcaccggaactggcatcaaccccgctaggagtcttggagctgcgatcatctacaacgacgaacatgcatgggacgaccactggatcttttgggttggaccattcattggagctgcacttgctgcagtttaccatcaaataatcatcagagctattccattccacaagtcttcttaagtttgctcaagtagcctcatctttctgaattttcaagactttgtaccttttttttgggttaaattttaatcctctccttctgatgtatttgtaatgtggattttcttgtgttcaaatgtctattatgtgtgtaaattatcaggttttgttgtactgtaccctattaatgaaggttctttattttatc

SEQ ID NO: 1049 - protein, 287 aa, Nicotiana excelsior
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAIFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWDDHWIFWVGPFIGAALAAVYHQIIIRAIPFHKSS

SEQ ID NO: 1050 - DNA, 1064 bp, Nicotiana excelsior
  CDS (34)..(897)
agaaaacttagttgagtgactgaagaaacaaaaatggcagagaacaaggaagaagatgttaagctaggagcaaacaagtacagagaaactcaacccttgggcacagcagctcaaacagacaaggactataaggagccaccaccagctcctttgtttgagccaggggagttgtcgtcatggtctttttacagagctggaattgcagaattcatggctactttcttgttcttgtacatcactatcttgactgttatgggtctcaaaaggtcagatagtttgtgttcttctgttggtattcaaggagttgcttgggcttttggtggcatgatctttgctcttgtctactgcactgctggtatctcaggaggacacattaacccagcagtgacatttggtctgttcttggcaagaaagttgtctttaacaagggctctgttctacatggtgatgcagtgccttggtgcaatctgtggtgctggtgttgttaaaggttttatggtgggtccatatcagagacttggtggtggggccaacgtggttcaacctggctacaccaaaggtgatggacttggtgctgagattattggcacctttgtccttgtctacactgttttctctgccactgatgccaagagaaatgctagagattctcatgttcctattttggcacctcttcctattggattcgcggtgttcttggttcatttggccaccatccctatcactggaaccggcatcaaccccgcccggagccttggagctgctatcatcttcaaccacgaccaggcatgggatgatcactggatcttctgggttggaccattcattggagctgctctcgctgcagtttaccaccagataatcatcagagccattccattcaagaccaaatcttaaattatcttgaagagtcctccttttatgtttcttcccctgcttatgtaccctttttcccctttctggtgctgttgtatcatgtgattttcttttcttcagatgtcaaatatgtgtgtaaattatgaggttaatgctgtatttaaagctttcttgctccttatcaagtg

SEQ ID NO: 1051 - protein, 287 aa, Nicotiana excelsior
MAENKEEDVKLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRALFYMVMQCLGAICGAGVVKGFMVGPYQRLGGGANVVQPGYTKGDGLGAEIIGTFVLVYTVFSATDAKRNARDSHVPILAPLPIGFAVFLVHLATIPITGTGINPARSLGAAIIFNHDQAWDDHWIFWVGPFIGAALAAVYHQIIIRAIPFKTKS

SEQ ID NO: 1052 - DNA, 1039 bp, Medicago sativa
  CDS (48)..(920)
gtcgacattcagcagtagcatattttcatcaacaaagagagtgagctatggaggctaaagaacaagatgtttcattgggagctaacaaattcccagagagacaaccaattggtattgcagctcagagccatgatgatggcaaggactacaaggaaccaccaccagcaccattgtttgagccttctgagcttacttcatggtctttctacagagctgggatagctgagtttgtggccacttttctgtttctttacatcactctcttgactgttatgggtgttaacagatctgagtctaagtgtaaaactgttggtattcaaggaattgcttggtcttttggtggcatgatctttgcccttgtttactgtaccgctggtatctctgggggtcacataaacccagcagtgacattcggtttgttcttggcaaggaaattgtcattgaccagagctttgttctacatggtgatgcaaacccttggtgctatctgtggtgctggtgtggttaagggttttgagggaaagactttctacaccaacaaaaatggtggtgctaactttgttgcccctggttacactaaaggtgatggacttggtgctgagattgttggtacctttgttcttgtctacaccgtcttctccgccactgatgccaagcgtagcgccagagactcccacgttcctattttggctccactgccaattgggttcgctgtatttttggtgcatttggccactatcccaatcactggaactggtatcaaccctgctaggagtcttggtgctgcaattatcttcaacaaagatcttggttggaatgatcactggattttctgggttggaccattcattggtgcagcacttgcagctctttaccacacagttgtgatcagagccattcctttcaagtcaagtaattaatttaatccaacggtttatgatctttgatgcaaaaccaagccaactttgtgggttttattttatttgatccttatctggttttaattatttcccttttttgtatgtaaaggatgttgtgc

SEQ ID NO: 1053 - protein, 290 aa, Medicago sativa
MEAKEQDVSLGANKFPERQPIGIAAQSHDDGKDYKEPPPAPLFEPSELTSWSFYRAGIAEFVATFLFLYITLLTVMGVNRSESKCKTVGIQGIAWSFGGMIFALVYCTAGISGGHINPAVTFGLFLARKLSLTRALFYMVMQTLGAICGAGVVKGFEGKTFYTNKNGGANFVAPGYTKGDGLGAEIVGTFVLVYTVFSATDAKRSARDSHVPILAPLPIGFAVFLVHLATIPITGTGINPARSLGAAIIFNKDLGWNDHWIFWVGPFIGAALAALYHTVVIRAIPFKSSN

SEQ ID NO: 1054 - DNA, 1251 bp, Hordeum vulgare
  CDS (53)..(913)
ctgcagcaagcaccgttcaagctagagggcactaggttgagctagcttagcaatggccaaggacattgaggcggcaccccaagggggcgagttctccagcaaggactactcggacccgcccccggcgccgatcgtggacttcgaggagctgaccaagtggtcgctgtaccgcgcggtgatcgccgagttcgtcgccacgctcctcttcctctacatcaccgtggccaccgtcatcgggtacaagcaccagtccgaccccaccgttaacaccaccgacgcggcctgcagcggcgtcggcaccctcggcatagcatgggccttcggcggcatgatcttcgtcctcgtctactgcaccgccggcgtctcaggtggacacatcaacccggcggtgaccttcgggttgttcctggcgaggaaggtgtcgctcatccgggcgctgctctacatcatcgcgcagtgcctcggcgccatctgcggcgtcggccttgtcaagggcttccagagctcctactacgtgcggtacggcggtggcgccaacgagctcagcgcaggctactccaagggcactggtctagcggccgagatcatcggcaccttcgtgctcgtctacacggtcttctccgccaccgaccccaagcgcaacgcccgtgattcccacatcccggtgctggctcctctcccaatcggattcgctgtgttcatggtccacttggccaccatccccatcaccggcaccggcatcaaccccgcgagaagcttgggagctgctgtcatctacaacactgacaaggcctgggatgaccaatggatcttctgggtggggccactgatcggcgccgccattgccgccgcctaccaccagtatgtgctgagggccagcgccgccaagctcgggtcctacaggagcaactaagtcgcccgtagctccggccggacgcgcgagggggggcactgaagtgtagatatgtgcgaagaagaaggccgcctccagccaatgcgctatggctgctcgatcccaccgcttggttcagtggctccagtcttcgcatcatctgctgctaccgttcctcggcttgtgcatatgttgatgtgaccgtccattcgtatgtcgacgtgtttccggagttcgccatgtttgcttgctgctgtttcttccaagtgtgcttttcttttgctcgctctatgtatgtatgtatgtatgtatgtatgtggagaatttggtaatcaaagaattggtaccgtttaagatct

SEQ ID NO: 1055 - protein, 286 aa, Hordeum vulgare
MAKDIEAAPQGGEFSSKDYSDPPPAPIVDFEELTKWSLYRAVIAEFVATLLFLYITVATVIGYKHQSDPTVNTTDAACSGVGTLGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 1056 - DNA, 1075 bp, Hordeum vulgare
  CDS (31)..(903)
caccgaccctagcttgccgatcagccgaggatggccaaggacatcgaggcggcgcccccaggcggcgagtacggggccaaggactactccgacccgccgccggcgccgctcttcgacgcggaggagctgaccaagtggtccctgtaccgcgcggtgatcgccgagttcgtggccacgctgctcttcctctacatcaccgtggccaccgtcattgggtacaagcaccaggcggaccccgccggccccaatgctgccgacgcggcgtgcagcggcgtcggcatcctcggcatcgcctgggcgttcggcggcatgatcttcgtcctcgtctactgcaccgccggtgtctcgggtggccacatcaacccggcggtgacgttcgggctgttcctggcgcgcaaggtttcgctggtgcgcgcggtgctctacatcatcgcgcagtgcctgggcgccatctgtggcgtggggctcgtcaaggggttccagagcgccttctacgtgcgctacggcggcggcgccaacgagctcagcgcgggctactccaagggcaccgggctcgccgccgagatcatcggcaccttcgtgctcgtctacaccgtcttctccgccaccgaccccaagcgcagcgcccgtgactcccacgtcccagtgctggctcctttgccaatcggcttcgcggtgttcatggtgcacctggccactatcccaatcaccggcaccggcatcaacccggcaaggagcttcggagctgccgtgatctacaacaacgagaaggcctgggatgaccactggatcttctgggtggggccattcatcggagccgccattgccgccgcctaccaccagtacgtcctgagggcgagtgccaccaagcttggctcgtctgcctccttcggtaggagctagatcggtccgccgccgtgtggatgatcggaggcactgaaaaagaaatatatcagtgtgatatggctcggatcgtgtattatgcaagcgtctgtatttttctagatgcgtttggatgtctttaaaatttctctagaattctgtgaatttggatcgttgaggaatttggatgcct

SEQ ID NO: 1057 - protein, 290 aa, Hordeum vulgare
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRAVLYIIAQCLGAICGVGLVKGFQSAFYVRYGGGANELSAGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRS

SEQ ID NO: 1058 - DNA, 1083 bp, Hordeum vulgare
  CDS (45)..(923)
ctcctctgcctaacaagctaagcagctcagctcaagcatcggcaatggagggcaaggaggaggacgtgcgtctgggcgcgaaccggtactcggagcggcagccgattgggacggcggcgcagggcggcggcgcggacgagaaggactacaaggagccgccgccggcaccgctgttcgaggcggaggagctgacgtcgtggtccttctaccgcgcggggatcgccgagttcctggccaccttcctgttcctgtacatcagcgtgctcacggtgatgggcgtggtgggcaacccctccggctccaagtgcggcaccgtgggcatccagggcatcgcctggagcttcgggggcatgatcttcgtgctcgtctactgcaccgccggcatctccggcggccacatcaaccccgccgtcaccttcgggctgttcctggccaggaagctgtcgctcacccgggccgtgttctacatggtgatgcagtgcctgggagccatctgcggcgccggggtggtgaaggggttccagaccacgctgtacatgggcaacggcggcggcgccaactcggtggcgccggggtacaccaaaggcgacggcctgggggcggagatcgtggggacctttgtgctcgtgtacaccgtcttctccgccaccgacgccaagcgcagcgccagagactcccacgtccccattttggcgccgctgccgatcgggttcgcggtgttcctggtgcacctggcgacaatccccatcaccggcaccggcatcaacccggcgcgctccctcggcgccgccatcatctacaacaagaagcagtcgtgggacgaccactggatcttctgggtgggcccgttcaccggcgcggcgctggcggccatctaccacgtggtggtgatcagggccatccccttcaagagccgcgactagtatactcaatcagccatggaatggatggaatcctatcgcgtattgttcatcaaccatcatttgtgctgatcgttgctcgtgcattgctacgtggctgaatcatcgccggcacctcctgtaattatcggtctaccgtactgttcttgagcgagcgagcgag

SEQ ID NO: 1059 - protein, 292 aa, Hordeum vulgare
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRD

SEQ ID NO: 1060 - DNA, 1052 bp, Phaseolus vulgaris
  CDS (23)..(892)
gtgagggatagagtgagcaaaaatggagggaaaggagcaagatgtttcactgggagcgaacaaattctcggagaggcaacccattggcactgcggctcagatccaagacgatggaaaggactacaaagagcctccatcggctccactgttcggcccctccgaactcacttctcggtcattctaccgagccggaatagcggagtttgtagccacttttcttttcctctacataaccatcttaaccgtcatgggtgtcaataggtccgattccaagtgcgcaaccgttggcattcaaggcattgcttggtccttcggtggtatgatctttgctctcgtttactgcaccgctggaatctcagggggacacgttaatcctgctgtgacattcggactcttcttggcgaggaaattgtcgttgactagggcagtgttctacatagtgatgcaggttctgggtgctatcgttggagctggtgtggtcaagggtttcgagggaaaaacattcttcggcaaacacaacggtggtgccaacttcgttgcccctggttacacaaaaggcgatggactcggtgctgagattgttggaaccttcgttcttgtctacactgttttctcagccactgatgccaagcgtagcgctagagactcacacgttcctattttggcacccttgcccattgggttcgctgtgttcttggtgcacttggccaccatcccaatcactggcactggtatcaaccctgctcgaagtctcggtgctgccatcatcttcaacaaagaccttggctgggatgatcactggattttctgggttggacccttcgttggagcagctcttgcggctctttaccaccaagtcgtgatcagagctattcccttcaaatccagctaagggatgaagcttgtgatgagtgggtaaaagaaccagacgaagcaaagtttatggtctaattttatattgttatctgttatttaagttggaagatgaccatgagcgatgtgtgctgtaattgcttgtgaaataaaaaacaacgtcctctttttctgggctc

SEQ ID NO: 1061 - protein, 289 aa, Phaseolus vulgaris
MEGKEQDVSLGANKFSERQPIGTAAQIQDDGKDYKEPPSAPLFGPSELTSRSFYRAGIAEFVATFLFLYITILTVMGVNRSDSKCATVGIQGIAWSFGGMIFALVYCTAGISGGHVNPAVTFGLFLARKLSLTRAVFYIVMQVLGAIVGAGVVKGFEGKTFFGKHNGGANFVAPGYTKGDGLGAEIVGTFVLVYTVFSATDAKRSARDSHVPILAPLPIGFAVFLVHLATIPITGTGINPARSLGAAIIFNKDLGWDDHWIFWVGPFVGAALAALYHQVVIRAIPFKSS

SEQ ID NO: 1062 - DNA, 1285 bp, Vitis vinifera
  CDS (98)..(952)
tggggcacactctactcaacttctcccaccttctcctaccttctcctgaacccccctagctcttctctttgcctggtgtttttctgctataacatctatgactaaggacgttgaggttgcggagcatgggtccttctccgccaaggactatcatgacccgccgccggcgccgctgttcgactcagttgagctcactaagtggtccttctacagggctctgattgcggagttcattgccacgctgctcttcctttacattacggtgctgacagtcatcggctacaagagccagactgccgggggtgacccatgcggtggtgttggcattctgggcattgcttggtcttttggtggcatgatctttatccttgtttactgcactgccggcatctctgggggacacattaacccggcggtgacctttgggctgttcctggcccggaaggtgtcgctgatccgagcaatattgtacatggtggctcagtgtcttggagccatttgtggtgtgggtctcgtcaaagccttccaatctgcttactatgatcgctacgggggcggtgccaacgagctctccaccggctacagcaaaggcaccggcttgggcgctgagatcattggaacttttgtccttgtctacaccgtcttctctgcaactgaccccaagaggagtgccagagactcccatgttcctgttctggcacctcttccaattgggtttgccgttttcatggttcacttggccactattcctatcactggcaccggtatcaaccctgccaggagtttgggggctgctgttatctacaacaatgagaaggcctgggatgaccagtggatcttttgggttggacccttcattggtgcagccattgcagccttctaccaccagttcatattgagagctggagctgtcaaggctcttgggtcattcaggagcaccgctcatgtgtgatttgcagagccattttgataccttcttccactgttattgggggcgaagaaaaagaatttggaaggaggagaagtgattggaattggaagaataattatggaggttgttattgatatggatgagggcatgaaattgtagataccatctccatggaaataggaagctttttgtatccctcccttaagcacttttcttttaatccacttcatgcttatcttttcctagttttctctttcattgtttgcttatgcttgaacaaaattctgtgttgtggcttgtcttggaagtaaagggctttattttgttttccgaaaaaaaaaaaaaaaaaaaaaa

SEQ ID NO: 1063 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTAHV

SEQ ID NO: 1064 - DNA, 1512 bp, Phaeosphaeria nodorum
  CDS (1)..(1512)
atggccacaaacgaattgactgctcttccacagtattatggccagcagctcaaggacggtacagtaatggagtcccccgtctcaccacgtgtctatgggcgtgggtccagtgattcaagacaagaacttctacgtctgccagcccaagcacatatcgatcgagacctggatcccatctctcccgtcatcggtacagatccaaacgcaattggtctcgcaaaccgtcccagtcgtaaccgattaggtggccagccggaaatcgacgagtacggttcgcccgttgcgaaccgctacacacgcaagactcaaccccagagccagtccatggttcctcgcactgcctatgtggaagaacacttctcagaggacgaatacgagcagcggccccaaccctaccgccgtcgcacaactcgccagtaccggcctcctccatcagctcacgagaacgatcgttcaatgagccgctactcacaggtacccaatcgtcgcaacactaaccggtcggatgtgcactacaacaacgacaagccacggactcacatacactacggcagtgacgacgaagaatatgcgcctcgccgccctccaatccgcccaggggccggtcacggcgatggccgcgagccaccgcgagcacctccttccaccgaggacgtgatgcgtctgccctggatgatctggatgggctcgaatgcaaagaaccatttcgtcgcgttcgtcggcgaatttgtgggcaccactatgtttctgttcttcgcgttctcgggcacgcaagtcgccaacatcggtgccggacaatcagaggataacacaacgactggtgaagccacagggttctcacccaacgtcttgctctacattgctctcgtcttcagcttcagtctcatggttaatgtgtgggtgttcttccgtattagcggcgggctgttcaatccggctgtcacgtttgcgtttctgctgtgtagcgccttgtcgccgacacgagcgagtttactcatggctgcgcaggtatctgggagtattttctcgagttacctggtcagcgtcctgtttccaacaccttttaacgtgcggacgacgctgagttcggggacgagtttggcacagggagtgtttattgaggcggtcttgacagcagagttggtgttcacaatcttcatgttggcaaaggagaagcacaaagccaccttcatcgcccctgtgggcattggactagcgcttttcatctccgagctcgtcggcgtctactacaccggcggctcgctcaaccccgcgcgcagtttcgggccctgcgtcgtcaccggcatcttcgacaaggagcactggatctactgggccgggccagcaatcggcgccatcctcgctgtcattttctacaagttcatcaagatcctcgagtacgaggtcgccaacccaggccaggacgatgatgacaaggatgtcgaggtcaaggagaagaataacaacgaggaaagtgggccggatagccctaatcgtcggggcgagccgtag

SEQ ID NO: 1065 - protein, 503 aa, Phaeosphaeria nodorum
MATNELTALPQYYGQQLKDGTVMESPVSPRVYGRGSSDSRQELLRLPAQAHIDRDLDPISPVIGTDPNAIGLANRPSRNRLGGQPEIDEYGSPVANRYTRKTQPQSQSMVPRTAYVEEHFSEDEYEQRPQPYRRRTTRQYRPPPSAHENDRSMSRYSQVPNRRNTNRSDVHYNNDKPRTHIHYGSDDEEYAPRRPPIRPGAGHGDGREPPRAPPSTEDVMRLPWMIWMGSNAKNHFVAFVGEFVGTTMFLFFAFSGTQVANIGAGQSEDNTTTGEATGFSPNVLLYIALVFSFSLMVNVWVFFRISGGLFNPAVTFAFLLCSALSPTRASLLMAAQVSGSIFSSYLVSVLFPTPFNVRTTLSSGTSLAQGVFIEAVLTAELVFTIFMLAKEKHKATFIAPVGIGLALFISELVGVYYTGGSLNPARSFGPCVVTGIFDKEHWIYWAGPAIGAILAVIFYKFIKILEYEVANPGQDDDDKDVEVKEKNNNEESGPDSPNRRGEP

SEQ ID NO: 1066 - DNA, 1185 bp, Phaeosphaeria nodorum
  CDS (1)..(1185)
atggctccatcgcaacaaaacatcctacccgtacacaggaacgaatccagtgcgggtgaaaacagacccagacactcgactcacagccatcatcatccgcatattcaccacccgcacatccacggccatcatccgcacatcaaagcccgcaagaatgctctcaacggatacgtgtcaaacaaatggcgcaatgagcttgtcgcggctgttgccgagtttgctgggactttcatgttcttattcttcgcattcggcggcactcaagtcgccaacactgctgcgctgtacagtgaccaagctactgctggacagggcgggaacagtataacgcaggcaccaaacaccagcgtcttgctgtacatcagtctgatatttgggttcagtttgatggtgtgcgtgtgggtgtttttccgagtcagtggtggattgttcaaccctgctgttaccctaggtctttacctaataaaagcgctgaaatgggatcgcgcagtcctatgcttcatcagccaaatgctcgctggcatagctgctgcgggcgttgtatctgccatccttcccggcccgctgaacgtttcgacgacacttggcaacggtgttactcccacgatgggcgtcttcctggagatgtttttgacatctctcctcgtcttcaccatcttcatgcttgcagctgagaaacacaaagccacatttcttgctcctgtcggcataggtctctcgctcttcgtcgcggaaatggttggcgtcttcttcactggcggttcgctgaatcccagtcgatcatttggcccctgcgtcgtgacgcgcaactttccatcataccactacatttactggtttggtccagtcatgggcacgttgctggctttcggcatgtacaggatcgtcaagatagtggaatacgagaccgtcaaccccggacaagactttgacgatcacgaggctgcggctttccagccgccggagaatgctgagacagcagaggaggtcggtcgaccaaatgtggcggctatcgcgttggaggaagccatcagggcggcgaaccccggatctgccgacagccaggagggagacgagaagaaagcacacacggagaccagtgatggctcgcctagtggaacattggtgtatagggagaagcctagtgcacaggagttattggatcggacagggcacaaccattag

SEQ ID NO: 1067 - protein, 394 aa, Phaeosphaeria nodorum
MAPSQQNILPVHRNESSAGENRPRHSTHSHHHPHIHHPHIHGHHPHIKARKNALNGYVSNKWRNELVAAVAEFAGTFMFLFFAFGGTQVANTAALYSDQATAGQGGNSITQAPNTSVLLYISLIFGFSLMVCVWVFFRVSGGLFNPAVTLGLYLIKALKWDRAVLCFISQMLAGIAAAGVVSAILPGPLNVSTTLGNGVTPTMGVFLEMFLTSLLVFTIFMLAAEKHKATFLAPVGIGLSLFVAEMVGVFFTGGSLNPSRSFGPCVVTRNFPSYHYIYWFGPVMGTLLAFGMYRIVKIVEYETVNPGQDFDDHEAAAFQPPENAETAEEVGRPNVAAIALEEAIRAANPGSADSQEGDEKKAHTETSDGSPSGTLVYREKPSAQELLDRTGHNH

SEQ ID NO: 1068 - DNA, 801 bp, Phaeosphaeria nodorum
  CDS (1)..(801)
atgtctatcgaaagaactgacgacaaggagtccggcctcccacatcacgagacttcctcttcgactgttcaatctgagaagcgccctctgcgccacactctccggaaagaacttactgctttcattggagaattcattggtacctttatgttcctcgcccttgctttctgtggaactcaaatagccatcaactcaaccgcagtcgctcctacactcgactcagacagcccttcagcacccaatgtcaacaaactgctctacattgcctttgcatttggattatcgctcgcaatcaacgttgctatctttgctgatgtcagtggaggaaagtttaatcctgctgtctccatggcgctgttcattactggaaagattgattggcgtcgcatggttcataccataatctcgcagatgattgccggaatggctgcatcgggcttcattgcagcactacttcccgggccgctgggtgtcgccaccacccttgacccatccatctcgactgctcgtggtctgttcctcgaagccttcgtcacgtcgatgttgattctgactatcctaatgctcgagggcggcccggcaaaaccgatgcacattggcatggcgttattcgttgctgaactttgcagcgccttcttcaccggtggtagcttgaatccggcgcgcagctttggtccttgtgtggtggttggatttcctacataccattggatctactggctcgggccgctcctcgggtccgctgtggcgagtggagcgtattggctcatcaactttgttcatcccgagcgatcgttctag

SEQ ID NO: 1069 - protein, 266 aa, Phaeosphaeria nodorum
MSIERTDDKESGLPHHETSSSTVQSEKRPLRHTLRKELTAFIGEFIGTFMFLALAFCGTQIAINSTAVAPTLDSDSPSAPNVNKLLYIAFAFGLSLAINVAIFADVSGGKFNPAVSMALFITGKIDWRRMVHTIISQMIAGMAASGFIAALLPGPLGVATTLDPSISTARGLFLEAFVTSMLILTILMLEGGPAKPMHIGMALFVAELCSAFFTGGSLNPARSFGPCVVVGFPTYHWIYWLGPLLGSAVASGAYWLINFVHPERSF

SEQ ID NO: 1070 - DNA, 915 bp, Phaeosphaeria nodorum
  CDS (1)..(915)
atgccccgagtacccgtacaccgcgaaccaaaggcatctccccatcgaagtccaaatcaacgaagcttcgactatgagaatcacagacgcggccgtgactatgaccacaccatcaaacgtcatccacgtccccctccaaagcgcgagatcaccactctcactgcgcacttggttgctgccgtcggtgaatttgtcggaacatttatgtttttatacttctcctttatcggccaaatcatgctcgtctcgcaagctgcagagcgctctactataaatggacaagccagcagccagcaaaacatcttcactgccttgttatacgggtttagtttgttggtgaatgtatgggccttttacaggattagtggtggtctatttaaccctgcggtgacgtttggcctagttctgtctggtgcattgcctcccattcgaggcctctgtctcttcccagcacaactcttggcagccatgtgcgcggctgcaatcgcaaatgccatggtgccgggcgacatcagtgccacgatcacgtccctttccccaaacacgagcgtcgcccaaggcgtcttcatcgagatgttcatgactgcggaactagtcttcgtcgtgctcatgctggccgcggagaagagcaaggatacgttcattgcacctatcggcataggactagcgttattcgtggctatgatgggtggcgtcttttataccggtggctcgctgaatccagcacgcagcctcggtccggctgtggcgtcggcgcaattcaatcattatcattggatctactgggttggtccttttcttggcgctgcgttagctgcgggattctatcacttcgtcaagttcttcgactatgagcaggtcaatcccgggcaggactcggcgggtggagatttcgatgcggatgatcgagtctga

SEQ ID NO: 1071 - protein, 304 aa, Phaeosphaeria nodorum
MPRVPVHREPKASPHRSPNQRSFDYENHRRGRDYDHTIKRHPRPPPKREITTLTAHLVAAVGEFVGTFMFLYFSFIGQIMLVSQAAERSTINGQASSQQNIFTALLYGFSLLVNVWAFYRISGGLFNPAVTFGLVLSGALPPIRGLCLFPAQLLAAMCAAAIANAMVPGDISATITSLSPNTSVAQGVFIEMFMTAELVFVVLMLAAEKSKDTFIAPIGIGLALFVAMMGGVFYTGGSLNPARSLGPAVASAQFNHYHWIYWVGPFLGAALAAGFYHFVKFFDYEQVNPGQDSAGGDFDADDRV

SEQ ID NO: 1072 - DNA, 1011 bp, Phaeosphaeria nodorum
  CDS (1)..(1011)
atgaacgtcgaccgtcccacgcgtggcctgcgcattccatggaagtcccgccatcaccaacgaccccacaaacacgagcatcatgtggcacgtcctctggactggcttaacttcctcccaaagactgtaaaggggcatattgtcgcatgcttaggcgaatttgtgggcacattcatgtttttgctctttgctttaggcgggacaaatgtcgtcaatactgcaccagcgcaaggtgccaacgcgacagatctcgctgccaatccgagcaaaatcatgtacatctctttggtgtttggtctagcactcatggtgaacgcctgggtgttcttccgcattagtggaggattgttcaatcctgccgtcaccctcggcatgatgcttgttggagctactgcttacatgcgtggcctcctaatcatcatttcccagatcattggtggcatcgcagcttcagccgttgtgtctggaatgatgcccaacgtcttggctgtgaggactgagctgggcggtggtaccaccgtggttcagggactgtttattgagatgttcttgacggcgcagttggtcttcaccatcttcatgcttgctaccgagaagcacgaaggtaccttcattgctcctgttggtataggactggcaagttctctcttcgtcgctgagcttatgggtgtctactacaccggtggcagtgtcaacccggcccgatccttcggcccagctgtggtatctcacacttttgcttcgtaccattggatctattgggtcggacccattcttggagctatccttgcgagtaccttctacatgttcatcaaagctttggagtatgagactgtcaaccttgaaggtgatgatccaaaggcagctctaggtgaaaagttcaaaggagctcccgcctcccgcgacggcgctgtttcaggccatcgcaggaccgcatctggtggttcaagcgacacctatgataaggctccagtcctcgagaacggcagcccgcccccggcagctcgctag

SEQ ID NO: 1073 - protein, 336 aa, Phaeosphaeria nodorum
MNVDRPTRGLRIPWKSRHHQRPHKHEHHVARPLDWLNFLPKTVKGHIVACLGEFVGTFMFLLFALGGTNVVNTAPAQGANATDLAANPSKIMYISLVFGLALMVNAWVFFRISGGLFNPAVTLGMMLVGATAYMRGLLIIISQIIGGIAASAVVSGMMPNVLAVRTELGGGTTVVQGLFIEMFLTAQLVFTIFMLATEKHEGTFIAPVGIGLASSLFVAELMGVYYTGGSVNPARSFGPAVVSHTFASYHWIYWVGPILGAILASTFYMFIKALEYETVNLEGDDPKAALGEKFKGAPASRDGAVSGHRRTASGGSSDTYDKAPVLENGSPPPAAR

SEQ ID NO: 1074 - DNA, 984 bp, Saccharomyces cerevisiae
  CDS (1)..(984)
atgtcttcgaacgattcgaacgataccgacaagcaacatacacgtctggatcctaccggtgtggacgacgcctacattcctccggagcagccggaaacaaagcaccatcgctttaaaatctctaaagacaccctgagaaaccactttatcgctgcggccggtgagttctgcggcacattcatgtttttatggtgcgcttacgttatctgcaatgtcgctaaccatgatgtcgcactcgttgcagcgcctgacggttcccatccgggtcaattgattatgattgccatcggtttcggattttccgtcatgttttctatctggtgttttgccggtgtctctggtggggctttgaatcctgctgtgtcgctttcgctgtgcttggcgagagccgtctctcctacaagatgtgtcgttatgtgggtttcgcagattgttgccggaatggccgctggaggcgctgcaagcgccatgacacctggtgaagtcctctttgccaattctttgggcctgggctgctctaggacgaggggtctgttcctggagatgttcggcaccgctatcctatgtttaacagtcttaatgacggctgtggagaagcgtgaaaccaactttatggccgcgctgcccatcggcatctccctgtttatcgcacacgtcgctttgactgcatacacaagcacaggtgtcaaccctgcgaggtctttgggtgctgctgtcgcagccagatacttccctcattaccactggatttattggattggcccgctgttaggatccattttagcatggtctgtatggcaattattgcaaatcttagactacacaacctacgttaccgctgaaaaggctgccagcaccaaggaaaaagctcaaaaaaaggtgaaaccagcagttcctctgctgtggctgaagtctaatttttccctccttttctttatttctcgctcactagcacttaatgttataatattcggcaaaaactag

SEQ ID NO: 1075 - protein, 327 aa, Saccharomyces cerevisiae
MSSNDSNDTDKQHTRLDPTGVDDAYIPPEQPETKHHRFKISKDTLRNHFIAAAGEFCGTFMFLWCAYVICNVANHDVALVAAPDGSHPGQLIMIAIGFGFSVMFSIWCFAGVSGGALNPAVSLSLCLARAVSPTRCVVMWVSQIVAGMAAGGAASAMTPGEVLFANSLGLGCSRTRGLFLEMFGTAILCLTVLMTAVEKRETNFMAALPIGISLFIAHVALTAYTSTGVNPARSLGAAVAARYFPHYHWIYWIGPLLGSILAWSVWQLLQILDYTTYVTAEKAASTKEKAQKKVKPAVPLLWLKSNFSLLFFISRSLALNVIIFGKN

SEQ ID NO: 1076 - DNA, 984 bp, Saccharomyces cerevisiae
  CDS (1)..(984)
atgtcttcgaacgattcgaacgataccgacaagcaacatacacgtctggatcctaccggtgtggacgacgcctacattcctccggagcagccggaaacaaagcaccatcgctttaaaatctctaaagacaccctgagaaaccactttatcgctgcggccggtgagttctgcggcacattcatgtttttatggtgcgcttacgttatctgcaatgtcgctaaccatgatgtcgcactcgttgcagcgcctgacggttcccatccgggtcaattgattatgattgccatcggtttcggattttccgtcatgttttctatctggtgttttgccggtgtctctggtggggctttgaatcctgctgtgtcgctttcgctgtgcttggcgagagccgtctctcctacaagatgtgtcgttatgtgggtttcgcagattgttgccggaatggccgctggaggcgctgcaagcgccatgacacctggtgaagtcctctttgccaattctttgggcctgggctgctctaggacgaggggtctgttcctggagatgttcggcaccgctatcctatgtttaacagtcttaatgacggctgtggagaagcgtgaaaccaactttatggccgcgctgcccatcggcatctccctgtttatcgcacacgtcgctttgactgcatacacaggcacaggtgtcaaccctgcgaggtctttgggtgctgctgtcgcagccagatacttccctcattaccactggatttattggattggcccgctgttaggatccattttagcatggtctgtatggcaattattgcaaatcttagactacacaacctacgttaccgctgaaaaggctgccagcaccaaggaaaaagctcaaaaaaaggtgaaaccagcagttcctctgctgtggctgaagtctaatttttccctccttttctttatttctcgctcactagcacttaatgttataatattcggcaaaaactag

SEQ ID NO: 1077 - protein, 327 aa, Saccharomyces cerevisiae
MSSNDSNDTDKQHTRLDPTGVDDAYIPPEQPETKHHRFKISKDTLRNHFIAAAGEFCGTFMFLWCAYVICNVANHDVALVAAPDGSHPGQLIMIAIGFGFSVMFSIWCFAGVSGGALNPAVSLSLCLARAVSPTRCVVMWVSQIVAGMAAGGAASAMTPGEVLFANSLGLGCSRTRGLFLEMFGTAILCLTVLMTAVEKRETNFMAALPIGISLFIAHVALTAYTGTGVNPARSLGAAVAARYFPHYHWIYWIGPLLGSILAWSVWQLLQILDYTTYVTAEKAASTKEKAQKKVKPAVPLLWLKSNFSLLFFISRSLALNVIIFGKN

SEQ ID NO: 1078 - DNA, 1046 bp, Solanum tuberosum
  CDS (49)..(900)
aaaaactcaaaaagctctgtttctttcactgccaacttctaaaaaaaaatgtcgaaggacgtaattgaagaaggacaagttcatcatcgtggaaaggactatgttgaccctcctccagctcctcttcttgacatggctgagcttaccaaatggtctttttacagagctgttatagctgaattcatcgccacccttctcttcctttatgtcaccgttgctactgttatcggccacaagaaactcaacaaactcgaccaatgtgatggtgttgggattcttggaattgcgtgggcttttggtggcatgatcttcgttcttgtttactgtactgctggaatttctggtggtcatattaacccggcggtgacatttgggttgttcttggcaaggaaagtgtcattgataagagcagttgcttacataattgcacagtcacttggtgctatttgtggcgttggtttcgttaagttgttcatgaagcattactacaacgcagaaggtggaggtgctaacttcgtgcaacctggttacaacaaaggaactgctttgggtgctgaaattattggaacttttgtgcttgtttacaccgtcttctctgctactgacccaaaaagaagcgctcgcgattcccacgtccctgttttggctcctcttccaattggatttgctgttttcatggttcatttggctaccatccccattactggaactggtattaacccagctaggagctttggagctgcagttatttacggcaacgaaaaaatctgggatgaccaatggatattctgggttggaccaatggtgggagcaatggctgcagcaatataccatcagtttgtattgagagctggagctgttgaagcttttggatctttccgcagcaaccaaaccaactaagcaagtgttatcaaccagccagagaagagaaattgcattcacaagttcaaattgttcttgtttaattgtttgattttgtgtatgaagattaattcattaatgtctgaaccttttttttttaatttattttgttcgtttggtacagt

SEQ ID NO: 1079 - protein, 283 aa, Solanum tuberosum
MSKDVIEEGQVHHRGKDYVDPPPAPLLDMAELTKWSFYRAVIAEFIATLLFLYVTVATVIGHKKLNKLDQCDGVGILGIAWAFGGMIFVLVYCTAGISGGHINPAVTFGLFLARKVSLIRAVAYIIAQSLGAICGVGFVKLFMKHYYNAEGGGANFVQPGYNKGTALGAEIIGTFVLVYTVFSATDPKRSARDSHVPVLAPLPIGFAVFMVHLATIPITGTGINPARSFGAAVIYGNEKIWDDQWIFWVGPMVGAMAAAIYHQFVLRAGAVEAFGSFRSNQTN

SEQ ID NO: 1080 - DNA, 1262 bp, Xerophyta humilis
  CDS (89)..(949)
acgcgggggcccaaaaacattctgctcgctttgcgcttcattaattcgagtgtagaagtgtttaagaggagcgagagatcagagatcgatggaggggaaggaggaagacgtgaggttgggagcaaacaagttctcggagcggcagccgatcgggacgtcggcgcaaacggagagggactatgtagagccgccaccggcaccgttgtttgagcccggcgagctgagctcgtggtctttctaccgcgccggcatcgccgagttcatagctacctttcttttcctgtacataaccatcctcactgtcatgggagtcgtcaagtccccgacgaagtgttccaccgtcggcatccagggcatcgcatgggctttcggcggcatgatcttcgccctcgtctactgtaccgccggcatctcaggcggacacattaatccggcggtgactttcgggctgttcctggcacggaagctgtcactgacgagggcgctgttctacatggtgatgcagcgcctcggcgcgatctgcggcgccggcgtggtgaaaggcttccagaaaggtctctacatgagccagggcggcggtgccaacgctgtcaatcctggttacacgaaaggcgacggccttggagctgagatcatcggcaccttcgtcctcgtctacaccgtcttctccgccaccgatgctaagcgcagcgccagggactcccacgttcctatcttggccccgttgcccatcgggtttgcggtgttcttggtgcacttggcgacgatcccgatcaccggcaccggcatcaaccctgcaaggagcctgggagctgccatcatctacaacagatcccacgcatggaatgaccattggatattctgggttgggccattcatcggagctgcactggctgcgctgtaccaccaggtcgtcatcagagcaatccccttcaaatccagggcatgaacgacgacgatgagcctattcctctctctctctctctctctctctctctctctctctcccctgtgttgccatctgcattgaataaacaccaatccgtattagagtccttgggttttcttctaaaattatctctaaattgtaaatgaagttcatcttgcagtgaattttaaggagaagctgcagattgtgtctattttgaaggttggtttgtgatgtatgtcatggtgtcgaactgttaatccagttccaatgtatttagtaaaattaatgaatgatattttggttttctagtataaaaaaaaaaaaaaaaaaa

SEQ ID NO: 1081 - protein, 286 aa, Xerophyta humilis
MEGKEEDVRLGANKFSERQPIGTSAQTERDYVEPPPAPLFEPGELSSWSFYRAGIAEFIATFLFLYITILTVMGVVKSPTKCSTVGIQGIAWAFGGMIFALVYCTAGISGGHINPAVTFGLFLARKLSLTRALFYMVMQRLGAICGAGVVKGFQKGLYMSQGGGANAVNPGYTKGDGLGAEIIGTFVLVYTVFSATDAKRSARDSHVPILAPLPIGFAVFLVHLATIPITGTGINPARSLGAAIIYNRSHAWNDHWIFWVGPFIGAALAALYHQVVIRAIPFKSRA

SEQ ID NO: 1082 - DNA, 855 bp, Aspergillus oryzae
  CDS (1)..(855)
atgttacacgtaccctatacattccaaaatacctttgttgccgttgtgggagagtttgttggaactttcatgttcctcttcttcgcatttgctggtggccaggtctccaacacccctaagccagctgagggggcggcaccaaacacttcgaacctactctatctgtccctttccttcggattttctctgcttgtgaatgtctggacattttaccgtgtgacgggtggcttatttaatccagtggtcactctagctctctgcctctgcggaggcatgcatcctgttcgtggtgtgttagtttttgcttctcaaattatagcgggaattgcatcagcaggcgtggttagttgcttgttcccaggacctctaagtgttgggaccaggctgggaggtggcacctcaatctcccagggcctgttcattgagatgttcctgacagcacacctggtatttgtcgtgattatgttggctgtagtgaagcaaaagtcaacgttcctcgcgcctgttgggatcggcctggttttatttgtgaaccaactagtcggaacctactataccggctgtgccctcaaccctgcgcgtgcccttggccctgacgtgatcaaccgcagcttcccaggatatcactggatctactgggtaggaccattactggggtctctccttgcttctggattctatggttttctcagtatatttcactatgagaccgttaatccgggccaagattttaatcagtgggaggccgctgcgggccccggcccgtggcacgaagaaataaacaagcacagcggtgcgccaaaccattcacacttatcaggtgatcagccaaccctccatcaagacaatgtgtga

SEQ ID NO: 1083 - protein, 284 aa, Aspergillus oryzae
MLHVPYTFQNTFVAVVGEFVGTFMFLFFAFAGGQVSNTPKPAEGAAPNTSNLLYLSLSFGFSLLVNVWTFYRVTGGLFNPVVTLALCLCGGMHPVRGVLVFASQIIAGIASAGVVSCLFPGPLSVGTRLGGGTSISQGLFIEMFLTAHLVFVVIMLAVVKQKSTFLAPVGIGLVLFVNQLVGTYYTGCALNPARALGPDVINRSFPGYHWIYWVGPLLGSLLASGFYGFLSIFHYETVNPGQDFNQWEAAAGPGPWHEEINKHSGAPNHSHLSGDQPTLHQDNV

SEQ ID NO: 1084 - DNA, 1246 bp, Olea europaea
  CDS (68)..(931)
  misc_feature (1221)..(1221): n is a, g, c or t
acgcgggataccagcttcagccctacaacttcttctctatattcttcacacttccctcaccccacgaatgacgaaagacgtcgaatctcatgtggagccagcggaggaatactccgccaaggactaccatgatccaccaccggcgcctctcattgattttgatgagctgagcagctggtcgttttacagagcacttattgctgagttcgttgccactttgctgttcctttacgtcacagttttgaccgttataggctacaaaagccagattgacccagctcacggcggcgacgactgcggcggcgttgggattcttggcattgcatgggctttcggtggaatgattttcattcttgtttactgcaccgccggtatctctggaggacatattaacccggcagtgacattagggctgttcttgggaagaaaggtgtcactgatcagagcagtgctttacatggtagcacaatgtttgggtgcaatctgtggtgtgggattggtgaaagcattccaaaaatcgtactatcataagtatggtggtggagcaaatgaacttgctccagggtacaacaaaggggttggtttgggtgctgaaattattggcacctttgttttggtctacaccgtcttctcagccactgatcctaagaggaatgccagagactcccatgtccctgtcttggctccacttcccatcggatttgctgtgttcatggttcaccttgccaccatccccatcaccggaactggcatcaaccctgctaggagctttggagctgctgtcatctacaacgaagacaagccctgggatgaccattggattttttgggttggaccattcgttggagctctaattgctgcaatctaccaccaatacatcctaagggcaggagccatcaaggcactgggatctttcaggagcaacgcttaagacaattgtgcatttgtttgatgattcattctcacaagtacacgaaagtggagaggaccttgaaaactgcacatgaattccctgtggatatagggttcctttaatttttattcccatcatttcccttttcctcttgttttggatgtatttaagttgtgttgtatcttctccctttttctctccttttaagtgctgctctatctatgatgtaactcttcgtaaataagtataatggtttgtgctcccttctctctccctctcccccttgattatgtaataacctgattcanaaaaaaaaaaaaaaaaaaaaaaaaa

SEQ ID NO: 1085 - protein, 287 aa, Olea europaea
MTKDVESHVEPAEEYSAKDYHDPPPAPLIDFDELSSWSFYRALIAEFVATLLFLYVTVLTVIGYKSQIDPAHGGDDCGGVGILGIAWAFGGMIFILVYCTAGISGGHINPAVTLGLFLGRKVSLIRAVLYMVAQCLGAICGVGLVKAFQKSYYHKYGGGANELAPGYNKGVGLGAEIIGTFVLVYTVFSATDPKRNARDSHVPVLAPLPIGFAVFMVHLATIPITGTGINPARSFGAAVIYNEDKPWDDHWIFWVGPFVGALIAAIYHQYILRAGAIKALGSFRSNA

SEQ ID NO: 1086 - DNA, 1152 bp, Olea europaea
  CDS (18)..(875)
aaaacgggatcccgaaaatggagagcaaagaggaagatgtacgagtgggagccaacaaattcgccgagaggcagccgattggcacggctgctcaaagccaggacaaggactacaaggaaccaccaccggcgccacttttcgagccgggtgagctgtcctcgtggtcgttctacagagctggcatagcagagttcatagccactttcttgttcctttatattacagttttgacagtgatgggagttagtaagtctgattccaagtgcaaaactgttggaatccaaggtattgcttgggcatttggtggcatgatctttgcccttgtttactgcactgcaggaatttcaggggggcatataaatccggcagtgactttcgggctgtttttggggaggaaattgtcgttgacccgggctgtgttctacatggtgatgcagtgtcttggagccatatgtggtgctggtgtggttaagggattcggaaagaccctgtacatgaccaagggtggtggtgctaatgtagtagcccacggttacaccaagggcgatggcctaggtgctgaaataatcggaacttttgtgctcgtttacactgtcttctctgctactgatgccaaacgtagcgccagagactcgcacgttcctatattggcccccttgcctattgggtttgctgtgttcttggtgcacttggcaaccatccctattaccggtacaggtattaaccccgccaggagtcttggtgcagcaatcatctacaacaaagacaaggcatgggatgatcactggatattctgggttggaccgttcattggggcagcacttgcagctctatatcatgtggtggtgatccgagccatcccattcaaaaaataagcgcgatgagattaaagccttctcaatttgtggccaactgattcaagcccatgatggaaatcgaaggctgaattttaatcttctgttgtattttctattttttctctgtttggtttgtatgtagatggtgacatgctcttagaaaaggactgaactttcaaaagataaaatccagacagagcgtgctcatgtgctcataaaaaaaagtggggactgtgtctgtaattttctgtggctgtgcaatgagaagttgtcttaataaaaaaaaaaaaaaaaa

SEQ ID NO: 1087 - protein, 285 aa, Olea europaea
MESKEEDVRVGANKFAERQPIGTAAQSQDKDYKEPPPAPLFEPGELSSWSFYRAGIAEFIATFLFLYITVLTVMGVSKSDSKCKTVGIQGIAWAFGGMIFALVYCTAGISGGHINPAVTFGLFLGRKLSLTRAVFYMVMQCLGAICGAGVVKGFGKTLYMTKGGGANVVAHGYTKGDGLGAEIIGTFVLVYTVFSATDAKRSARDSHVPILAPLPIGFAVFLVHLATIPITGTGINPARSLGAAIIYNKDKAWDDHWIFWVGPFIGAALAALYHVVVIRAIPFKK

SEQ ID NO: 1088 - DNA, 846 bp, Beta vulgaris subsp
  CDS (1)..(846)
atgactaaggaagtaagtgaagaagcacaagttcaccaacatggaaaagactacgttgatccacctccagcaccattgtttgacatgggagaactcaaactttggtcgttttggagagctgtaattgctgagttcattgcaactcttttgtttctttacataacagttgcaactgttattggttacaaaaatgaaactgacccttgtgctactgttggtctcctcggtattgcttggtcttttggtggcatgatctttattcttgtttactgcaccgctggtatttctggaggacacatcaatccagcagtaaccttcggtttgttcctagcaaggaaagtttcattgttaagagcattcttctacatggtaggccaatgcgcaggtgccatctgtggtgtaggtttagtaaaagctttcatgagtggggcctacgttcgcttaggtggtggggccaactctgtacaacctggttataataagggtactgctcttggagctgaaattattggaacttttgttttggtttacactgttttctcagcaactgaccctaagagaagtgcacgtgactctcacgtgcctatccttgcaccacttcctattggttttgctgtgtttatggttcatttggctactattcccattactggtactggtattaaccctgctagaagctttggtgctgctgttatcttcaatgataagaaggcgtgggatgaccattggatattctgggttggaccatttgtgggagcattagcagcagcagcataccaccagtacatcttgagagcagcagcaattaaggctttgggatcattccgaagcaaccctaccaactaa

SEQ ID NO: 1089 - protein, 281 aa, Beta vulgaris subsp
MTKEVSEEAQVHQHGKDYVDPPPAPLFDMGELKLWSFWRAVIAEFIATLLFLYITVATVIGYKNETDPCATVGLLGIAWSFGGMIFILVYCTAGISGGHINPAVTFGLFLARKVSLLRAFFYMVGQCAGAICGVGLVKAFMSGAYVRLGGGANSVQPGYNKGTALGAEIIGTFVLVYTVFSATDPKRSARDSHVPILAPLPIGFAVFMVHLATIPITGTGINPARSFGAAVIFNDKKAWDDHWIFWVGPFVGALAAAAYHQYILRAAAIKALGSFRSNPTN

SEQ ID NO: 1090 - DNA, 861 bp, Beta vulgaris subsp
  CDS (1)..(861)
atggaagggaaagatgaagatgttagacttggagcaaacaaattttcagaaaaacaagggttaggaacagtggcacaagatagagattacaaagaaccaccaccagcaccactgttcgaacctggagagttaacatcttggtcattttatagagctggaattgcggaatttattgcaactttcttgtttctttacataagtattttgactgttatgggttacagtcgtacagccaacaaatgttctactgttggtattcagggtattgcttgggcttttggtggaatgatctttgctcttgtttattgtactgctggaatttctggaggtcacattaacccagcagtgacattgggtttgttcttggcaaggaaattgtccttgacaagagcagtgttctacatgataatgcaatgcttgggtgccatttgtggtgctggtgtggttaagggcttccaacccaccccctacatgactgctggcggtggtgctaactatgtccaccatggctacaccaagggtgatggtctcggtgctgagatcatcggtactttcgttcttgtctacaccgtcttctctgccactgacgccaagagaagtgctagggactctcatgttcctatcttggctccattgccaattgggttagccgtgttcttggttcacttggccactatccccattactggcactggtatcaaccctgctagaagtcttggtaccgcaatcatcttcaacagacaccacaactcttggaacgaccactggatcttctgggtgggacccttcattggagcagcactagcagcagtgtaccacacagtggtgatcagggcaattccattcaagtccaagtcgtaa

SEQ ID NO: 1091 - protein, 286 aa, Beta vulgaris subsp
MEGKDEDVRLGANKFSEKQGLGTVAQDRDYKEPPPAPLFEPGELTSWSFYRAGIAEFIATFLFLYISILTVMGYSRTANKCSTVGIQGIAWAFGGMIFALVYCTAGISGGHINPAVTLGLFLARKLSLTRAVFYMIMQCLGAICGAGVVKGFQPTPYMTAGGGANYVHHGYTKGDGLGAEIIGTFVLVYTVFSATDAKRSARDSHVPILAPLPIGLAVFLVHLATIPITGTGINPARSLGTAIIFNRHHNSWNDHWIFWVGPFIGAALAAVYHTVVIRAIPFKSKS

SEQ ID NO: 1092 - DNA, 931 bp, Helianthus annuus
  CDS (53)..(799)
ttttcttcacactctccatttcttttaattatttaagttctgaaaaaacaaaatgcctggaattgcatttggtagttttgatgattcctttagcttgagctccatcaaatcctacgttgcagagttcatctccacccttctcttcgtcttcgcgggtgtcggctccgccattgctttcgccaagttgacagcggatgctgaccttgatccagccggtctggtggctatcgcggtctgccatggacttgcactctttgtcgcggtctccatcgccgctaacatctctggcggccatgtcaatccagctgtcaccttcggattggctgttggcggtcaaatcaccatcctaactggcatcttttactggattgcccaatgcattggctccatcgccgcatgctaccttcttagcttcgtcactggaggcttggcggtgcctacccatgcggttgctgctggtgttggagctatccaaggagtagtgatggaaatcattatcacatttgcattggtgtacaacgtttacgccaccgcagttgaccccaagaagggcgatttgggcacaatcgcgccacttgccattggtctcattgtaggtgccaacattttggctgccggtccattctctggtggatcaatgaacccggcccgatccttcggtcctgctgtggccgctggtgatttctccggccactggatctactgggttggacctctcgttggtggtggcttagccggagcaatttacagcaatgtgtttattagtaatgaacatgctcccctttccagcgagttttaatgttttttttcttgtgaaccagatcagtttgtaattgtaataaaagaaaggaaagcaatttatttgtttttcttttctttttctaattttaatttttaatttatgaaaaattttaatttggttgtggttttt

SEQ ID NO: 1093 - protein, 248 aa, Helianthus annuus
MPGIAFGSFDDSFSLSSIKSYVAEFISTLLFVFAGVGSAIAFAKLTADADLDPAGLVAIAVCHGLALFVAVSIAANISGGHVNPAVTFGLAVGGQITILTGIFYWIAQCIGSIAACYLLSFVTGGLAVPTHAVAAGVGAIQGVVMEIIITFALVYNVYATAVDPKKGDLGTIAPLAIGLIVGANILAAGPFSGGSMNPARSFGPAVAAGDFSGHWIYWVGPLVGGGLAGAIYSNVFISNEHAPLSSEF

SEQ ID NO: 1094 - DNA, 864 bp, Picea abies
  CDS (1)..(864)
atggaaggaaaagaagaagacgttaggctcggggcgaacaagtattccgaaaggcagccgctggggactgcggcgcagacgagggagaaggattacaaggattcaggtccggctccactgttcgaacccggagagttagcgtcatggtccttctggagggcgggtattgcagaattcatggccacctttctgtttctctacgtaacgattctcacagtcatgggggttaagagatcccccagcatgtgccagtctgtgggcatccaagggattgcatggtcctttgggggaatgatctttgcccttgtttattgcactgcagggatctcgggtggtcacataaaccctgcggtcaccttcggcttgttcttggccaggaaggtctctctgcctcgcactgtcttctacatgatatgccagtgcctgggagccatgtgtggcgctggagtggtcaaggggatgcagaaaggcatgtatgaagttgaaggaggaggggccaatcttgtggcccatggatacagtaaaggagatgggctgggtgctgagattgtgggcacctttgtattggtctacactgttttttctgctactgatgcgaagagaagtgccagggattctcatgtccctgtgttggctccattgcctattggatttgcagtgtttctggtgcatttggcaaccattccaatcactggaacaggcatcaaccctgctaggagcctcggggtagccatcatttatggcaggagccatgcttgggatgaccggtggattttctgggtaggacccttggttggcgctgctcttgcagctatatatcatcagctcatcatccgagccatacccttcaaatctcgtagttag

SEQ ID NO: 1095 - protein, 287 aa, Picea abies
MEGKEEDVRLGANKYSERQPLGTAAQTREKDYKDSGPAPLFEPGELASWSFWRAGIAEFMATFLFLYVTILTVMGVKRSPSMCQSVGIQGIAWSFGGMIFALVYCTAGISGGHINPAVTFGLFLARKVSLPRTVFYMICQCLGAMCGAGVVKGMQKGMYEVEGGGANLVAHGYSKGDGLGAEIVGTFVLVYTVFSATDAKRSARDSHVPVLAPLPIGFAVFLVHLATIPITGTGINPARSLGVAIIYGRSHAWDDRWIFWVGPLVGAALAAIYHQLIIRAIPFKSRS

SEQ ID NO: 1096 - DNA, 1135 bp, Mesembryanthemum crystallinum
  CDS (65)..(922)
cttccctctgcaagtagagagagaaaccaaagaagaaaatctagagagagaaacaacccgaaaaatggagggaaaggaagaggatgtgaaggtgggagccagcaagtacccagagaagatgccgctggggatggcgcggcaaacaaaggactacaaggagccaccaccggcgccgctgttcgagccggatgagctcaagtcctggtcgttttacagagctgggctcgccgagttcatcgccaccttcttcttcctttacgtgagtgttttaactgttatgggtgttagtcgcaatcccaacaagtgtgctactgttggaattcagggcattgcttgggcttttggtggcatgatttttgctcttgtttactgtactgctggtatctctggtgggcacataaacccagcagtgacctttgggctgctattggcaaggaagctgtccttaacaagggcagttttctacatgataatgcaatgccttggagcaatctgtggggctggtgtggtgaaggggttcgagtctggcgcatacgagtcaatgggtggtggagccaatgtagtggcctctgcgtacaccaagggagatgggcttggtgctgagattatcggcacttttgtccttgtctacactgtcttctccgccactgatgccaagagatctgccagagactcccatgttcctctattggcacctcttccaattgggtttgcagtgtttttggttcatttggcaaccatacccatcactggaactggtattaacccagcaaggagtttgggagctgcaatcatctacaacaaggcccatgcatgggatgaccattggattttctgggtgggacccttcattggagctgctcttgctgctgtgtaccaccagattgtcatcagggccatacgcttccattccaaggcttgatttttagggttttattaaagatagcagaatttgtgtaagaattttttgagtcatttttgtccttgtaatattagtttttcttctctcttctcaatctctttctgatctgttgtgtcttgtggaatattattggtcctgaaatgtgtgtaaattattgaattgttgatgtattattgggtgaccttttgttgtagtggaagattcttcttttat

SEQ ID NO: 1097 - protein, 285 aa, Mesembryanthemum crystallinum
MEGKEEDVKVGASKYPEKMPLGMARQTKDYKEPPPAPLFEPDELKSWSFYRAGLAEFIATFFFLYVSVLTVMGVSRNPNKCATVGIQGIAWAFGGMIFALVYCTAGISGGHINPAVTFGLLLARKLSLTRAVFYMIMQCLGAICGAGVVKGFESGAYESMGGGANVVASAYTKGDGLGAEIIGTFVLVYTVFSATDAKRSARDSHVPLLAPLPIGFAVFLVHLATIPITGTGINPARSLGAAIIYNKAHAWDDHWIFWVGPFIGAALAAVYHQIVIRAIRFHSKA

SEQ ID NO: 1098 - DNA, 1278 bp, Mesembryanthemum crystallinum
  CDS (225)..(1076)
gagagaactagtctcgagtttttttttttttttttttttattcataagagtttaatgaataacatacaacaacaacatatttcacaaatcgaaatttacagcaatgatgtaattaacctcaactcaaaccaccacagtctcacagagcagcaccaaaaagagcatagctcactgcctttctttctagagagagaaacaagagagagagagaaacaagagaagcaatggaggggaaggaagaggatgtgagactaggagccaacaagttctcggagaggcagccgctggggacggtggcgcaggacagagactacagggagccaccgcgcgcgctctttgaggccggcgagctgacgtcatggtcgttctacagagctgggattgctgagttcattgctaccttcttgttcctctacatctctatcttgactgttatgggggttaataggagtccctcaaagtgtgccagtgttggaattcagggtattgcttggtcttttggtggcatgatctttgcccttgtttactgcactgctggaatttcaggaggtcacattaacccagcagtcacatttgggctattcttggcaaggaaattgtccttgacaagggcagtcttctacatggtcatgcaatgcttgggtgccatttgtggtgctggtgttgtcaagggcttccagcccaccccctaccagctcttgggcggcggggccaactctgtgaaccccggctacaccaagggatcaggccttggcgctgagattatcggcacttttgttcttgtctacaccgtcttctccgccactgacgccaagcgaagcgctagggactcccatgttcctatcttggctccattgccaattgggttcgctgtgttcttggttcacttggccaccatccccgttactggcactggcatcaacccagccaggagtcttggtgctgctatcatttacaacaggccccatgcttgggctgaccattggattttctgggtgggacccttcatcggtgcagcacttgcagccctgtaccatgtagtagtgataagggcaattccattcaaatccaagtgatgataagatttcgagtgatgatgaatgatcatcggacggccaagattaattgtcgaggtctctagatgataagattggacccccacgtgtcattttccctagttatttttatctctccttctgtgtttgtcttttgtactgtactagtttgtaaagttatggtgttttggggtctcagaagaacgtgggatgtttcatgttt

SEQ ID NO: 1099 - protein, 283 aa, Mesembryanthemum crystallinum
MEGKEEDVRLGANKFSERQPLGTVAQDRDYREPPRALFEAGELTSWSFYRAGIAEFIATFLFLYISILTVMGVNRSPSKCASVGIQGIAWSFGGMIFALVYCTAGISGGHINPAVTFGLFLARKLSLTRAVFYMVMQCLGAICGAGVVKGFQPTPYQLLGGGANSVNPGYTKGSGLGAEIIGTFVLVYTVFSATDAKRSARDSHVPILAPLPIGFAVFLVHLATIPVTGTGINPARSLGAAIIYNRPHAWADHWIFWVGPFIGAALAALYHVVVIRAIPFKSK

SEQ ID NO: 1100 - DNA, 1049 bp, Nicotiana tabacum
  CDS (19)..(873)
gtgactgaagaaaaaaaaatggcagagaacaaggaagaggatgttaagctaggagcaaacaagtacagagaaacacaacctttgggtacagcagctcaaacagacaaggattataaggagccaccaccagctcctttggtttggaggcagaagagttgtcgtcatggtctttttacagagctggaattcagcatggccactttcttgttcttgtacatcactatcttgactgttatgggtcttaaaagatctgatagtttgtgttcttctgttggtattcaaggagttgcttgggcttttggtggtatgatctttgcccttgtctactgcactgctggtatctcaggaggacacattaacccagcagtgacatttggtctgttcttggcaagaaagttgtctttaacaagggctgtgttctacatggtgatgcagtgcctaggtgcaatctgtggtgctggtgttgttaaaggttttatggtgggtccataccagagacttggtggtggggccaacgtggttaaccctggctacactaaaggtgatggacttggtgctgagattattggcacctttgtccttgtttacactgttttctctgccactgatgccaagagaaatgctagagattcacatgttcctattttggcacctcttcctattggattcgcggtgttcttggttcatttggccaccatcccaatcaccggaaccggtatcacccccgcccggagccttggagctgctatcatcttcaaccaagaccgggcatgggatgatcactggatcttctgggttggaccattcattggagctgcacttgctgcagtttaccaccagataatcatcagagccattgcattcaagagctaaagctcttaattatcttgaagagtctcatgtcctatgtctcttccctgttatatttcaagactcctgtacccctttttcccccgtttctaatgctgttgtctcatgtaattttcttctcttttgatgttaattatgtgtgtaaattatcaggttaaaaaaaaaaaaaaaaaaaaaaa

SEQ ID NO: 1101 - protein, 284 aa, Nicotiana tabacum
MAENKEEDVKLGANKYRETQPLGTAAQTDKDYKEPPPAPLVWRQKSCRHGLFTELEFSMATFLFLYITILTVMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGITPARSLGAAIIFNQDRAWDDHWIFWVGPFIGAALAAVYHQIIIRAIAFKS

SEQ ID NO: 1102 - DNA, 1318 bp, Hordeum vulgare
  CDS (133)..(993)
tgcatgctcgagcggccgccagtgtgatggatatctgcagaattcgcccttagagcgaaaaagaaaagcacactgaacaactgcagcaagcaccgttcaagctagagggcactaggttgagctagcttagcaatggccaaggacattgaggcggcaccccaagggggcgagttctccagcaaggactactcggacccgcccccggcgccgatcgtggacttcgaggagctgaccaagtggtcgctgtaccgcgcggtgatcgccgagttcgtcgccacgctcctcttcctctacatcaccgtggccaccgtcatcgggtacaagcaccagtccgaccccaccgtcaacaccaccgacgcggcctgcagcggcgtcggcatcctcggcatagcatgggccttcggcggcatgatcttcgtcctcgtctactgcaccgccggcgtctcaggtggacacatcaacccggcggtgaccttcgggttgttcctggcgaggaaggtgtcgctcatccgggcgctgctctacatcatcgcgcagtgcctcggcgccatctgcggcgtcggccttgtcaagggtttccagagctcctactacgtgcggtacggcggtggcgccaacgagctcagcgcaggctactccaagggcaccggtctagcggccgagatcatcggcaccttcgtgctcgtctacacggtcttctccgccaccgaccccaagcgcaacgcccgtgattcccacatcccggtgctggctcctctcccaatcggattcgctgtgttcatggtccacttggccaccatccccatcaccggcaccggcatcaaccccgcgagaagcttgggagctgctgtcatctacaacactgacaaggcctgggatgaccaatggatcttctgggtggggccactgatcggcgccgccattgccgccgcctaccaccagtatgtgctgagggccagcgccgccaagctcgggtcctacaggagcaactaagtcgcccgtagctccggccggacgcgcgagggggggcactgaagtgtagatatgtgcgaagaagaaggccgcctccagccaatgcgctatggctgctcgatcccaccgcttggttcagtggctccagtcttcgcatcatctgctgctaccgttcctcggcttgtgcatatgttgatgtgaccgtccattcgtatgtcgacgtgtttccggagttcgccatgtttgcttgctgctgtttcttccaagtgtgcttttcttttgctcgctctaagggcgaattccagcacactggcggccgttactagtggatccgagctcgtaccaa

SEQ ID NO: 1103 - protein, 286 aa, Hordeum vulgare
MAKDIEAAPQGGEFSSKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 1104 - DNA, 867 bp, Aegiceras corniculatum
  CDS (1)..(867)
  misc_feature (403)..(403): r is g or a
atggaaggaaaagaagaggatgttcgtctcggagcgaacaagtttgcggagaggcagcctattgggacggctgcccagggtgcgggggacaaggactacaaagagccccccgcagcccctctgttcgagcctggtgaattgtcctcgtggtcgttctatcgtgctggcattgccgagttcatggccactttcttgtttttgtacataactgtgctgacggtgatgggtgtgagtaggtcggggtctaagtgcgccagtgttggcatccagggaatcgcctgggcgtttggtgggatgatcttcgcccttgtttactgcactgctggaatttcgggggggcatattaacccggctgtgactttcgggctgctgttggctaggaagttgtctctaacgagggccrtgttctacatgataatgcagtgccttggagccatatgcggtgcaggtgtggtgaaggggtttgagggcagtagccgttttacaatagcaggtggaggggcaaatgtagtacaacctggtcacaccaagggcgacggacttggtgcggagattgttggcacttttgtgctagtctacactgttttctccgccactgatgcaaagcgtaacgccagggactcccacgtcccaatattggcaccattgcctattggattcgcagtgttcttagtgcatttggccaccatcccaatcacaggtaccggtatcaaccccgccaggagccttggtgccgcaatcatctacaacaaggatcaagcctgggatgaacattggatattctgggtgggacccttcatcggtgcagctctcgcagctttgtaccaccaagtcgtgatcagggccatacccttcaagtccaagtga

SEQ ID NO: 1105 - protein, 288 aa, Aegiceras corniculatum
  misc_feature (135)..(135): The Xaa at location 135 stands for Met, or Val.
MEGKEEDVRLGANKFAERQPIGTAAQGAGDKDYKEPPAAPLFEPGELSSWSFYRAGIAEFMATFLFLYITVLTVMGVSRSGSKCASVGIQGIAWAFGGMIFALVYCTAGISGGHINPAVTFGLLLARKLSLTRAXFYMIMQCLGAICGAGVVKGFEGSSRFTIAGGGANVVQPGHTKGDGLGAEIVGTFVLVYTVFSATDAKRNARDSHVPILAPLPIGFAVFLVHLATIPITGTGINPARSLGAAIIYNKDQAWDEHWIFWVGPFIGAALAALYHQVVIRAIPFKSK

SEQ ID NO: 1106 - DNA, 1263 bp, Mimosa pudica
  CDS (56)..(901)
cctcctagcaagctaaagctagcttttttttttctcttctctctctgtatcagccatgactaaggaccttgaaggacctcctcctcctcacaaggactaccatgaccctcctccagctcctctcttggacgccgccgagctcggcaagtggtccttctacagagccgtcattgccgagttcgtcgccaccctcctcttcctctacatcactgtcctcaccgtcatcggctacaagtcccagatcgacggcggccacgactgcgacggcgtcggcgtcctcggcattgcctgggccttcggtggcatgatcttcatcctcgtctactgcaccgccggcatttctggtgggcacataaacccggcggtgacgtttgggctatttctggctcggaaggtgtcgttgattagagccatagcgtacatagtggctcagtgcctgggagccatatgtgggtgtggcttggtgaaggctttccagaaggccttctacaacaggtatggcggtggagccaacaccttgtctactggctacagctctggcactggcttgggtgctgagatcataggcaccttcgtccttgtctacaccgttttctccgccactgaccccaaacgaaatgcccgagactctcacgtccccgtattggctcctcttcctattggatttgccgttttcatggttcacctaaccaccattcccatcactggcactggtatcaacccggccaggagctttggggctgcagtcatgtacaacaattttgaggcatgggatgaccactggatcttttgggtgggacctttcattggtgctgccatagctgccatttaccaccaatatgtgttgagagctcaggcggccaaggctctgggttctttcaggagcagctcccacttgtgatttccatacagggcatggctgaaggacatggatgaggatgaactggatttctatagaagaatgcatggcggattattgccatttttaattgcatgtatgtcctcgtcgtatttaatttatgatgtgctgtgttattattgttattttaattagtggtgtcaagattcagcaaccgggtgtattactgttttatgtgttactttagggattgccttcagttaaacgtgcgtttgatgtccttttttgaattaatttggcaatttctgtatgtgtcgttattttgtgcagtggttattttgtattgggagagaattgaaagagaattactgaattgatgttgaatttcaaaaaaaaaaaaaaaa

SEQ ID NO: 1107 - protein, 281 aa, Mimosa pudica
MTKDLEGPPPPHKDYHDPPPAPLLDAAELGKWSFYRAVIAEFVATLLFLYITVLTVIGYKSQIDGGHDCDGVGVLGIAWAFGGMIFILVYCTAGISGGHINPAVTFGLFLARKVSLIRAIAYIVAQCLGAICGCGLVKAFQKAFYNRYGGGANTLSTGYSSGTGLGAEIIGTFVLVYTVFSATDPKRNARDSHVPVLAPLPIGFAVFMVHLTTIPITGTGINPARSFGAAVMYNNFEAWDDHWIFWVGPFIGAAIAAIYHQYVLRAQAAKALGSFRSSSHL

SEQ ID NO: 1108 - DNA, 1216 bp, Vitis vinifera
  CDS (76)..(930)
gaattcactagtgattaccttctcctgaaccccctagctcttctctttgcctagtgtttttctgctataacatttatgaccaaggacgttgaggttgcggagcatgggtccttctccgccaaggactatcatgacccgccgccggcgccgctgttcgactcagttgagctcactaagtggtccttctacagggctctgattgcggagttcattgccacgctgctcttcctttacattacggtgctgacagtcatcggctacaagagccagactgccgggggtgacccatgcggtggtgttggcattctgggcattgcttggtcttttggtggcatgatctttatccttgtttactgcactgccggcatttctgggggacacattaacccggcggtgacctttgggctgttcctggcccggaaggtgtcgctgatccgagcaatattgtacatggtggctcagtgtcttggagccatttgcggtgtgggtctcgtcaaagccttccaatctgcttactatgatcgctacgggggcggtgccaacgagctctccaccggctacagcaaaggcaccggcttgggcgctgagatcattggaacttttgtccttgtctacaccgtcttctctgcaactgaccccaagaggagtgccagagactcccatgttcctgttctggcacctcttccaattgggtttgccgtgttcatggttcacttggccactattcctatcactggcaccggtatcaaccctgccaggagtttgggggctgctgttatctacaacaatgagaaggcctgggatgaccagtggatcttttgggttggacccttcattggtgcagccattgcagccttctaccaccagttcatattgagagctggagctgtcaaggctcttgggtcattcaggagcaccactcatgtatgatttgcagagccattttgataccttcttccactgtttttgggggtgaagaaaaagaatttggaaggaggagaagtgatcggaattggaagaataattatggaggttgttattgatatgtatgagggcatgaaattgtagataccatctctatggaaataggaagctttttgtattcctcccttaagcacttttcttttaatccacttcatgcttatcttttcctagttttctctttcattgtttgcttatgcttgaacaaaattctgtgttgggctttgtcttgttg

SEQ ID NO: 1109 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTTHV

SEQ ID NO: 1110 - DNA, 1254 bp, Glycyrrhiza uralensis
  CDS (85)..(954)
cgcccgggcaggtaagtactccatcagcttcattcacagcaagagataaggtgtgaaattaattaaacccaaaaaaggaagaagatggaagggaaggaacaagatgtgtcgctgggagcgaacaaattcccggagaggcaaccgattggtacagcggcacagacccaagacgatgggaaggactacaaggagccaccacctgcaccactgttcgagcccaacgagctcacctcttggtctttctacagagcagggatagctgagttcgtagccacttttctgttcctgtacatcaccatcttgaccgtcatgggcgttaacagatcagaatccaagtgcaaatccgttggtattcaaggaatcgcttgggcctttggtggcatgatcttcgccctcgtttactgcaccgctggcatctctgggggtcacataaacccggctgtgacatttggtctgttcttggcgaggaagttgtcgttgacaagggcggtgttctacatggtgatgcagtgtcttggagctatctgtggtgctggtgtggttaagggttttgagggaaagaccttgtacggcaaatacaacggtggtgccaactttgtgaactctgggtacacaaaaggtgacggactcggtgctgagattgttggcacctttgttcttgtctacaccgttttctcagccaccgatgccaagcgtagcgccagagactctcacgtccctattttggcaccgttgccaattgggttcgctgtgttcttggtgcgcttggccaccatcccaatcaccggaactggtatcaaccctgcacgtagtcttggtgctgctatcatcttcaacaaggaccgtggttggaatgatcactggatcttctgggtgggaccattcattggagcaggtcttgcagctctctaccacgtagtcgtaatccgtgccattcccttcaagtcgaagtgatgatgatcattgaatcaaacggttcgtggttatcaatcaagttgtgggttccatttcatcatcatcatcatcatgatctgtttatcttctttttttagttttaaagtattgtaatttgtaattttgtatgtaaattaaagatcgtgtaatatggtgattatattattactagggggttgcacttgcatgtgttggcgtcatgggccattccactgcttttaagttggaaggagggcccagctcgtgtgtgatgtacggctgtgattgtgtatttgccaaataaaataacacccgatcgag

SEQ ID NO: 1111 - protein, 289 aa, Glycyrrhiza uralensis
MEGKEQDVSLGANKFPERQPIGTAAQTQDDGKDYKEPPPAPLFEPNELTSWSFYRAGIAEFVATFLFLYITILTVMGVNRSESKCKSVGIQGIAWAFGGMIFALVYCTAGISGGHINPAVTFGLFLARKLSLTRAVFYMVMQCLGAICGAGVVKGFEGKTLYGKYNGGANFVNSGYTKGDGLGAEIVGTFVLVYTVFSATDAKRSARDSHVPILAPLPIGFAVFLVRLATIPITGTGINPARSLGAAIIFNKDRGWNDHWIFWVGPFIGAGLAALYHVVVIRAIPFKSK

SEQ ID NO: 1112 - DNA, 840 bp, Physcomitrella patens
  CDS (1)..(840)
atggcaaaagacgtgggcgtggagcctgggttcccctccaaggactacacagacccacctcctgcgcctctcattgacgcatccgagtttgggcaatggtccttctaccgagcagtcatcgctgagtttgtagccactcttctcttcctgtacattaccattgccaccgtgataggcgcagtccgaaatgctggctgtgatggggtgggacttcttggcatcgcatgggcttttggaggcatgattttcgtgctggtgtactgcaccgccggtatctcaggaggtcatattaatccagctgttacgttcggcttgctgttggcacgcaaaatctcgctgccccgagcgcttgcctacatgatcgcgcagtgcttaggagctatctgcggtgccggtctagtgaagggatttcagactgctttctacatgaggtatggtggaggcgcaaactctgtggccgcagggtacagcatcggcacaggactagccgccgagatcatcggaacgtttgttctagtgtacaccgtcttctctgccacagaccccaagcgcaatgctcgtgattctcatgtgccggtgttggctcctcttcccataggatttgcggtgttcatggttcatttggcaactattcccattaccggaactggaatcaacccagcaagaagctttggcgccgctgtcatctacaaccgcagcaagccttggaatgaccactggatctattgggtgggtccattcctgggagctgctttggccgccgcttaccaccaatatgtgcttagagctggtcctttcaagtctctgggctccttccgcagtgccccaagtcacatctaa

SEQ ID NO: 1113 - protein, 279 aa, Physcomitrella patens
MAKDVGVEPGFPSKDYTDPPPAPLIDASEFGQWSFYRAVIAEFVATLLFLYITIATVIGAVRNAGCDGVGLLGIAWAFGGMIFVLVYCTAGISGGHINPAVTFGLLLARKISLPRALAYMIAQCLGAICGAGLVKGFQTAFYMRYGGGANSVAAGYSIGTGLAAEIIGTFVLVYTVFSATDPKRNARDSHVPVLAPLPIGFAVFMVHLATIPITGTGINPARSFGAAVIYNRSKPWNDHWIYWVGPFLGAALAAAYHQYVLRAGPFKSLGSFRSAPSHI

SEQ ID NO: 1114 - DNA, 840 bp, Physcomitrella patens
  CDS (1)..(840)
atggcaaaagacgcgggcacagagtcaggggtcccttccaaggactactctgatccacctccggcgcctctcattgacgccgccgagttcggccgatggtccttctacagagccatcatcgccgagttcgtcgccactttgctgttcctgtacatcaccatttcaaccgtgatcggtgccagccgaaatgcaggctgtgcgggagtcggactattgggcatcgcctgggcgtttggaggcatgattttcgtgttggtgtactgcaccgctggtgtctcaggagggcatatcaacccagcagtcacgttcggtttgctcatggcacgaaaaatttcgctacctcgtgctcttacatacatgatagctcagtgcctgggagcaatctgcggtgcaggccttgcgaaggggttccagactgctttctacatgagatatggaggaggagcaaactctgtggctctggggtacagtacaggcactggtctggccgctgagatcatcggcactttcgttctggtatacaccgtgttctctgccaccgaccccaagcgcaatgcccgtgacagtcatgtgccggtgttagctcctcttcccataggatttgcagtcttcatggttcatttggcaactatccccatcacaggaactggtatcaatcccgcaagaagcttcggcgcagctgtcatctacaatcgcagcaagccttgggatgatcactggatcttctgggtcggtccatttctgggagcagctttggcggctagttaccaccaatacatcttgagagcagcacctttcaagtctcttggctccttcagaagtgcccctagccacgtctaa

SEQ ID NO: 1115 - protein, 279 aa, Physcomitrella patens
MAKDAGTESGVPSKDYSDPPPAPLIDAAEFGRWSFYRAIIAEFVATLLFLYITISTVIGASRNAGCAGVGLLGIAWAFGGMIFVLVYCTAGVSGGHINPAVTFGLLMARKISLPRALTYMIAQCLGAICGAGLAKGFQTAFYMRYGGGANSVALGYSTGTGLAAEIIGTFVLVYTVFSATDPKRNARDSHVPVLAPLPIGFAVFMVHLATIPITGTGINPARSFGAAVIYNRSKPWDDHWIFWVGPFLGAALAASYHQYILRAAPFKSLGSFRSAPSHV

SEQ ID NO: 1116 - DNA, 1039 bp, Vicia faba
  CDS (48)..(920)
acgcggggatagcattcatattcctccattcatcaagagagtgagaaatggaagcaaaggaacaagatgtttcacttggagccaacaaattcccagagagacaacccatcggtattgcagctcagagccatgacgacggaaaggactataaggaaccacctccagcaccgttgttcgagccttctgaactcacttcatggtctttctacagagctgggatagccgagttcgtcgcaacttttctgtttctctacatcaccatcttgactgtcatgggtgtcaacaaatctcagtccaagtgtgcaactgttggtattcaaggaatcgcttggtctttcggtggcatgatctttgcccttgtttactgcaccgctggaatctctgggggtcacataaacccggcagtgacattcggtttgttcttggcgaggaaactgtctctaacaagagcagtgttctacatcgtgatgcaggttctcggtgctatctgtggtgctggtgtggttaagggttttgaaggaaaagccttcttcggtgaaaaaggcggtggtgctaattttgttgctcctggttacacaaaaggagatggacttggtgctgagattattggtacctttgttcttgtttacaccgttttctcagccactgatgccaaacgtagtgccagagactctcacgttcctattttggctcctttgccaattgggtttgctgtgtttttggttcatttggccactattccaatcactggaactggtatcaaccctgctaggagtcttggtgctgcaattatcttcaaccaagatcgtggctggaatgatcagtggattttctgggttggaccattcattggtgcagcacttgcagcactttaccacacagttgtgatcagagccattcctttcaagtccagatcctgatttgatttctttctttataaaacttcattgttgcatcttggattgtaattgagcttgaaaatatttgagagatctggatcatgtgtttattcaaaaaaaaaaaaaaaaaaaaaaaaaaa

SEQ ID NO: 1117 - protein, 290 aa, Vicia faba
MEAKEQDVSLGANKFPERQPIGIAAQSHDDGKDYKEPPPAPLFEPSELTSWSFYRAGIAEFVATFLFLYITILTVMGVNKSQSKCATVGIQGIAWSFGGMIFALVYCTAGISGGHINPAVTFGLFLARKLSLTRAVFYIVMQVLGAICGAGVVKGFEGKAFFGEKGGGANFVAPGYTKGDGLGAEIIGTFVLVYTVFSATDAKRSARDSHVPILAPLPIGFAVFLVHLATIPITGTGINPARSLGAAIIFNQDRGWNDQWIFWVGPFIGAALAALYHTVVIRAIPFKSRS

SEQ ID NO: 1118 - DNA, 1174 bp, Fraxinus excelsior
  CDS (20)..(880)
gcgtgagaaaaggaaagaaatggagagcaaagaggaagatgtacgagtgggagccaacaaattcaacgagaggcagccgattggcacggcggcgcaaagccaagacaaggactacaaggagccaccaccggcaccgcttttcgatcccggtgagctgtcctcatggtcgttctacagagctggcatagccgagttcatagccactttcctgttcctgtatattgcaattttgacagtgatgggagtaagcaagtctgattctaagtgctctactgttggaatccaaggaattgcttgggcattcggcggcatgatctttgcccttgtttactgcaccgctggaatttcaggggggcatataaatccggcagtgacgtttgggttgtttttggcaaggaaattgtcattgactcgggctatattctacatggtgatgcagtgtctaggagccatatgtggtgctggtgtggttaaggggttcggaaagaccctgtacatgaccaagggcggaggtgctaatgttgtagctcccggttacaccaagggtgatggcctaggtgctgaaattgtaggtaccttcgtgcttgtttacaccgttttctccgctactgatgccaaacgtagcgccagagactctcacgttcctatattagcccccttgcccattgggtttgccgtgttcttggtccacttggcgaccatccctattacgggtactggtattaaccccgccaggagtcttggagcagcaatcatctacaacaaagaccacgcatgggacgatcattggatattctgggttggaccattcattggggcagcacttgcagctctctaccatgtggttgtgatcagagccatcccattcaagaataagtgataccattaggccttctcacttgtgaccactgcttcaagcacatgaaggatattgaaggctggaattatttctgttgtattttctattttcctctgtttggttgtatgtattttatctgtacttgtgtattgagatagtgagagatgctctttgaaaaggacttcacttttggaagaagaccaaacagagcatgctcatgtcctcataaaaagtaatgggccaggctttgatctgtaatttggctgtgcaatgagaagtcttaataatcaaaaaaaaaaaaaaaaaaaaaaaaaa

SEQ ID NO: 1119 - protein, 286 aa, Fraxinus excelsior
MESKEEDVRVGANKFNERQPIGTAAQSQDKDYKEPPPAPLFDPGELSSWSFYRAGIAEFIATFLFLYIAILTVMGVSKSDSKCSTVGIQGIAWAFGGMIFALVYCTAGISGGHINPAVTFGLFLARKLSLTRAIFYMVMQCLGAICGAGVVKGFGKTLYMTKGGGANVVAPGYTKGDGLGAEIVGTFVLVYTVFSATDAKRSARDSHVPILAPLPIGFAVFLVHLATIPITGTGINPARSLGAAIIYNKDHAWDDHWIFWVGPFIGAALAALYHVVVIRAIPFKNK

SEQ ID NO: 1120 - DNA, 1189 bp, Ipomoea nil
  CDS (92)..(946)
ttgcaacaatttcacccaacgttcaacgttaaactttgcagaactctcattttcttggtaataatttggtagatcaatcgaagagctgaggatggagcacagagaagaggatgtgagattgggggccaacaagttcccggagaagcaagccatcggcacggcagcgcaagacaaggactacacggaggcaccgccgacggcgctgttcgagcccagcgagctctcctcgtggtccttttaccgcgccggaatcgccgagttcatagccaccttcctcttcctttacatcaccattctcaccgtcatgggcgtcagcaaatccgactccaaatgcaaaaccgtcggcattcagggcatcgcttgggccttcggcggcatgatcttcgccctcgtttactgcaccgccggcatctccggggggcatattaatccggcggtaacgttcgggctgtttctggctcggaaagtgtcgttgactaggctggtgtactacattgtgatgcagtgtctgggggcgatctgcggcgccggcgtggtgaaggggttcggaaagacgctgtacaactccaaaggcggcggcgccaacgttgtaaaccccggatacaccaaaggcgacggcctcggcgccgagattgtcggcacctttgttcttgtttacaccgtcttctccgccactgatgccaaacgcaacgccagagactcccatgtccctgtgttggcaccgttgcccattgggttcgccgtcttcttggtgcacttggctaccattccgatcaccggcacgggtattaacccggcccgaagtctcggtgcagccatcatctacaacaatgaacacgcatggaatgatcattggatcttctgggttggaccatttgttggggcagcactggctgcactgtaccaccaggttgtgatcagagccatcccattcaagtcatcctgatccgactacttatcatcttcttcaattgtactgttctccattatgaagccttttattttgcctaattttcttgtggctggcgatgaaatgaagcagagagataaaggacaagacaacctcaattcaattattggaacatgttgcttgttatctctaggacatttgcttttcattaaagtccaaaagagttaaacagttgggcgtttgtataatttgtatgtttgttctgtaatcttgaggttg

SEQ ID NO: 1121 - protein, 284 aa, Ipomoea nil
MEHREEDVRLGANKFPEKQAIGTAAQDKDYTEAPPTALFEPSELSSWSFYRAGIAEFIATFLFLYITILTVMGVSKSDSKCKTVGIQGIAWAFGGMIFALVYCTAGISGGHINPAVTFGLFLARKVSLTRLVYYIVMQCLGAICGAGVVKGFGKTLYNSKGGGANVVNPGYTKGDGLGAEIVGTFVLVYTVFSATDAKRNARDSHVPVLAPLPIGFAVFLVHLATIPITGTGINPARSLGAAIIYNNEHAWNDHWIFWVGPFVGAALAALYHQVVIRAIPFKSS

SEQ ID NO: 1122 - DNA, 829 bp, Triticum aestivum
  CDS (52)..(798)
acattccgtctcatcctccccagctcggtttttgggccattctaagccaccatgcctgcctccatcgccttcggtcggttcgatgactccttcagcttggcctctttcaaggcctacatcgccgagttcatctccaccctcatcttcgtcttcgccggcgtcggctctgccatcgcctactccaaggtgagcggcggcgcgccgcttgacccatccgggctgatcgccgtggccatctgccacgggttcgggctgttcgtcgcggtcgccgtcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttctgcaccggcgtggcgacccctacacacgggctttccggcgtgggcgccttcgagggcgtcgtgatggagatcatcgtcaccttcgggctcgtctacaccgtgtacgccaccgccgccgaccccaagaaggggtccctcggcaccatcgctccaatcgccatcggcttcatcgtcggcgccaacatcctcgtcgccggccccttctccggcgggtccatgaaccctgcacgctccttcggccccgccgttgccagcggcgacttcaccaacatctggatctactgggccggcccgctcatcggcggtggcctcgccggcgtcgtctaccggtacctgtacatgtgcgacgaccacaccgccgtcgccggcaacgactactaagcagccatggaagacattcggtcttggttcc

SEQ ID NO: 1123 - protein, 248 aa, Triticum aestivum
MPASIAFGRFDDSFSLASFKAYIAEFISTLIFVFAGVGSAIAYSKVSGGAPLDPSGLIAVAICHGFGLFVAVAVGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGVVYRYLYMCDDHTAVAGNDY

SEQ ID NO: 1124 - DNA, 1248 bp, Spinacia oleracea
  CDS (46)..(903)
caacccaaaaacaaaagaaacattcccacaacagtagaaacaaaaatggagggcaaagatgaagatgttagactcggagctaacaagtacggggagaagcaagggttgggtacggtggcgcaagacagagactacaaggagccaccaccagcgccgctgtttgagcccggagagctgacgtcatggtcattttacagggccggaattgcggagtttattgcaacattcttgttcctttacatcagtattttgacggttatggggtacagccgtgctgataacaagtgtaaaactgttggtattcagggtattgcctgggcttttggtggaatgatctttgcccttgtttactgtactgctggaatttctggaggtcacattaacccagcagtaacattcggattgttcttggcaaggaaattgtcgttgacaagagcagtgttctacatgattatgcaatgtttaggtgccatttgtggtgctggtgtggttaagggattccaacccgggccctaccaggtcggtggtggaggatctaactatgttcaccatggttacaccaagggatcaggccttggtgctgagattgttggtaccttcgtccttgtctacaccgtcttctctgccactgacgccaagagaagcgctagggactctcatgttcctatcttggcacccctcccaatcgggttcgctgtgttcttggttcacttggccaccatccccattaccggcaccggtatcaaccctgctaggagtcttggtaccgctatcatctacaacaaacaaattaacaactggaacgaccactggatcttctgggtgggaccattcattggagcagcattggcagctgtttaccacacagtggtgattagggcaatccctttcaaatccaagtaatgggtttaaataagctcatgggtttcattcatgggtggatgttgttgtatgattggatcgtctcatcagcccgacgacccgtatttgtgttctaaggctgtttgatggtgactagaagaatcccatgtgtgttattttctttgtttgtcatttgtattaagtaagttattttgtaattttttaaaattttcctcgaagaatcctgagagggttgtggcttgtattggactgggttgtgaaaatgtaaattctaattatcaactatgtaattgtaatggtcccgttccgggtatattaagtactagccttttttttcttgtatctcaaaaaaaaaaaaaaaaaaaa

SEQ ID NO: 1125 - protein, 285 aa, Spinacia oleracea
MEGKDEDVRLGANKYGEKQGLGTVAQDRDYKEPPPAPLFEPGELTSWSFYRAGIAEFIATFLFLYISILTVMGYSRADNKCKTVGIQGIAWAFGGMIFALVYCTAGISGGHINPAVTFGLFLARKLSLTRAVFYMIMQCLGAICGAGVVKGFQPGPYQVGGGGSNYVHHGYTKGSGLGAEIVGTFVLVYTVFSATDAKRSARDSHVPILAPLPIGFAVFLVHLATIPITGTGINPARSLGTAIIYNKQINNWNDHWIFWVGPFIGAALAAVYHTVVIRAIPFKSK

SEQ ID NO: 1126 - DNA, 1095 bp, Ricinus communis
  CDS (81)..(947)
aaacggtcattaatccttccctttagttcttgcatttttcagctcaagaaaaaaggaaagaagagtaactagcttgcgctatggagggcaaagaagaagatgttagattgggagctaacaagtacagggaaacgcagccgattggaacggctgctcaaagccaagatgataaggattatacagagccaccaccggcgcctctgtttgagcctggcgagttgacttcatggtcgttttatagagctggaattgcagagttcatagcgactttcttgttcttgtatatctctgttttgactgttatgggtgttgttaaagcacccactaaatgctccactgttggtattcaagggattgcttgggcctttggtggcatgatctttgctcttgtttactgtactgctggaatttcaggaggacacataaacccagccgtgaccttcgggctgtttctggcgaggaagttgtcgttgacaagggctttgttctacatggtgatgcagtgccttggagccatatgcggtgctggtgtagtaaaaggatttgaaggtagtcatgactacactaggttgggcggtggtgctaacagtgtcaaccctggttacaccaaaggtgatggtcttggtgctgaaattgttggtacctttgttcttgtttacaccgtcttctctgccactgatgccaaacgtagtgccagagactcccatgttcctattttggcaccattgccaattgggttcgcagttttcttggtgcacttggctactatcccaattacaggaaccgggatcaacccagcccgtagtcttggtgcagcaatcatcttcaacaaggaccaaggctgggatgatcattggattttctgggtgggtccattcattggggcagcacttgcagctctctaccaccaagttgtgatcagagccattcctttcaagaaatgctgaagatgatgatgcatccatgtgtgaccgtttgatgtttcaaaatcaagtttgtttcattctatctgtttgtcttctgtctgcacctgtattatatgagcacatgtaataatagtagttgttattatgcttctagcaaaaaaaaaaaaaa

SEQ ID NO: 1127 - protein, 288 aa, Ricinus communis
MEGKEEDVRLGANKYRETQPIGTAAQSQDDKDYTEPPPAPLFEPGELTSWSFYRAGIAEFIATFLFLYISVLTVMGVVKAPTKCSTVGIQGIAWAFGGMIFALVYCTAGISGGHINPAVTFGLFLARKLSLTRALFYMVMQCLGAICGAGVVKGFEGSHDYTRLGGGANSVNPGYTKGDGLGAEIVGTFVLVYTVFSATDAKRSARDSHVPILAPLPIGFAVFLVHLATIPITGTGINPARSLGAAIIFNKDQGWDDHWIFWVGPFIGAALAALYHQVVIRAIPFKKC

SEQ ID NO: 1128 - DNA, 1074 bp, Raphanus sativus
  CDS (27)..(887)
aaaaaaaatactcttaagagagagaaatggaaggcaaggaagaagatgttagagtcggagctaacaagtttccggagagacaacccatcggaacatcggctcagagcgacaaggactacaaggagccacctcctgctcccttgttcgagccaggcgagcttgcttcctggtccttctggagagccggtatcgccgagttcatcgccacgtttctgttcctttacatcaccgtgttgaccgtcatgggcgtgaagagagcaccgaacatgtgtgcttctgtcggaatccaagggatcgcttgggctttcggtggtatgatcttcgctctcgtctactgcaccgctggtatctccggtggacacatcaacccagctgtcacgtttggtctattcttggccaggaagctttcgcttacgcgagctgtgtactacatagtgatgcagtgcttgggagccatttgtggagctggtgtggtgaagggtttccagcctaagcaataccaagctctaggaggtggagccaacactgtagctcctggttacaccaaagggagtggtcttggagctgagattattggaacctttgtcctcgtttacaccgttttctccgccactgacgccaaaagaaacgctcgtgactctcatgttcccattcttgctcctctcccaattggattcgctgtgttcttggtccacttagcaaccatccccatcactggaactggaatcaacccagctagaagtcttggagctgccatcatcttcaacaaggataacgcttgggacgaccattgggtcttttgggttggaccattcatcggtgctgctcttgctgctctgtaccacgtgatagtcatcagagccatcccatttaagtccagaagctgatccagtcactcttaaaaatctagctttgtgctattaatagtttgctttctttttgtgaattgtgtgaagcatcgtgtgtgtatttgcttgttcctcttctttgcctaatgcaagactatttgtaaaacaaagacattcccccttgcaaaatttgtaatctctcttctataactggaacattctgagc

SEQ ID NO: 1129 - protein, 286 aa, Raphanus sativus
MEGKEEDVRVGANKFPERQPIGTSAQSDKDYKEPPPAPLFEPGELASWSFWRAGIAEFIATFLFLYITVLTVMGVKRAPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1130 - DNA, 1086 bp, Zea mays
  CDS (1)..(867)
atggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcctgggctgaccactggatcttctgggtcggccccttcatcggcgctgcgctggctgccatctaccaccaggtgatcatcagggcgatcccgttcaagagtaggtcttaaaggagccgatgctgctgcttcgagatgccggtcttaaaaggatggattcgtggctgttttcaaatgatcccctactatgttacgtgcagttccattcctctttcaaagttcggagctgcttttatccgaacccagacttgtaattcatctgtaccaaatgtgtaatatgccgcgcctctgttatgtgcaattgaaaattatgaaagtcgacgcggccgc

SEQ ID NO: 1131 - protein, 288 aa, Zea mays
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRS

SEQ ID NO: 1132 - DNA, 876 bp, Blumeria graminis
  CDS (1)..(876)
atgcctactgatggaattccacccatgttgggacaatcttctccactaaagcttcgtaaatacgaaggccgacttagtgatgacaacttccgaaaccatgtcatagcagccatcggcgagttcctcgggaccactttgttcctcttttatggattcctagcagcacagattatcaacagcaaacctgacaatctttctgacgctcctagtctactccagttaatattcgttgcttcagcctttggtgtcagtggagcagtcaacgtctggctattctaccgagtcagtggaggccatttaaaccctgcaatcactatcggtcttactctaataggagctgtaccagtcactcgagctttacttctcgtatccgttcagctacttggtggtatattagctgcatctctagtattagccgttaccccagggtctctaaatgttcagaccgctttgggcaatgcgacatccgtgaagcaaggtttctttttggagatgattctcactgccacccttgtgttgacagtgtttatgctcgctgtagagaaacaccgtaccactcctctagcacctttaggaatcggtctcattcttttcctcgatgtcctcttagctgcacagttctctggcggctcattaaacccagcacgatcctttggtccagctgtcgtcgaattgaactttgcgacataccattggatttactggttcggaccaatcgcaggtgcagtcttagcagccgctatcttcaaagttctaaagtttcttgcatacgagactgcagttgctggacaggaccatgatggactagacgtctaccggcttatcgatgatgccggtggtcatgaagtcgatcgggaaattcaacttgaagtttaa

SEQ ID NO: 1133 - protein, 291 aa, Blumeria graminis
MPTDGIPPMLGQSSPLKLRKYEGRLSDDNFRNHVIAAIGEFLGTTLFLFYGFLAAQIINSKPDNLSDAPSLLQLIFVASAFGVSGAVNVWLFYRVSGGHLNPAITIGLTLIGAVPVTRALLLVSVQLLGGILAASLVLAVTPGSLNVQTALGNATSVKQGFFLEMILTATLVLTVFMLAVEKHRTTPLAPLGIGLILFLDVLLAAQFSGGSLNPARSFGPAVVELNFATYHWIYWFGPIAGAVLAAAIFKVLKFLAYETAVAGQDHDGLDVYRLIDDAGGHEVDREIQLEV

SEQ ID NO: 1134 - DNA, 1248 bp, Triticum aestivum
  CDS (63)..(941)
aattcggcacgagatctcccccacctctctcccaaagccaagagctcagagaagcaccggccatggagggcaaggaggaggacgtgcgcctgggcgcgaaccgctactcggagcaccagcccatcggcacggcggcgcagggcggcggcgcggacaaaaaggactacaaggagccgcccccggcccccttcttcgaggccggggagctcacctcctggtccttctaccgggccggcatcgccgagttcctggccactttcctcttcctctacatctcggtgctcaccgtgatgggcgtggtgggcaacccgtcggggtccaagtgcggcacggtcggcatccagggcatcgcctggagcttcggcggcatgatcttcgtgctcgtctactgcaccgccggcatctccggcggccacatcaaccccgcggtcaccttcgggctgtttttggcaaggaagctgtcgctcaccagggccgtcttctacatcgtgatgcagtgcctgggggccatatgcggcgccggcgtggtcaaggggttccagaccacgctgtaccagggcaacggcggcggcgccaactccgtcgcgcccgggtacaccaagggggacgggctaggggctgagatcgtcggcacgttcgtgctggtctacaccgtcttttctgccaccgacgccaagcgcagcgccagagactcccacgtccccattttggcgccgcttcccatcgggttcgcggtgttcctggtgcacctggcgacgatccccatcacggggaccggcatcaacccggcgaggtccctcggcgccgccatcatctacaacaagaagcaggcgtgggacgaccactggatcttctgggttggtccgttcatcggtgcggcgctggcggccatctaccacgtggtggtgatcagggccatccccttcaagagccgcgactagtcagccaatcagtctgccgaccatggacgggtggaatcttatcgctgttcatcgtcgatcgatcatgtggtggtggttgcccgtgcgtacgtggctcatttcgcacgctgtaattctctatctaccgtcctctgtccctctcctcggtgtgtgtgcctgccgacagcgtcactgtggcgcacctgttcaagtctgcgagttgtgtactttccctcccttctgtattgtaccgctgcgcacgcgatttaacggagcgtgcatatgtatgtaaattattaattaagaaggaacgtcgatcgagttaatt

SEQ ID NO: 1135 - protein, 292 aa, Triticum aestivum
MEGKEEDVRLGANRYSEHQPIGTAAQGGGADKKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 1136 - DNA, 876 bp, Erysiphe graminis subsp
  CDS (1)..(876)
atgcctactgatggaattccacccatgttgggacaatcttctccactaaagcttcgtaaatacgaaggccgacttagtgatgacaacttccgaaaccatgtcatagcagccatcggcgagttcctcgggaccactttgttcctcttttatggattcctagcagcacagattatcaacagcaaacctgacaatctttctgacgctcctagtctactccagttaatattcgttgcttcagcctttggtgtcagtggagcagtcaacgtctggctattctaccgagtcagtggaggccatttaaaccctgcaatcactatcggtcttactctaataggagctgtaccagtcactcgagctttacttctcgtatccgttcagctacttggtggtatattagctgcatctctagtattagccgttaccccagggtctctaaatgttcagaccgctttgggcaatgcgacatccgtgaagcaaggtttctttttgaagatgattctcactgccacccttgtgttgacagtgtttatgctcgctgtagagaaacaccgtaccactcctctagcacctttaggaatcggtctcattcttttcctcgatgtcctcttagctgcacagttctctggcggctcattaaacccagcacgatcctttggtccagctgtcgtcgaattgaactttgcgacataccattggatttactggttcggaccaatcgcaggtgcagtcttagcagccgctatcttcaaagttctaaagtttcttgcatacgagactgcagttgctggacaggaccatgatggactagacgtctaccggcttatcgatgatgccggtggtcatgaagtcgatcgggaaattcaacttgaagtttaa

SEQ ID NO: 1137 - protein, 291 aa, Erysiphe graminis subsp
MPTDGIPPMLGQSSPLKLRKYEGRLSDDNFRNHVIAAIGEFLGTTLFLFYGFLAAQIINSKPDNLSDAPSLLQLIFVASAFGVSGAVNVWLFYRVSGGHLNPAITIGLTLIGAVPVTRALLLVSVQLLGGILAASLVLAVTPGSLNVQTALGNATSVKQGFFLKMILTATLVLTVFMLAVEKHRTTPLAPLGIGLILFLDVLLAAQFSGGSLNPARSFGPAVVELNFATYHWIYWFGPIAGAVLAAAIFKVLKFLAYETAVAGQDHDGLDVYRLIDDAGGHEVDREIQLEV

SEQ ID NO: 1138 - DNA, 1279 bp, Petunia hybrida
  CDS (46)..(906)
aaaacaccatttgccatatccacaaatagtgctagagttgaaaaaatggcaaagaatgtgggtagtgaaggatcttttacaacaaaggattaccaagatcctccaccagcaccactcatagacccagcggagctaacccaatggtccttctacagggctctcattgctgagttcatagccacacttcttttcctttacatcacggtgctaacagtgattggttacaaaagtgaaagtgaccctgccaagaatgctgatccttgtagtggagttggaattcttggtattgcttgggcctttggtggcatgatctttatccttgtctactgcactgctggtatttctggtggtcatataaatccagcagtgacatttggactattcttggcaaggaaggtatccctaataagggcagtgatgtatatggtggctcaatgtttgggagccatttgtggtgttggcttggttaaagctttccaatcagcttactaccaccgctacgacggcggagccaacatgctctccgatggctacagtaaaagcgtggggttatcagcggagatcatcggaacatttgttttagtttacactgttttctcggccaccgatcccaagaggaatgctagagactctcatgtccctgtgttggcaccacttccaattggatttgcagtgttcatggttcacttagccaccattccgattaccggcaccggcatcaacccagcaaggagtcttggagctgccgttatcttcaaccaagacaaagcttggaaagaccattggatcttttgggtaggacctttcattggggcagccatagcagcattctaccatcaattcatattgagagcaggtgcagctaaagctcttggttcattcaggagcagtacttctcaagcttgatgattatgtatgattgaatttgaaaaagagaaggaaagagctttagtttccaataattattgttgttgtactatttatgttagtatgtcgtgttagtggtacttttagctctcattgtcccaagttagttatgatggtcttgaagaacaatgcgaaatggtggggtagtgcttgagactttgagagccatgcatggatgtgtagataaaaaagtgatttgtctttgggagggggaaagcttttccgtattccctttgttgttggcaaatgacttttatggatctacactttgtatttatgagcatcttcctttgtattgtctaaaaaaaaaaaaaaaaaaaaaaaaaaaaaaaaaaaaaaaaaaaaaaaaaaa

SEQ ID NO: 1139 - protein, 286 aa, Petunia hybrida
MAKNVGSEGSFTTKDYQDPPPAPLIDPAELTQWSFYRALIAEFIATLLFLYITVLTVIGYKSESDPAKNADPCSGVGILGIAWAFGGMIFILVYCTAGISGGHINPAVTFGLFLARKVSLIRAVMYMVAQCLGAICGVGLVKAFQSAYYHRYDGGANMLSDGYSKSVGLSAEIIGTFVLVYTVFSATDPKRNARDSHVPVLAPLPIGFAVFMVHLATIPITGTGINPARSLGAAVIFNQDKAWKDHWIFWVGPFIGAAIAAFYHQFILRAGAAKALGSFRSSTSQA

SEQ ID NO: 1140 - DNA, 1123 bp, Petunia hybrida
  CDS (49)..(909)
gttctcaagaaaatattgcaattgtgactttattgtaaagttaaaaaaatggaacatagagaagaagatgtaaacttaggagctaacaaatattcagagagacaagcaattggcactgctgcacagagtcaagacaaggattacatagaaccaccaccagcaccattgtttgagtcaggggagttgatgtcatggtccttttaccgtgctggaatagcagagtttatggccactttcctttttctttatataactgttttaactgtcatgggagtgtccaagtctgattctaaatgttcaactgttggaattcaaggcattgcttgggcttttggtggcatgatctttgccttagtttattgtactgcaggcatttcaggaggacacattaatccagcagtgacatttgggctattcttggcaaggaaactgtcattgacaagggcattattctacatggtaatgcaatgcctaggagccatctgtggtgctggtgttgtcaaaggatttggcaagactctttaccaaactaaaggtggtggtgctaatgttgtagctcctggttacaccaagggtgatggtctaggtgctgaaattgttggtacctttgttcttgtttacactgttttctctgccactgatgctaaacgtagcgccagagattctcatgtccctcttttggcacctttacctattggatttgctgtgttcttggtgcacttggctactattcccatcactggaactggtattaaccctgctaggagtcttggtgcagccatcatctacaaccaggaacacgcatggaatgaccactggatattctgggttggaccattcattggggcagctctagcagctctataccaccaagttgtgatcagagcaattccattcaagtccaagtgaagtaatttctttgtgtcattttgaccacatatctcctcaagcttatcgtttcgtggcaattgtaatcacggagagatgagaagtcctcactctgcccattttcttttgtttcctttttgtcttttgtttatatctatgtgtatttgtaagttacttaagtaagggaatgtatgtgattgctatatgtgttctttaaaaaaaaaaaaaaaaaaaa

SEQ ID NO: 1141 - protein, 286 aa, Petunia hybrida
MEHREEDVNLGANKYSERQAIGTAAQSQDKDYIEPPPAPLFESGELMSWSFYRAGIAEFMATFLFLYITVLTVMGVSKSDSKCSTVGIQGIAWAFGGMIFALVYCTAGISGGHINPAVTFGLFLARKLSLTRALFYMVMQCLGAICGAGVVKGFGKTLYQTKGGGANVVAPGYTKGDGLGAEIVGTFVLVYTVFSATDAKRSARDSHVPLLAPLPIGFAVFLVHLATIPITGTGINPARSLGAAIIYNQEHAWNDHWIFWVGPFIGAALAALYHQVVIRAIPFKSK

SEQ ID NO: 1142 - DNA, 1083 bp, Nicotiana tabacum
  CDS (70)..(930)
gacctaacttagaaacagaaaaaaagaaagaagaaaaaaccttctagtgtgtgtctgtgtgtgaaaaaaatggcagaaaacaaagaagaagatgtgaatcttggagcaaacaaatacagagaaacacaacccttaggaacagcagcacaaacagaaaataaggattatattgaaccaccaccagcaccattatttgaacctggtgaattatcatcttggtcattttacagagctgggattgcagaatttatggccactttcttgttcttgtacattacaatcttgactgtaatgggacttaaaaggtcagatagtttgtgttcttctgttggtattcaaggtgttgcttgggcttttggtggtatgatctttgctcttgtttactgtactgctggtatctcaggaggccacattaatccagctgtgacctttggtctattcttagcaaggaaactttccttaaccagggcagtattctacatggtaatgcaatgccttggtgctatttgtggtgctggtgttgttaaaggtttcatgaaaggtccataccaaagacttggtggtggtgccaatgtggttaaccctggctatactaaaggtgatggacttggtgctgaaattattggtacttttgttcttgtttacactgttttctctgctactgatgccaagagaaatgccagagattcacatgttcctattttggcacctcttcctattggatttgctgtgttcttggttcatttggccaccatcccaattactggaactggcatcaaccctgctaggagtcttggagctgctattatcttcaacaaaaaacaggcatgggatgaccattggatcttctgggttggaccattcattggagctgctcttgctgcagtttaccaccagattattatcagagccattccattcaagagctaagattctcctgccatttgcctttttcaagactctgtattccattttcttctcttgctggtgtctgtcaaatgtgtaatttcttctattaagatgtcaattatgtgaataaattattcaagttgtagcaaaaaaaaaaaaaaaaaaaaaaaaaaa

SEQ ID NO: 1143 - protein, 286 aa, Nicotiana tabacum
MAENKEEDVNLGANKYRETQPLGTAAQTENKDYIEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMKGPYQRLGGGANVVNPGYTKGDGLGAEIIGTFVLVYTVFSATDAKRNARDSHVPILAPLPIGFAVFLVHLATIPITGTGINPARSLGAAIIFNKKQAWDDHWIFWVGPFIGAALAAVYHQIIIRAIPFKS

SEQ ID NO: 1144 - DNA, 1108 bp, Nicotiana glauca
  CDS (35)..(889)
agaaaatactccaaatttagcatatagtgagaaaatggcgaagaacgtgggtagtgaagggtcgttcacgacgaaagactaccaagatccgccgccagcaccactgattgacccagtagagctaacccaatggtctttttacagagcactcattgctgaattcatagccactcttctcttcctttacataacggtgctgaccgtcattggttacaagagccaaagtgcaacgacaactgatccttgtgctggtgttgggatccttggtattgcttgggcatttggtggcatgattttcgttcttgtttactgtaccgctggtatttctggtggtcatataaatccagcagttacatttggactattcttggcgaggaaagtatcgctaataagggcagttatgtatatggtggctcagtgtttgggagccatttgtggggttggattagttaaggctttacaatcagcttactaccaccgctatgacggcggagtcaatatgctctccgacggatacagtcacggcgttgggttgtcggcggagatcatcggaacttttgttcttgtttacactgttttctctgccactgatcccaagaggaatgctagagattctcatatccctgtgttggcaccactccccattggatttgcagttttcatggttcatttagccaccattccgatcaccggcaccggaatcaacccggctaggagtcttggcgctgccgttatcttcaaccaacacaaagcctggaaagaccactggatattttgggtaggacctttcattggagcagccattgcagcattctaccatcaattcatattgagagcaggtgcagctaaagcccttggttcattcaggagcagtacttctcaagtttgatgactaaatttgagagaaaaagaggaaagggttgttgtactctatatatttatgtcaatcttttgttttagtggtcttaatttctagctctccttgtcccaaattacgatggttttgaagatcatgcgcaatagtggtgttgtacttgagagccaaagatgtgtagattacaaatgtattgtctttggaaaggaaaatcttttttttttttggtaaaaa

SEQ ID NO: 1145 - protein, 284 aa, Nicotiana glauca
MAKNVGSEGSFTTKDYQDPPPAPLIDPVELTQWSFYRALIAEFIATLLFLYITVLTVIGYKSQSATTTDPCAGVGILGIAWAFGGMIFVLVYCTAGISGGHINPAVTFGLFLARKVSLIRAVMYMVAQCLGAICGVGLVKALQSAYYHRYDGGVNMLSDGYSHGVGLSAEIIGTFVLVYTVFSATDPKRNARDSHIPVLAPLPIGFAVFMVHLATIPITGTGINPARSLGAAVIFNQHKAWKDHWIFWVGPFIGAAIAAFYHQFILRAGAAKALGSFRSSTSQV

SEQ ID NO: 1146 - DNA, 1132 bp, Solanum chacoense
  CDS (62)..(913)
ctcggcacgagataaactcaaaaaacgctctgtttctttcactgccaaacttctaaaaaaaatgtcgaaggacgtaattgaagaaggacaagctcatcatcatggaaaggactatgttgacccccctccagctcctcttcttgacatggctgagcttaccaaatggtctttttacagagctgttatagctgaattcatcgccacccttctcttcctttatgtcaccgttgctactgttatcggccacaagaaactcaacgctctcgaccaatgtgatggtgttgggattcttggaattgcgtgggcttttggtggcatgatcttcgttcttgtttactgtactgctggaatttctggtggtcatattaacccagcggtgacatttgggttgttcttggcaaggaaagtgtcattgataagagcagttgcttacataattgcacagtcacttggtgctatttgtggtgttggtttcgttaagttgttcatgaagcattactacaacgcagaaggtggaggtgctaactttgtgcaacctggttacagcaaaggaactgctttgggtgctgaaattattggaacttttgtgcttgtttacaccgtcttctctgctactgacccaaaaagaagcgctcgcgattcccacgtccctgttttggctcctcttccaattggatttgctgttttcatggttcatttggctaccatccccattactggaactggtattaacccagctaggagctttggagctgcagtcatttacggccacgaaaaaatctgggatgaccaatggattttctgggttggaccaatggtgggagcaatggcagcagcaatataccatcagtttgtattgagagctggagctgtaaaagctttgggatcattccgcagcaaccaaaccaactaagcaagtgttatcaaccacccctcataaccaggcagagaagaagagaaatttcattcacaagttcaaatttttcttgtttaattgtttgattttgtgtatgaagattaattaattaattaatgtatgaaccttttattttattttattttattttgttcgtttggtacagtttcatctttaatgttagtttttggagtgtgtaaaaaaaaaaaaaaaaaa

SEQ ID NO: 1147 - protein, 283 aa, Solanum chacoense
MSKDVIEEGQAHHHGKDYVDPPPAPLLDMAELTKWSFYRAVIAEFIATLLFLYVTVATVIGHKKLNALDQCDGVGILGIAWAFGGMIFVLVYCTAGISGGHINPAVTFGLFLARKVSLIRAVAYIIAQSLGAICGVGFVKLFMKHYYNAEGGGANFVQPGYSKGTALGAEIIGTFVLVYTVFSATDPKRSARDSHVPVLAPLPIGFAVFMVHLATIPITGTGINPARSFGAAVIYGHEKIWDDQWIFWVGPMVGAMAAAIYHQFVLRAGAVKALGSFRSNQTN

SEQ ID NO: 1148 - DNA, 1135 bp, Allium cepa
  CDS (38)..(904)
gaccaccaccactcacaaaaaaaaaaaaggaaaaaacatggagggaaaagaagaagatgtcagagtaggagcgaacaagtactcggaaaggcaaccgatcggaacatcagcgcagatgacggaagacaaggactacaaagagccacctcccgcccctttcttcgagcccggagagctcaagtcgtggtccttttacagagctggaatcgctgaattcatggccaccttcctcttcctctacatcaccatccttaccgtcatgggcgtcgttaagtctccgtccaagtgctccaccgttgggattcagggtatcgcttgggctttcggtggcatgattttcgcccttgtttactgcactgctgggatttctggagggcacataaacccagcagtgaccttcggtctgttcttagcaaggaagctatcccttacaagggcagtcttctacatgatcatgcaatgcttaggtgcaatttgcggagctggagtcctaaaaggctaccaaaagggcctctacatgacccaaggtggaggtgctaacgttgttgcacctggctacaccaaaggctctggtttgggtgccgaaatcataggcactttcgttcttgtttacaccgtcttctccgctactgatgccaagagaaacgcaagggactcccatgttcccattcttgcaccactgcctattggatttgcagtgtttcttgtccatttagcgaccattccaatcaccggcacaggcattaacccagctaggagtcttggtgctgccatcatctacaacaaaggtcatgcttggaatgaccattggatattctgggttggaccattcattggagctgcacttgctgccatgtatcaccaaattgtgataagagcaattccattcaaaagcaggtcctagagttcattgttgtatgatgcatttactttctttcttgtactgtttgtcaatattgagtgcagcttcctatcattcaagtgtgctgtttgtataaatgccacatgtcaatgttgtgttttttttagttgatgaacgattttcttggtaattccgcttccatgtactttgtaattaagagtattgctggattgttcttgcatttgaacttaatgtagattttgtggtatgttg

SEQ ID NO: 1149 - protein, 288 aa, Allium cepa
MEGKEEDVRVGANKYSERQPIGTSAQMTEDKDYKEPPPAPFFEPGELKSWSFYRAGIAEFMATFLFLYITILTVMGVVKSPSKCSTVGIQGIAWAFGGMIFALVYCTAGISGGHINPAVTFGLFLARKLSLTRAVFYMIMQCLGAICGAGVLKGYQKGLYMTQGGGANVVAPGYTKGSGLGAEIIGTFVLVYTVFSATDAKRNARDSHVPILAPLPIGFAVFLVHLATIPITGTGINPARSLGAAIIYNKGHAWNDHWIFWVGPFIGAALAAMYHQIVIRAIPFKSRS

SEQ ID NO: 1150 - DNA, 1237 bp, Allium cepa
  CDS (41)..(916)
gctactttacgcaactcacccaaatattaatcaacaaataatggcaaacaaggaagtagatgtacctgaaacaaaagatactcagttcactgcaaaagactacacagacccgcccccagcgccgcttttcgacatgggtgagctcaccaagtggtcactgtaccgtgcagtcatagcagagttcgtcgccactctattgttcctctacatcacagtagccacggttatcgggtatagtcaccagagcgatgcaaccatacccggaaataccgatgctcactgcagcggtgttggcgtgcttggaattgcctgggctttcggtggcatgatcttcgttctcgtttactgcactgctggaatttccggtggacacataaacccagctgtgacgttcgggcttttcctagcaagaaaagtatctttaataagagcgcttctgtacatgatagcacagtgtttaggtgcaatatgcggtgttgggtttgtcaaagcgttccagtctgcctactattctagatacggaggtggtgccaacactctgaacgctgggtacagtaaaggaaccgggcttgcagccgaaattataggcacttttgtgttggtctacactgtgtttgctgctaccgaccctaaacgtagtgctagagattctcatgtgccggtactggctccacttccaattgggtttgctgtgttcatggttcatttggcaaccattccaattactggtactgggattaatcctgctagaagttttggagctgctgttatttacaacaaggataaagcttgggacgatcagtggatattctgggttggtccattcattggtgcagcaattgcagcagcttaccatcagtatgtgctaagagcaggagctgtgaaggctcttgggtcttttgggagcaatgcttgattgatactagtcaaactgcatgcagtgaagtccctgtaataattatcagaaacagtttgaattggttcatgttgtgattgtgttgaaaagagacagagaaatctaatatttgatttctttgttgttttttctctcatttgtagattttgtctttgtcttccaatgtagaatgtgaatctgtgatggagtgtttttttcttccactatttgccatgtcttaagaaaaaaaatggctttttatgtcttaattggaactgtgccaactatgtaatgtaaaagtactttttctcataaaaaaaaaaaaaaaaaaaaaaaaaaaaa

SEQ ID NO: 1151 - protein, 291 aa, Allium cepa
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSRYGGGANTLNAGYSKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFGSNA

SEQ ID NO: 1152 - DNA, 1053 bp, Raphanus sativus
  CDS (22)..(882)
agaaaagagacgtctggagagatggaaggcaaggaagaagatgttagagtcggagccaacaagtttccggagagacaaccgatcggaacatcggctcagagcgacaaggactacaaggagccacctcctgcgcccttgttcgagcccggcgagcttgcttcgtggtccttctggagagccgggatcgctgagttcatcgccacgttcttgttcctttacatcactgttttaaccgtcatgggagtcaagaggtcaccgaacatgtgtgcttctgtcggaatccaagggatcgcttgggctttcggtggtatgatcttcgctctcgtctactgcaccgctggtatctccggtggacacatcaacccagctgtcacgttcggtctgttcttggccaggaagctttcgctcacacgagctgtgtactacatagtgatgcagtgcttaggagccatctgtggagctggtgtggtcaagggattccaaccaaagcagtaccaagctctaggaggtggagccaacactgtagctcctggttacactaaaggaagtggtctcggagctgagattattggaacttttgtccttgtttacaccgtcttctccgccactgacgccaagaggaacgctcgtgactctcatgttcccattcttgcacctctccctatcggattcgctgtgttcttggtccacttagcaaccatccccatcactggtactggcatcaacccagcaaggagtcttggagctgcaatcatcttcaacaaggacaacgcttgggacgaccattgggtgttttgggttggaccattcatcggtgctgcacttgctgctctttaccacgtgattgtcatcagagccatcccattcaagtccagaagctgattgagttactcttagtttgcttttcttttgtgaatgtactactactacttgtgtgaaacatcgtctgtatgtgtttgttcctctgctttgcctaatgcagactctatttgtaatacagagtcagagacattcccctgaaaaaatattgtgatcttatcttctacaaatccc

SEQ ID NO: 1153 - protein, 286 aa, Raphanus sativus
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1154 - DNA, 702 bp, Plesiomonas shigelloides
  CDS (1)..(702): transl_table=11
atgtttaaaccttttagcgccgaatttttcggtactttctggctggttctgggtggctgtggtagcgccttgatctctgctgctttccctcagttaggtattggctttttgggcgtggcgttggcttttggtctgacagtagtcaccatggcttatgcggtcgggcatatctccggagcgcattttaaccccgcggtgaccttgggtctgtgggccggtggacgcttccctgcggcgcgcgtgttaccttacatcatcgctcaggttatcggcggtattgccgctgcggcagtgctgtatggtatcgccagcggtaaggcggggtttgatgcgacaaccagcggctttgcagctaatggctatggcattcactcaccaggcggttatgcgttaagcgcctgtatgctgagcgagtttgtcctcagtgcgttttttgtcatcgtgatccacggggcgacagaaaaacgcgctcctgcgggctttgcgccgttggcgattggtctgacgctgaccatcattcatttggtgagcatccctgtcaccaatacctcggttaaccctgcgcgtagtatcgcggcggcagttttccaaggtacttgggcgttagatcagttgtggatgttttgcttgatcccatcattaggcggaattgccggtggtctgatttaccgcgcattgctggcgcgtccggctgaagcataa

SEQ ID NO: 1155 - protein, 233 aa, Plesiomonas shigelloides
MFKPFSAEFFGTFWLVLGGCGSALISAAFPQLGIGFLGVALAFGLTVVTMAYAVGHISGAHFNPAVTLGLWAGGRFPAARVLPYIIAQVIGGIAAAAVLYGIASGKAGFDATTSGFAANGYGIHSPGGYALSACMLSEFVLSAFFVIVIHGATEKRAPAGFAPLAIGLTLTIIHLVSIPVTNTSVNPARSIAAAVFQGTWALDQLWMFCLIPSLGGIAGGLIYRALLARPAEA

SEQ ID NO: 1156 - DNA, 1026 bp, Brassica napus
  CDS (26)..(877)
gttttcctaaatagaaatatattaaatggctaaagatgtggaaggagcagagggagtcacggcgagggactacgaagacccaccgcctactccgtttttcgatgcggaggagctcacgaagtggtctttatacagagcagtcatcgccgagttcgtagccactctcctcttcttatatgtcaccgttttgactgtcatcggctacaagatttcctccgacactaaggcaggaggcgacgactgcggaggcgtcggaatcctcggtatctcgtgggctttcggcggcatgatcttcatccttgtctactgcaccgccggtatctcaggtggtcacataaacccggcggtgacgttcggcttattcttggcccggaaggtatcgctggttagagcggttctatatatggtggctcagtgtttaggtgcgatttgcggagttgggtttgtcaaagccttccaaagcgcttactacgtgcgttacggcggaggagccaactctctagccgacggatacagcacagggactggactcgccgcagagatcatcggaacttttgtcctggtctacactgtcttctcagccacagaccccaaaagaaacgcacgagactcccacgttcccgtgttggcgccacttccgatagggtttgcggtcttcatggttcacttggccactattccgatcaccggaacaggaattaacccggcaaggagtttcggagctgcggttatctacaacgagtccaagccgtgggatgaccactggatattctgggttggaccattcattggagctgcgattgctgcattttaccaccaattcgtcctaagagcttccggttccaaatccctcgggtccttcagaagtgcggcctaagaaaaacaattacaaaatggttgttatggtgtgtgtacaaatttggcaagtttcaatttcttattgtctttttctaatttctggcatcagtgtggggatatatgtgaatgaatgtttgtgtgatcggggaaaacaatcttaatgaaatc

SEQ ID NO: 1157 - protein, 283 aa, Brassica napus
MAKDVEGAEGVTARDYEDPPPTPFFDAEELTKWSLYRAVIAEFVATLLFLYVTVLTVIGYKISSDTKAGGDDCGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 1158 - DNA, 1093 bp, Brassica napus
  CDS (11)..(874)
gaaactagttatggcgaaggacgtggaagccgtttccggagaagggtttcagacaagagactatcaagatccaccgccagcgcctctgtttgacccggcggagctgaccaagtggtctttctacagagcagtcatcgctgagttcgtagctactctcctcttcctgtacatcaccgttttgacagtcatcggttacaagattcagaccgatagtactgccggcggcgttgactgcggtggagttggtatcctaggtatcgcttgggcttttggtggcatgatcttcatccttgtctactgcaccgccggtatctctggtggtcacattaacccggcagtgacattcgggctactcttggcacgtaaagtgtcgttggttagagccatattgtacatggtagctcagtgtttgggtgcgatatgtggagttgggttcgtcaaagccttccaaagctcttactacgtccgttacggcggtggagccaactctctagccgatggttacagcacaggaaccggactagccgcagagatcattggtactttcgttcttgtctacaccgtcttctccgccactgaccctaaacgtagtgccagagactcccacgtcccagtgttggcgccacttcccattggatttgcggtgttcatggtgcacttggctaccattcccatcactggaactggaatcaacccggcaaggagtttcggagcagccgttatcttcaacgagagcaagccatgggatgaccactggatattttgggtgggaccattcgttggagctgcgatagctgcattctaccaccagttcgttttgagggcttcaggttccaagtctctcggatctttcagaagtgctgccaacgtttaaatactctctcatttccaccaatcagattctgaaataataaagatgataatcttttactctatgtacaaattatccaaatcagtttcagtttgttatcttatttgtgtgtattccacttgctctttagtgtgttttcgttgagtgcaattgttcttattttacgccaatgccaagtttatgaagtgactagaattgaaaatcaaaaaaaaaaaaaaaaaa

SEQ ID NO: 1159 - protein, 287 aa, Brassica napus
MAKDVEAVSGEGFQTRDYQDPPPAPLFDPAELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 1160 - DNA, 687 bp, Rhizobium meliloti
  CDS (1)..(687): transl_table=11
atgttcaggaagctctctgtggaatttctcggtactttctggctcgttctcggcgggtgcggcagcgccgtgcttgccgctgccttcccggaggtcggcatcggcctgcttggggtctcctttgccttcggccttacggtgctgaccatggcctatgcggtcggcgggatttcgggcggtcatttcaatccggcggtatcggtcgggcttgccgttgccggcagaatgccgccggcaagcctcgtcggttacatcctcgcgcaggtcaccggcgcgatcgccgcagctgccgtgctctacgtgatcgccagcggcaaggccgatttccagcttggcggttttgccgccaatggctacggcgaacactcgccgggcggttattcgttgacggcggcgctcgtcaccgaggtcgtcatgaccgcctttttcctgctcatcattcttggctcgacgcatagccgtgtgcctgtgggcttcgcgcccatcgccatcggcctggggctgaccttgattcacctcgtctcgatcccggtcaccaacacctcggtcaatccggcgcgttcgaccggacaggcgctgttcgtcggcgattgggcgatttcccagctctggctcttctgggtcgcgccgctgatcggtgcggtcatcgccggaatcgtatggaagatcgtcggcgacgatagctag

SEQ ID NO: 1161 - protein, 228 aa, Rhizobium meliloti
MFRKLSVEFLGTFWLVLGGCGSAVLAAAFPEVGIGLLGVSFAFGLTVLTMAYAVGGISGGHFNPAVSVGLAVAGRMPPASLVGYILAQVTGAIAAAAVLYVIASGKADFQLGGFAANGYGEHSPGGYSLTAALVTEVVMTAFFLLIILGSTHSRVPVGFAPIAIGLGLTLIHLVSIPVTNTSVNPARSTGQALFVGDWAISQLWLFWVAPLIGAVIAGIVWKIVGDDS

SEQ ID NO: 1162 - DNA, 687 bp, Brucella melitensis
  CDS (1)..(687): transl_table=11
atgttgaacaaattatcggctgaatttttcggaacattctggctggtcttcggagggtgcggcagcgcgattctcgccgccgctttccctgaactgggtatcggcttcctcggtgttgcccttgctttcggtttaaccgtcctcaccatggcctatgctgttggcggcatttccggcggacatttcaaccccgccgtatcgctcggcctcaccgttgccgggcgtcttccggccaaggatctgattccctattgggtcgcgcaggttctgggagccatcgccgctgctgccatcctctatgtcattgcttctggcaaagatggcttctcggctggaggtctcgcctcgaacggttatggtgagctttctcccggcggctacagcatgatggccggcctgctcatcgaaatcatcctgacggccttcttcatcatcatcattctgggctcgacttcgtcgcttgcaccagcgggtttcgccccgattgcgatcggctttggcctcaccctcatccatctggtctccattccggttaccaatacgtgggtaaacccggcgcgctcgaccggcgttgccctcttcgccgatacggcagccctcagccagctctggcttttctgggttgcaccacttgtaggcgcggtaatcggtgcaatcatctggaagggcctgctcggccgagattaa

SEQ ID NO: 1163 - protein, 228 aa, Brucella melitensis
MLNKLSAEFFGTFWLVFGGCGSAILAAAFPELGIGFLGVALAFGLTVLTMAYAVGGISGGHFNPAVSLGLTVAGRLPAKDLIPYWVAQVLGAIAAAAILYVIASGKDGFSAGGLASNGYGELSPGGYSMMAGLLIEIILTAFFIIIILGSTSSLAPAGFAPIAIGFGLTLIHLVSIPVTNTWVNPARSTGVALFADTAALSQLWLFWVAPLVGAVIGAIIWKGLLGRD

SEQ ID NO: 1164 - DNA, 687 bp, Brucella suis
  CDS (1)..(687): transl_table=11
atgttgaacaaattatcggctgaatttttcggaacattctggctggtcttcggagggtgcggcagcgcgattctcgccgccgctttccctgaactgggtatcggcttcctcggtgttgcccttgctttcggtttaaccgtcctcaccatggcctatgctgttggcggcatttccggcggacatttcaaccccgccgtatcgctcagcctcaccgttgccgggcgtcttccggccaaggatctgattccctattgggtcgcgcaggttctgggagccatcgccactgctgccatcctctatgtcattgcttctggcaaagatggcttctcggctggaggtctcgcctcgaacggttatggtgagctttctcccggcggctacagcatgatggccggcctgctcatcgaaatcatcctgacggccttcttcatcatcatcattctgggctcgacttcgtcgcttgcaccagcgggtttcgccccgattgcgatcggctttggcctcaccctcatccatctggtctccattccggttaccaatacgtcggtaaacccggcgcgctcgaccggcgttgccctcttcgccgatacggcagccctcagccagctctggcttttctgggttgcaccacttgtaggcgcggtaatcggtgcaatcatctggaagggcctgctcggccgagattaa

SEQ ID NO: 1165 - protein, 228 aa, Brucella suis
MLNKLSAEFFGTFWLVFGGCGSAILAAAFPELGIGFLGVALAFGLTVLTMAYAVGGISGGHFNPAVSLSLTVAGRLPAKDLIPYWVAQVLGAIATAAILYVIASGKDGFSAGGLASNGYGELSPGGYSMMAGLLIEIILTAFFIIIILGSTSSLAPAGFAPIAIGFGLTLIHLVSIPVTNTSVNPARSTGVALFADTAALSQLWLFWVAPLVGAVIGAIIWKGLLGRD

SEQ ID NO: 1166 - DNA, 690 bp, Chromobacterium violaceum
  CDS (1)..(690): transl_table=11
atgaaatcgtatggcgcggagtttctgggcactttctggctggtgctgggcggctgcggcagcgcggtgctggcggcgggatttcccaatctgggcataggcttcgccggcgtggcgctggcattcggcctgacggtggtgacgatggcttacgcgatcggccacatttccggctgccacctgaacccggcggtatccatcggcctgtgggcgggcgggcgctttcccgccgggcaattggcgccgtacatcgtggcgcaggtgctgggcgccatcgccgcgggcgcggtgctgtacgtgatcgccagcggcggagccggcttcgacgtggccaagggcttcgcttccaacggctatgccgagcattcgccgggcggctattcgctgctggcggccctggtgtgcgaggtggtgatgaccatgtttttcttattggtgatcatgggcgccaccgacaagcgcgcgcctgccggtttcgcgccgttggcgataggcctggcgctgaccctgatccacctgatcagcatcccggtcaccaatacctcggtcaacccggcgcgcagcaccggcgtggccttgttcgtcggcggctgggcggtgcagcagctgtggctgttctggctggcgcccatcatcggcgcggtgctgggcgcgaaggtgtatcgcctgatcgccggcgagtcggagtag

SEQ ID NO: 1167 - protein, 229 aa, Chromobacterium violaceum
MKSYGAEFLGTFWLVLGGCGSAVLAAGFPNLGIGFAGVALAFGLTVVTMAYAIGHISGCHLNPAVSIGLWAGGRFPAGQLAPYIVAQVLGAIAAGAVLYVIASGGAGFDVAKGFASNGYAEHSPGGYSLLAALVCEVVMTMFFLLVIMGATDKRAPAGFAPLAIGLALTLIHLISIPVTNTSVNPARSTGVALFVGGWAVQQLWLFWLAPIIGAVLGAKVYRLIAGESE

SEQ ID NO: 1168 - DNA, 690 bp, Pseudomonas aeruginosa
  CDS (1)..(690): transl_table=11
atgaagcaatacggagcagagttcttcggcaccttctggctggtattgggcggctgcggcagcgcagtactcgctgccggcgtaccggaactgggaatcggctacctcggcgtggccctggcgttcggcctcagcgtgctgaccatggcctatgccatcggcccgatctccggcgcccatctgaaccccgcggtatcggtaggcctgtgggtcggcgggcgcttcccggccagccaactgctgccctatgtcgtcgcccaggtcctcggtggcctcgccgccggcggcgtgctgtacctgatcgccagcggcaaggccggcttcgacctggccgccggcttcgcctccaatggctacggcgaacactcgccgggcggctactcgttgcaagccgcgctggtcagcgaagtggtacttaccggcatgttcctgctgatcatcctcggcgccacctccaagcgcgcgccgcagggcttcgcgccgatcgccatcggcctgaccctgaccctgatccacctgatcagcatcccggtcaccaacacctcggtgaacccggcgcgcagcaccgcggtcgccctgtacgtcggcgactgggcggtttcccagctgtggctgttctgggtcgcgccgattctcggtgcggtactcggcgccctggcctatcgcctgatcggcgacaagaacgactga

SEQ ID NO: 1169 - protein, 229 aa, Pseudomonas aeruginosa
MKQYGAEFFGTFWLVLGGCGSAVLAAGVPELGIGYLGVALAFGLSVLTMAYAIGPISGAHLNPAVSVGLWVGGRFPASQLLPYVVAQVLGGLAAGGVLYLIASGKAGFDLAAGFASNGYGEHSPGGYSLQAALVSEVVLTGMFLLIILGATSKRAPQGFAPIAIGLTLTLIHLISIPVTNTSVNPARSTAVALYVGDWAVSQLWLFWVAPILGAVLGALAYRLIGDKND

SEQ ID NO: 1170 - DNA, 693 bp, Pseudomonas putida
  CDS (1)..(693): transl_table=11
atgtccctgggtaaacgcatgggggccgaactgatcggcaccttctggctggtccttggtggctgtggcagtgcggtactcgcagccagttcccctctcggcatcggtgtgctcggtgtcgccttcgccttcggcctcaccgtactgaccatggccttcgccatcggccatatttctggttgccatctaaaccctgccgtgtcgttcgggctggtggtgggcgggcgcttcccggcaaaagagctgctgccttatgtgatcgcccaggtgatcggtgccatcctggcggccggtgtgatctacctcatcgccagcggcaaggccggtttcgagctgtctgcggggttggcttcaaacggctacgccgaccactcgcccggtggctatacgctgggtgcaggctttgtcagtgaagtggtgatgacggcgatgttcctggtggtcatcatgggggcgaccgacgcccgcgcaccggcaggttttgcacccatcgccatcggcctggccctgaccctgatccacctgatctcgatcccggtgaccaatacctctgtcaaccccgcgcgtagcacggggccggccctgttcgtcggtggctgggccctgcagcagctgtggctgttctgggtggcgccgctgatcggtgctgctatcggcggcgcgctgtatcggggcctggcgaaagaaccttaa

SEQ ID NO: 1171 - protein, 230 aa, Pseudomonas putida
MSLGKRMGAELIGTFWLVLGGCGSAVLAASSPLGIGVLGVAFAFGLTVLTMAFAIGHISGCHLNPAVSFGLVVGGRFPAKELLPYVIAQVIGAILAAGVIYLIASGKAGFELSAGLASNGYADHSPGGYTLGAGFVSEVVMTAMFLVVIMGATDARAPAGFAPIAIGLALTLIHLISIPVTNTSVNPARSTGPALFVGGWALQQLWLFWVAPLIGAAIGGALYRGLAKEP

SEQ ID NO: 1172 - DNA, 696 bp, Vibrio vulnificus
  CDS (1)..(696): transl_table=11
atgaataaatatctggcggaattatttggcaccttttggctggtgcttggtggatgtggcagtgccgtgttggcggccgcctttccggacgttgggattggcctgctaggcgtatccctcgcgttcggtttgacggtgctcaccatggcttttgctatcggccatatttccggctgccacttgaaccctgccgtcaccattggcttatgggccggtggtcgatttgaagccaaagaaattgtgccttatatccttgctcaagtgattggtggcgtcattgccggtggtgtgctttataccatcgcctctggtcaaatgggcttcgatgcgacgagctcgggttttgcctctaacggttatggtgagcattctcccggtggctattcgctgacttctgcgctggtgaccgaagtcgtgatgaccatgatgtttttgctggtgattcttggcgcaacagatcagcgtgcacctcaaggttttgcgcccatcgctatcggtctgtgcctcacacttatccacctcatcagcattccagtgaccaatacatcggtcaaccctgctcgaagtaccggcgttgctctctatgttggcgattgggccaccgcgcaactttggctattctgggttgcgccgattttaggcgcactactaggggcggtggcctacaagttgatttcagggtcgaacaaagactaa

SEQ ID NO: 1173 - protein, 231 aa, Vibrio vulnificus
MNKYLAELFGTFWLVLGGCGSAVLAAAFPDVGIGLLGVSLAFGLTVLTMAFAIGHISGCHLNPAVTIGLWAGGRFEAKEIVPYILAQVIGGVIAGGVLYTIASGQMGFDATSSGFASNGYGEHSPGGYSLTSALVTEVVMTMMFLLVILGATDQRAPQGFAPIAIGLCLTLIHLISIPVTNTSVNPARSTGVALYVGDWATAQLWLFWVAPILGALLGAVAYKLISGSNKD

SEQ ID NO: 1174 - DNA, 696 bp, Vibrio vulnificus
  CDS (1)..(696): transl_table=11
atgaataaatatctggcggaattatttggcaccttttggctggtgcttggtggatgtggcagtgccgtgttggcggccgcctttccggacgttgggattggcctgctaggcgtatccctcgcgttcggtttgacggtgctcaccatggcttttgctatcggccatatttccggctgccacttgaaccctgccgtcaccattggcttatgggccggtggtcgatttgaagccaaagaaattgttccttatatccttgctcaagtgattggtggcgtcattgccggtggtgtgctttataccatcgcctctggtcaaatgggcttcgatgcgacgagctcgggttttgcctctaatggttatggtgagcattctcccggtggctattcgctgacttctgcgctggtgaccgaaatcgtgatggccatgatgtttttgctggtgattcttggcgcaacagatcagcgtgcacctcaaggttttgcgcccatcgctatcggtctgtgcctcacacttatccacctcatcagcattccagtgaccaatacatcggtcaaccctgctcgaagtaccggcgttgctctctatgttggcgattgggccaccgcgcaactttggctattctgggttgcgccgattttaggcgcactactaggggctgtggcctacaagttgatttcagggtctaacaaagactaa

SEQ ID NO: 1175 - protein, 231 aa, Vibrio vulnificus
MNKYLAELFGTFWLVLGGCGSAVLAAAFPDVGIGLLGVSLAFGLTVLTMAFAIGHISGCHLNPAVTIGLWAGGRFEAKEIVPYILAQVIGGVIAGGVLYTIASGQMGFDATSSGFASNGYGEHSPGGYSLTSALVTEIVMAMMFLLVILGATDQRAPQGFAPIAIGLCLTLIHLISIPVTNTSVNPARSTGVALYVGDWATAQLWLFWVAPILGALLGAVAYKLISGSNKD

SEQ ID NO: 1176 - DNA, 984 bp, Saccharomyces cerevisiae
  CDS (1)..(984)
atgtcttcgaacgattcgaacgataccgacaagcaacatacacgtctggatcctaccggtgtggacgacgcctacatccctccggagcagccggaaacaaagcaccatcgctttaaaatctctagggacaccctgagaaaccactttatcgctgcggtcggtgagttctgcggcacattcatgtttttatggtgcgcttacgttatctgcaatgtcgctaaccatgatgtcgcactcgttgcagcgcctgacggttcccatccgggtcaattgattatgattgccatcggtttcggattttccgtcatgttttctatctggtgttttgccggtgtctctggtggggctttgaatcctgctgtgtcgctttcgctgtgcttggcgagagccgtctctcctacaagatgtgtcgttatgtgggtttcgcagattgttgccggaatggccgctggaggcgctgcaagcgccatgacacctggtgaagtcctctttgccaattctttgggcctgggctgctctaggacgaggggtttgttcctggagatgttcggcaccgctatcctatgtttaacagtcttaatgacggctgtggagaagcgtgaaaccaactttatggccgcgctgcccatcggcatctccctgtttatcgcacacgtcgctttgactgcatacacaggcacaggtgtcaaccctgcgaggtccttgggtgctgctgtcgcagccagatacttccctcattaccactggatttattggattggcccgctgttaggatccattttagcatggtctgtatggcaattattgcaaatcttagactacacaacctacgttaccgctgaaaaggctgccagcaccaaggaaaaagctcaaaaaaaggtgaaaccagcagttcctctgctgtggctgaagtctaattttcccctccttttctttatttctcgctcactagcacttaatgttataatattcggcaaaaactag

SEQ ID NO: 1177 - protein, 327 aa, Saccharomyces cerevisiae
MSSNDSNDTDKQHTRLDPTGVDDAYIPPEQPETKHHRFKISRDTLRNHFIAAVGEFCGTFMFLWCAYVICNVANHDVALVAAPDGSHPGQLIMIAIGFGFSVMFSIWCFAGVSGGALNPAVSLSLCLARAVSPTRCVVMWVSQIVAGMAAGGAASAMTPGEVLFANSLGLGCSRTRGLFLEMFGTAILCLTVLMTAVEKRETNFMAALPIGISLFIAHVALTAYTGTGVNPARSLGAAVAARYFPHYHWIYWIGPLLGSILAWSVWQLLQILDYTTYVTAEKAASTKEKAQKKVKPAVPLLWLKSNFPLLFFISRSLALNVIIFGKN

SEQ ID NO: 1178 - DNA, 870 bp, Saccharomyces cerevisiae
  CDS (1)..(870)
atgtctaacgaatctaacgaccttgaaaaaaacatttcgcacttggacccaaccggtgttgacaatgcttatattccacctgaacagccggaaacgaagcattcgcgttttaatattgacagagataccttaagaaaccactttatcgctgctgtgggtgagttttgcggtaccttcatgtttttatggtgtgcttacgtcatttgtaatgtcgctaaccatgatgtggctttgacaaccgagcctgagggctctcatccaggtcaattgatcatgattgcccttggtttcggtttctctgtgatgttttctatctggtgttttgctggtgtttctggtggggctttgaacccagccgtttctctctctttgtgtttggccagagccatctcaccagccagatgtgtagtgatgtggtttcctcagatcattgctgggatggctgctggtggtgccgctagtgctatgactccaggcaaggttctctttactaatgctttgggtttaggctgttccaggtctagggggttgtttttggaaatgtttggtactgctgtgttgtgtttaacagttttgatgactgctgttgaaaaacgtgaaactaactttatggctgcgcttccaattggtatttctttattcatggctcacatggctttgaccggttacactggtaccggtgtcaaccctgcaaggtctctaggtgccgccgttgctgccagatatttccctcattaccactggatttactggattggcccacttttgggtgccttcttagcctggtcagtgtggcaattattacaaatccttgattacactacatacgttaatgccgaaaaggcggcaggtcaaaagaaggaagactga

SEQ ID NO: 1179 - protein, 289 aa, Saccharomyces cerevisiae
MSNESNDLEKNISHLDPTGVDNAYIPPEQPETKHSRFNIDRDTLRNHFIAAVGEFCGTFMFLWCAYVICNVANHDVALTTEPEGSHPGQLIMIALGFGFSVMFSIWCFAGVSGGALNPAVSLSLCLARAISPARCVVMWFPQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWIGPLLGAFLAWSVWQLLQILDYTTYVNAEKAAGQKKED

SEQ ID NO: 1180 - DNA, 1169 bp, Zea mays
  CDS (61)..(924)
taactagcttcttctagctctagctaggctcgtctgctgcaagaaggtaacagcgcaggcatggaggggaaggaggaggacgtccgcctgggcgccaacaagttctcggagcgccacgccatcggcacggcggcgcagggcacggacgacaaggactacaaggagcccccgccggcgccgctcttcgagcccggggagctcaagtcctggtccttctaccgccccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttggccctcgtctactgcaccgccggcatctccggccacatcaacccggcggtgaccttcgggctgttcctggcgaggaagttgtccctcaccagggcggtgttttacatcatcatgcagtgcctgggcgccatctgcggccggggcgtcgtcaaggggttccagcaggggctgtacatgggcaacggcggccggcgcaacgtcgtcgcgcccggctacaccaagggcgacggcctcggcgcggagatcgtcggcaccttcatcctcgtctacaccgtcttctccgccaccgacgccaagaggagggcaagggactcccatgtgccgatcctggcccctcttccaatcgggtttgccgtgttcctcgtccacctggccaccatgggtatcaccggcaccggcatcaaccccgcgcggagccttggcgccgccgtaatttacaaccagcaccatgcctgggctgaccactggatcttctgggtcggccccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcaaaattatgagacagcgagtcaagctttaagagttcatccaaaaaaaaaa

SEQ ID NO: 1181 - protein, 287 aa, Zea mays
MEGKEEDVRLGANKFSERHAIGTAAQGTDDKDYKEPPPAPLFEPGELKSWSFYRPGIAEFVATFLFLYISILTVMGVSKSTSKCATVGIQGIAWSFGGMILALVYCTAGISGHINPAVTFGLFLARKLSLTRAVFYIIMQCLGAICGRGVVKGFQQGLYMGNGGRRNVVAPGYTKGDGLGAEIVGTFILVYTVFSATDAKRRARDSHVPILAPLPIGFAVFLVHLATMGITGTGINPARSLGAAVIYNQHHAWADHWIFWVGPFIGAALAAIYHQVIIRAIPFKSRS

SEQ ID NO: 1182 - DNA, 1280 bp, Zea mays
  CDS (61)..(930)
gccgagcccaaccgcacaagcgcgcgaggcaggagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccgtctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgccctggctgccatctaccaccaggtgatcatcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgttttttttttctttccattgtggagaatttaagttattatccatttgctgcaaggtttgccgtctcattttatgcgttgggatgttggcaagaaagggcagatgtcatgtgagaatttaagttaagtgaaatcgattcagggttttcttgatttcagtttc

SEQ ID NO: 1183 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAVCGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 1184 - DNA, 1153 bp, Zea mays
  CDS (101)..(979)
gacacacaccgctgcttcaagaaaccaccgagagcccaaccgcacaggcaggagagagagcagggagccagggacagtagcgtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgaccttcgggctgttcttggccaggaagctgtccctgactagggccatcttctacattatcatgcaatgcctgggtgccatctgtggagctggagtggtgaagggcttccagcaggggctttacatgggcaacggcggtggcgccaatgttgtcgcccctggatacaccaagggggacggccttggcgcagagatcgttggcaccttcatcctagtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggagccttggcgccgccatcatctacaaccgggatcatgcgtggagcgaccattggatcttctgggtcggccccttcatcggcgccgccctggctgccatctaccaccaggtgatcatcagggccatcccgttcaagagcaggtcttaagctgccgcgggtgtgctgagacatgtggggaatgtattgtctgcccacgcctagtttctctgctgaatcttccatctctcttcccttcaagactgctcactgctgcactgctctgttatctgaacccagaacttcgtgtactcctgtaccgagctgtgtgtatgtttttttttc

SEQ ID NO: 1185 - protein, 292 aa, Zea mays
MEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 1186 - DNA, 864 bp, Arabidopsis thaliana
  CDS (1)..(864)
atggaaggcaaagaagaagacgtcaatgttggagccaacaagttcccagagagacagccgatcggtacggcggctcagacggagagcaaggactataaggaaccaccaccggcgccgtttttcgaacccggcgagctcaaatcttggtctttctacagagcagggatagctgagttcatagccactttccttttcctctacgtcaccgttttgacagtcatgggtgttaagagagctcccaatatgtgtgcctctgttggaatccaaggcatcgcttgggcttttggtggcatgatctttgctcttgtttactgtactgctggaatctcaggaggacatattaatccggcggtgacttttggtttgttcttggcgaggaagctatctttaaccagagctctgttctacatagtaatgcagtgccttggagctatatgtggtgctggtgtggttaaagggtttcaaccagggctgtaccagacgaatggcggtggagctaatgtggtggctcatggttacacaaagggttcaggtcttggtgcagagattgttggaacttttgttctggtttacactgttttctcagctactgatgctaagagaagtgccagagactctcatgtccctatcttggctccgcttccaattgggtttgctgtcttcttggtgcacttggctaccatcccaattactggaactggcattaacccggccaggagtctcggagctgccatcatctacaacaaggatcatgcttgggatgaccattggatcttctgggtcggtccattcattggtgctgcgcttgctgctctgtaccatcagatagtcatcagagctattcctttcaagtccaagacataa

SEQ ID NO: 1187 - protein, 287 aa, Arabidopsis thaliana
MEGKEEDVNVGANKFPERQPIGTAAQTESKDYKEPPPAPFFEPGELKSWSFYRAGIAEFIATFLFLYVTVLTVMGVKRAPNMCASVGIQGIAWAFGGMIFALVYCTAGISGGHINPAVTFGLFLARKLSLTRALFYIVMQCLGAICGAGVVKGFQPGLYQTNGGGANVVAHGYTKGSGLGAEIVGTFVLVYTVFSATDAKRSARDSHVPILAPLPIGFAVFLVHLATIPITGTGINPARSLGAAIIYNKDHAWDDHWIFWVGPFIGAALAALYHQIVIRAIPFKSKT

SEQ ID NO: 1188 - DNA, 1338 bp, Zea mays
  CDS (73)..(939)
cccacgcgtccgccagtgtcccagctcagcttagcaatccgtctctctatctacaggcgggggaattaatagatggagggcaaggaggaggacgttcgcctgggcgccaaccgctactcggagcgccagccaatcggcacggcggcgcagggcacggaggagaaggactacaaggagcctccgccggcgccgctgttcgaggcggaggagctgacgtcgtggtccttctaccgggccgggatcgccgagttcgtggccaccttcctgttcctgtacatcagcatcctgactgtgatgggcgtgagcaagtcgtccagcaagtgcgccaccgtgggcatccagggcatcgcgtggtccttcggcggcatgatcttcgcgctggtgtactgcacggcgggcatctccggcggccacatcaacccggccgtcaccttcggcctcttcctggcgcggaagctgtcgctcacgcgcgcgctcttctacatggtcatgcagtgcctgggcgccatctgcggcgccggcgtcgtcaagggcttccaggagggcctctacatgggcgccggcggcggcgccaacgccgtcaaccccgggtacaccaagggcgacgggctcggggcggagatcgtcggcaccttcgtgctcgtctacaccgtcttctccgccaccgacgccaagcgcagcgcccgcgactcccacgtgcccatcctcgcgccgctccccataggcttcgccgtcttcctcgtgcacctggcgaccatccccatcaccggcaccggcatcaaccccgcgcgcagcctcggcgccgccatcgtctacaacaggtcccacgcatggaacgaccactggatcttctgggttggccccttcatcggtgctgctcttgccgccatctaccacgtggtcatcatcagggccctccccttcaagagccgtgactgattatacgtacattgtttattaccaacagcaaccatgcagcatacgaatcatcgttattaagctatatatgtataatatccagcatgtcttgttaattactagtatatgtgctagtaagtggtgcgtgctcgctcttccatcgctgtcgtcgtctcatctgctattgttcgtcatatatatatgtccatgtgagctagctagtgtgtatcacgcgcggaggccagttcagctagccatcagtctgcaatgcactttgtgacttctctgtttagtcctctctcgcttgggttttggtacggtgaagtatataaactaagcatgcatatgtgtaaaaattcaaattcaagtgtatgcatgcatgccaataatgaaagttaagaagaagactccctgtttatg

SEQ ID NO: 1189 - protein, 288 aa, Zea mays
MEGKEEDVRLGANRYSERQPIGTAAQGTEEKDYKEPPPAPLFEAEELTSWSFYRAGIAEFVATFLFLYISILTVMGVSKSSSKCATVGIQGIAWSFGGMIFALVYCTAGISGGHINPAVTFGLFLARKLSLTRALFYMVMQCLGAICGAGVVKGFQEGLYMGAGGGANAVNPGYTKGDGLGAEIVGTFVLVYTVFSATDAKRSARDSHVPILAPLPIGFAVFLVHLATIPITGTGINPARSLGAAIVYNRSHAWNDHWIFWVGPFIGAALAAIYHVVIIRALPFKSRD

SEQ ID NO: 1190 - DNA, 1325 bp, Zea mays
  CDS (202)..(1092)
ccgaatcgatttgtccatttgctgcacgcatgactcgacatgcatggaattggatgggtcctactaatgctgtggcgctgcagcctatataagaacactacacacatagctcttgacacgtcgcttcatctagtcccagcactactcactcacttccagtctctagagccatcaagatcgtagctgagcgagttagtattcatggcaggaggcacgctgcaggacagatcggaggaagaggacgtgcgcgtgggcgtggaccgtttcccggagcggcagcccatcggcacggcggcggacgacctgggccgcgactacagcgagcccccggcggcgccgctgttcgaggcgtcggagctctcctcgtggtccttctaccgcgccggcatcgccgagttcgtggccacgttcctcttcctgtacgtgaccgtgctgacggtgatgggcgtgagcaagtccccctccaagtgcggcaccgtgggcatccagggcatcgcgtgggcgttcggcggcatgatcttcgcgctcgtgtactgcaccgcgggcgtgtcgggcggccacatcaacccggccgtcacgttcggcctcctcctcgcccggaagctgtcgctgacgcgggcggtctactacgtggtgatgcagtgcctgggcgccgtctgcggcgccggcgtcgtgaaggcgttcggcagcgcgctgtacgagtccgcgggcggcggcgccaacgccgtcagccccgggtacaccaagggcgacggcctcggcgccgaggtcgtgggcacgttcgtgctcgtgtacaccgtcttctccgccaccgacgccaagcgcaccgccagggactcccacgtccccgcgctggccccgctgcccatcggcttcgccgtattcctggtgcacctcgccaccatccccatcaccggcaccggcatcaaccccgccaggagcctcggcgccgccatcatctacgacaacccgcacgggtggcacggccactggatcttctgggtgggcccgttcgccggagcggcgcttgcggcggtgtaccaccaggtcgtcctcagggccatccccttcaagtccagcgctcactactagtgttgcttgccttgccgtcatacacggagttctgctgccacatcggccgctcaatgggccatcactccgcgaatgtatgatgtgtgtaactcgaatgtgtggttaattttcgttttcttacgtgtttgcatccacggaatgtgtcatcagtgtacaaatcaactgtatgtggctgtacgtgtcccaattatgataatgctaataaggccataatataccaaggcccatttact

SEQ ID NO: 1191 - protein, 296 aa, Zea mays
MAGGTLQDRSEEEDVRVGVDRFPERQPIGTAADDLGRDYSEPPAAPLFEASELSSWSFYRAGIAEFVATFLFLYVTVLTVMGVSKSPSKCGTVGIQGIAWAFGGMIFALVYCTAGVSGGHINPAVTFGLLLARKLSLTRAVYYVVMQCLGAVCGAGVVKAFGSALYESAGGGANAVSPGYTKGDGLGAEVVGTFVLVYTVFSATDAKRTARDSHVPALAPLPIGFAVFLVHLATIPITGTGINPARSLGAAIIYDNPHGWHGHWIFWVGPFAGAALAAVYHQVVLRAIPFKSSAHY

SEQ ID NO: 1192 - DNA, 1107 bp, Solanum lycopersicum
  CDS (13)..(873)
ctttgtgaaaaaatggcagaaaacaaggaagaagatgttaagcttggagctaacaagtttagggaaactcaaccattaggtacagcagctcaaacagacaaagattacaaagagccaccaccagctccattgtttgaaccaggggagttgtcatcatggtccttttacagggctggtattgcagagttcatggcaactttcttgttcttgtatatcacaatcttgactgttatgggtcttaagagatctgatagtttatgttcttcagtgggtattcaaggggttgcttgggcttttggtggtatgatctttgctttggtctactgtactgctggtatctcaggaggacacatcaacccagctgtgacctttggccttttcttggcaaggaaattgtccttgaccagggctgttttctacatggtgatgcagtgccttggtgcaatctgtggtgctggtgttgtgaagggcttcatggtaggaccataccaaagacttggtggtggtgctaatgttgttaaccctggatacaccaagggtgatggccttggtgctgaaattattggcacctttgtccttgtttacactgttttttcagccactgatgccaagagaaatgccagagactcacatgttcctattttggcaccacttcctattggattcgcagtgttcttggttcatttggccaccatccccatcaccggaactggcatcaaccccgccaggagtcttggagctgctatcatctacaacgacgagcatgcatggaatgaccactggatcttctgggttggaccaatgattggagctgctcttgctgctatttaccaccaaataattatcagagctatgccattccacaggtcttaagttatcagtctttaaacaatgggattctcaaagactcaacagtgtacttttgtcttctttttttggggggttgaatgttcaagtttctccttcaatgtatttgtaatgtggatctgttcctttgttaagatgttctattatgtgtgtaaattatcaggttatgataatgtaatgtaccttatcaatgaaggttctttatttttatctttgaaaaaaaaaaaaaaaaaaaaaaaa

SEQ ID NO: 1193 - protein, 286 aa, Solanum lycopersicum
MAENKEEDVKLGANKFRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYMVMQCLGAICGAGVVKGFMVGPYQRLGGGANVVNPGYTKGDGLGAEIIGTFVLVYTVFSATDAKRNARDSHVPILAPLPIGFAVFLVHLATIPITGTGINPARSLGAAIIYNDEHAWNDHWIFWVGPMIGAALAAIYHQIIIRAMPFHRS

SEQ ID NO: 1194 - DNA, 864 bp, Arabidopsis thaliana
  CDS (1)..(864)
atggcaaaggatgtggaagccgttcccggagaaggatttcagacaagagactatcaagatccgccaccagctccgtttattgatggagcggagctaaagaagtggtctttctacagagcagttatcgcagagttcgtagccactctcctcttcttatacatcaccgttttgacagtcatcggttacaagattcagtccgatactgatgccggtggcgtagattgcggcggagttggaatcctcggtatcgcttgggcctttggtggtatgatcttcatcctcgtctactgcaccgccggtatctctggtggtcacattaacccagcggtgacatttgggctattcttggcacgtaaagtgtcgttacctagggccctattgtacataatcgctcagtgtttgggtgcgatttgtggagttggttttgtcaaagccttccaaagctcttactacacccgttacggaggtggagccaactctctagccgatggctacagcacagggaccggtctagccgcagagatcattggtactttcgttcttgtctacaccgtcttctctgccactgaccccaaacgtagtgccagagactcccacgttccggtgttggcgccacttccaatcggatttgccgtgttcatggtacatttggctaccattcccattaccggaaccggaattaacccggcaaggagtttcggagctgccgtaatctacaacaagagcaagccatgggatgaccactggatattttgggttggaccattcattggagctgcgatagctgcattctaccaccaattcgttctgagagcttcaggttctaagtctcttggatcattcagaagtgctgccaacgtctaa

SEQ ID NO: 1195 - protein, 287 aa, Arabidopsis thaliana
MAKDVEAVPGEGFQTRDYQDPPPAPFIDGAELKKWSFYRAVIAEFVATLLFLYITVLTVIGYKIQSDTDAGGVDCGGVGILGIAWAFGGMIFILVYCTAGISGGHINPAVTFGLFLARKVSLPRALLYIIAQCLGAICGVGFVKAFQSSYYTRYGGGANSLADGYSTGTGLAAEIIGTFVLVYTVFSATDPKRSARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 1196 - DNA, 1171 bp, Zea mays
  CDS (73)..(945)
cccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggggccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgccttttttttgtttcagcagctgctgcgttgcgcgcgtgcgtgagatttggtttggtttcgttcccctgcaatgtaatcatgtcgtgactctcaagggattattccgctctt

SEQ ID NO: 1197 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 1198 - DNA, 1268 bp, Zea mays
  CDS (120)..(998)
atccattcggccattccttaacatccttgttgcaagcggcgccagcttgctcgcgctctctcgcagctgctacgctaaagcaagtctagtctctagaggaggaggcggagggggaggccatgggcaaggacgacgtggtccagagcggcgcgggcggcggggagttcgccgccaaggactacacggacccgccgccggcgccgctggtggacgcggcggagctgggttcgtggtcgctgtaccgcgcggtgatcgcggagttcatcgcgacgctgctgttcctgtacgtgacggtggcgacggtgatcgggtacaagcaccagacggacgcgtctgcgtcgggggccggggcggacgcggcgtgcggcggcgtgggcgtgctgggcatcgcgtgggccttcggcggcatgatcttcgtgctggtctactgcaccgccggcatctcggggggccacatcaacccggccgtcaccttcggcctcttcctggcgcgcaaggtgtcgctggtgcgcgcgctgctgtacatggtggcgcagtgcctcggcgccgtctgcggcgtcggcctcgtcaaggcgttccagagcgcctacttcgaccggtacggcggcggcgccaactcgctcgcgtccggctactcccgcggcgcggggctcggcgccgagatcgtcggcaccttcgtgctcgtgtacaccgtcttctccgccaccgaccccaagcgcaacgcccgcgactcccacgtcccggttctggctcccctccccatcggcttcgccgtgttcatggtccacctggccaccatccccgtcaccggcaccggcatcaacccggccaggagcctgggcgccgccgtcgtctacaacaaggacaagccatgggatgaccactggattttctgggtgggcccgctcctgggcgctgccatcgcggccttctaccaccagtacatcctccgggcgggcgccatcaaggctctcggctccttcaggagcaacgcgtgatgagcagagctaaagaaaggccttcgctggactgcgtgctggagcaacggcgatcgatcgatctagcgtggggagaggcggataggcgggcgcgcgagggaggagaataagtttgtgccggtggcccggtctcgtcggtcgcttttgttccagcatgcagctgcgtcgcgttcgtgtgcgtgcgtgggggtctccttaatttccccggcccctgtaatcatcaatcaccatgtgtgcgtataatatctgctgccaagggatcgattattc

SEQ ID NO: 1199 - protein, 292 aa, Zea mays
MGKDDVVQSGAGGGEFAAKDYTDPPPAPLVDAAELGSWSLYRAVIAEFIATLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 1200 - DNA, 1156 bp, Zea mays
  CDS (75)..(944)
agcaaagcgaagcgcgcgcacagagatctagctgagctactagctatagcagcagctgctgcaggtctcctgacatggcgaagcaggacatcgaagcatcggggcccgaggccggcgagttctcggccaaggactacacggaccctccgccggcgccgctcatcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggcggcgtgggcatcctcggcatcgcgtgggccttcggcggcatgatcttcatcctcgtctactgcaccgccggcatctcaggtgggcacatcaacccggccgtgaccttcggcctgttcctggcgaggaaggtgtccctcgtccgcgccctgctctacatcatcgcgcagtgcctgggcgccatctgcggcgtcggcctcgtcaagggcttccagagcgcctactacgtgcgctacggcggcggcgccaacgagctcagcgacggctactccaagggcaccggcctcgccgccgagatcatcggcaccttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgccgcctaccaccagtacgtgctgagagccagcgccaccaagctcgggtcctaccggagcaacgcctaataagtccggcggcgggagctgtgggcgccaccgatcgatccaagtgtagatacgtacgctcccccgactccgtccagtatatgacgccctgtggtcgtccacatctgccaccacagtcccgtccgcttggtgctgttttctttctttccttgacggggaaaaaaagtgtgatatatctttgctttctgtatatgtgacaaaatgcattctgt

SEQ ID NO: 1201 - protein, 289 aa, Zea mays
MAKQDIEASGPEAGEFSAKDYTDPPPAPLIDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 1202 - DNA, 1171 bp, Zea mays
  CDS (88)..(954)
cacaccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctgatcgacgcggaggagctcacccagtggtcactgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcttgggccttcggcggcatgatcttcatcctcgtctactgcaccgccggcatctcaggtgggcacatcaacccggccgtgaccttcggcctgttcctggccaggaaggtgtccctcgtccgcgcgctgctctacatcatcgcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccgcccggacgcgccaggagctgggcaccgttccgattctgttcctccacatgacgccctgttctgtttccgtgtggccaggactccgctcgctcgctgctgttttctacttcggaccaaagtgtgacatatctttgctttctgtatatgtatgtaggaatgcatcatgtaaggagaatttggaatacaattgcgtgagtttttatccgatcac

SEQ ID NO: 1203 - protein, 288 aa, Zea mays
MAKDIEASGPEAGEFSAKDYTDPPPAPLIDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 1204 - DNA, 1104 bp, Zea mays
  CDS (4)..(861)
agaatggccaaggacatcgaggccgcggcggcgcacgagggcaaggactactcggacccgcccccggcgccgctggtggacgcggaggagctgaccaagtggtcgctgtaccgcgcggtgatcgccgagttcgtggccacgctgcttttcctctacatcacggtggccacggtgatcgggtacaagcaccagacggacgcggcggcgtcgggccccgacgcggcgtgcggcggcgtcggcgtgctcggcatcgcctgggccttcggcggcatgatcttcatcctcgtctactgcaccgcgggggtgtcgggtgggcacatcaacccggccgtcaccttcggcctcttcctggcgcgcaaggtctcgctggtgcgcgcgctgctctacatcgtggcgcagtgcctcggcgccatctgcggcgtcgggctcgtcaagggcttccagagcgccttctacgtgcgctacggcggcggcgccaacgagctcagcgccggctactccaagggcaccggcctcgccgcggagatcatcggcaccttcgtgctcgtctacaccgtcttctccgccaccgaccccaagcgcaacgcccgtgactctcatgtccccgtgcttgcccctctccccatcgggtttgcggtgttcatggtccatctggccacgatccccatcaccggcaccggcatcaacccggccaggagcttgggcgctgctgtcatctacaacaacgacaaggcctgggatgaccactggatcttctgggtgggtccattcatcggcgccgccatcgccgcggcgtaccaccagtacgtgctgagggccagcgccgccaagctgggatcgtctgcctccttcagccgctagatcgatggcctcccgccggacaaggacagccggaggcgtgaactgtagatataccagattccggataaggacagcgtgtcgtcgttggttgcctctagccatgatgcgtcgttatatatgcatgccttatgatcagtttgtatttccactgcattttgcttgctttaattttccttccaagctagtgtgattgttgtgctgtacttatccgtgtacgacgagccgacgactgggtaaaatttc

SEQ ID NO: 1205 - protein, 285 aa, Zea mays
MAKDIEAAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYNNDKAWDDHWIFWVGPFIGAAIAAAYHQYVLRASAAKLGSSASFSR

SEQ ID NO: 1206 - DNA, 946 bp, Arabidopsis thaliana
  CDS (1)..(843)
atgtcgaaagaagtgagcgaagaaggcaaaacccaccatggaaaagactacgtggatcctccaccagctcctcttctcgacatgggtgagctcaaatcctggtctttctacagagctctcatcgctgagttcatcgctacactcctcttcctctacgtcaccgtcgctactgtcatcggccacaagaagcaaaccggtccttgtgacggcgttggtttacttggtatcgcttgggctttcggtggtatgatcttcgtcctcgtctactgcaccgccggtatctctggtggtcacattaacccagctgtgactttcggtctgttcttggcccgtaaggtctctttggtgcgagctcttggttacatgatagctcagtgtcttggagccatttgtggtgtgggtttcgtgaaagctttcatgaaaactccttacaacactcttggtggaggagctaacaccgtagctgacggttacagcaaaggaactgctctcggagctgagattattggaactttcgtccttgtttacaccgttttctctgcaactgaccctaagagaagcgctcgtgactctcacatccccgttttggctccacttccaattggatttgctgtgttcatggtgcatttggctactatccccattactggaactggtatcaacccagctagaagctttggtgctgctgttatctacaacaacgagaaggcgtgggatgaccaatggatcttttgggttggtccgttcttgggagcactagctgcagcagcttaccaccaatacatattgagagcttcagcaattaaggccttgggctcgttccgaagcaacgcaaccaattaatgaaggctttttttaagataatgtcaagaaacaactttaagatttatatgctttaattattatttgttgttcttttgtgtgtaatgagagagatggtggattg

SEQ ID NO: 1207 - protein, 280 aa, Arabidopsis thaliana
MSKEVSEEGKTHHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRALGYMIAQCLGAICGVGFVKAFMKTPYNTLGGGANTVADGYSKGTALGAEIIGTFVLVYTVFSATDPKRSARDSHIPVLAPLPIGFAVFMVHLATIPITGTGINPARSFGAAVIYNNEKAWDDQWIFWVGPFLGALAAAAYHQYILRASAIKALGSFRSNATN

SEQ ID NO: 1208 - DNA, 837 bp, Arabidopsis thaliana
  CDS (1)..(837)
atgtcaaaagaagtgagtgaagaaggaagacatggcaaagactacgtggatccacctccagctccacttctagacatggctgagcttaagctctggtctttttacagagctatcatcgcagagttcatcgccactctcctcttcctctatgtaaccgtagctacagtcattggccacaagaaccaaaccggtccttgtggcggtgttggtttactcggcattgcgtgggcctttggtggcatgatctttgtcctcgtctattgcaccgccggtatctccggaggtcacattaacccagctgtgacatttggtctgttcttggctcgtaaagtgtcgctccctagagcagttgcttacatggtggctcagtgtcttggagccatttgtggagttggactcgttaaggcctttatgatgactccatataaacgtctcggaggcggagctaacaccgtagctgatggttatagcaccggaactgctcttggtgctgagattattggcacatttgtcttggtttacactgtcttctccgccactgaccccaaaagaagtgcccgtgactctcacgtcccggttttggctccgttacctatagggtttgctgtgttcatggtgcatttggctactatccccataactggaactgggattaatccagccagaagctttggtgctgctgttatctacaacaatgagaaagcttgggacgaccattggatcttttgggttggaccattcgtgggagcattagcagcagcagcataccatcaatatatcttgagagctgcagcaatcaaagctttggcttcattccgcagcaacccaaccaattga

SEQ ID NO: 1209 - protein, 278 aa, Arabidopsis thaliana
MSKEVSEEGRHGKDYVDPPPAPLLDMAELKLWSFYRAIIAEFIATLLFLYVTVATVIGHKNQTGPCGGVGLLGIAWAFGGMIFVLVYCTAGISGGHINPAVTFGLFLARKVSLPRAVAYMVAQCLGAICGVGLVKAFMMTPYKRLGGGANTVADGYSTGTALGAEIIGTFVLVYTVFSATDPKRSARDSHVPVLAPLPIGFAVFMVHLATIPITGTGINPARSFGAAVIYNNEKAWDDHWIFWVGPFVGALAAAAYHQYILRAAAIKALASFRSNPTN

SEQ ID NO: 1210 - DNA, 867 bp, Oryza sativa
  CDS (1)..(867)
atggcgaaagacattgaggcgtcggcgccggagggcggcgagttctcggcgaaggactacaccgacccgccgccggcgccgctgatcgacgtggaggagctgaccaagtggtcgctgtaccgcgcggtgatcgcggagttcatcgcgacgctcctcttcctgtacatcacggtggccaccgtgatcgggtacaagcaccagtcggacgccaccgtcaacaccaccgacgccgcctgcagcggcgtcggcatcctcggcatcgcctgggccttcggcggcatgatcttcatcctcgtctactgcaccgccggcatctcaggtgggcacatcaacccggcggtgacgttcgggctgttcctggcgaggaaggtgtcgctgatcagggcggtgctgtacatcatcgcgcagtgcctgggcgccatctgcggcgtggggctcgtcaaggggttccagagctcgtactacgcgcggtacggcggcggagccaacgagctcagcgacggctactccaagggcaccggcctcggcgcggagatcatcggcaccttcgtgctcgtctacaccgtcttctccgccaccgaccccaagcgcaacgcccgcgactcccacatcccggtgttggctcctctcccaattggattcgcggtgttcatggtccatctggccaccatccccatcaccggcaccggcattaacccggcgaggagcttgggaaccgcggttatctacaacaaggacaaggcctgggatgaccaatggatcttctgggtgggccccctgatcggcgccgccatcgccgccgcctaccaccagtacgtgctgagggccagcgccgccaagctcgggtcctaccggagcaacgcctga

SEQ ID NO: 1211 - protein, 288 aa, Oryza sativa
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 1212 - DNA, 861 bp, Oryza sativa
  CDS (1)..(861)
atgggcaaagaggtggacgtgtccactctcgaggccggcggcgcccgggactacatcgacccgccgccggcgccgctcgtcgacgtcgacgagctgggcaagtggtcgctgtaccgcgcgctgatcgccgagttcgtcgccacgctgctcttcctctacgtcacggtggccacggtgatcgggtacaagcaccagacggacgccgccgtgaacggcgccgacgcggcgtgcggcggtgtgggcgtcctcggcatcgcgtgggcgttcggcggcatgatcttcatcctcgtctactgcaccgccggcgtctccggcgggcacatcaacccggcggtgacactcggcctcttcctggcgcggaaggtgtccctggtgcgcgccctcctgtacatggcggcgcagtgcctcggcgccatctgcggcgtcgcgctcgtcaaggggttccagagctcgctctacgacaggtacggcggcggcgccaacgagctcgccgccggctactccaccggcaccggcctcgccgccgagatcatcggcaccttcgtgctcgtgtacaccgtcttctccgccaccgatcccaagcgcaacgcccgcgactcacatgttcccgtgttggctccgctgccaatcgggttcgcggtgttcatggtgcacctggcgacgatcccgatcaccggcaccggcatcaacccggccaggagcctcggcgtcgccgtggtctacaacaacaacaaggcctggagtgatcagtggatcttctgggttgggccgttcatcggcgcggcgatcgcggcgctgtaccaccaggtcatcctccgtgccagtgcaaggggctacggctccttccggagcaacgcgtag

SEQ ID NO: 1213 - protein, 286 aa, Oryza sativa
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTLGLFLARKVSLVRALLYMAAQCLGAICGVALVKGFQSSLYDRYGGGANELAAGYSTGTGLAAEIIGTFVLVYTVFSATDPKRNARDSHVPVLAPLPIGFAVFMVHLATIPITGTGINPARSLGVAVVYNNNKAWSDQWIFWVGPFIGAAIAALYHQVILRASARGYGSFRSNA

SEQ ID NO: 1214 - DNA, 750 bp, Brassica napus
  CDS (1)..(750)
atggcggcagttgcctttggttcttttgatgattctttcagcttggcttctctaagagcttacctcgctgagttcatctccactttgctctttgtcttcgctggtgttggttccgccattgcctacgcgaaactgacgtctgatgcggctcttgatacgccgggacttgtcgccatcgctgtgtgccatggtttcgctctcttcgtggcggttgcaatcggagccaacatctccggtggccacgtgaacccagccgtcacttttggccttgctctcggtggtcaaatcacactcattaccggagttttctattggatcgctcagcttctcggctccaccgccgcttgcttccttcttaagttcgttaccggtggcttggcggttccaacacacagcgttgcggctggagtaggagccattgaaggagtagtgatggagatcatcatcaccttcgctttggtctacacagtctatgccaccgccgctgatcccaagaaaggttctcttggaaccattgctcctctggccattggtcttatcgttggtgccaacatcctcgccgctggtccattctcaggtggatccatgaacccagcacgttcctttggaccagctgttgcagctggagacttctctggtcactgggtctactgggtgggaccactcatcggtggtggactcgctggacttgtttacggaaatgtcttcatgccttcttcagaacatgttcctcttgcctctgaattctaa

SEQ ID NO: 1215 - protein, 249 aa, Brassica napus
MAAVAFGSFDDSFSLASLRAYLAEFISTLLFVFAGVGSAIAYAKLTSDAALDTPGLVAIAVCHGFALFVAVAIGANISGGHVNPAVTFGLALGGQITLITGVFYWIAQLLGSTAACFLLKFVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLVYGNVFMPSSEHVPLASEF

SEQ ID NO: 1216 - DNA, 753 bp, Brassica napus
  CDS (1)..(753)
atggtgaagattgcaattggaagtttaggtgattcctttagcgttgcgtctctaaaggcttacttatctgagtttatcgcaactcttctcttcgtgtttgccggcgttggttctgctattgcttttggcaaactaacatccaatgcggccctggacccatctggtcttgtcgctgtggctgtggctcacgcctttgctcttttcgtcggtgtgtccatagccgccaacatctccggtggacaccttaacccagccgtgactctcggcctcgcagtcggcggtaacatcactgtcatcaccggtttcttttactggatagctcagtgccttggctccatcgtcgcttgtctcctcctagccttcgttactaatggcgagagcgtaccgacccatggagtagcagccggtttaggagcggttgaaggaatagtgatggagattgtggtgacatttgctctggtgtacacagtttacgccaccgcagctgatccgaagaagggatcgcttggaaccattgctcctattgccattggtttcatcgttggtgccaacatccttgccgccggtccattcagcggaggctctatgaacccggccaggtcatttggaccagctgttgttagtggtgacttctctcagatatggatctactgggtaggcccacttgtcggcggtgcactagctggactcatctacggtgacgtcttcatcggatcctacgcaccggctccgaccacagaaagctacccttga

SEQ ID NO: 1217 - protein, 250 aa, Brassica napus
MVKIAIGSLGDSFSVASLKAYLSEFIATLLFVFAGVGSAIAFGKLTSNAALDPSGLVAVAVAHAFALFVGVSIAANISGGHLNPAVTLGLAVGGNITVITGFFYWIAQCLGSIVACLLLAFVTNGESVPTHGVAAGLGAVEGIVMEIVVTFALVYTVYATAADPKKGSLGTIAPIAIGFIVGANILAAGPFSGGSMNPARSFGPAVVSGDFSQIWIYWVGPLVGGALAGLIYGDVFIGSYAPAPTTESYP

SEQ ID NO: 1218 - DNA, 762 bp, Brassica napus
  CDS (1)..(762)
atggccggtattgacttttcctgtgaagactcctttaagttggtgtctttgaaagcttacctcgccgagttcatctccactttgctctttgttttcgccggcgttggctccgccattgcttttgggaagctaacgaataatgcggctcttgatgcgcccggtctagttgcgattgccgtttgccacggttttgccctctttgtcgcggtttccatcgcagcaaaccactccggtggtcatgtgaacccagccgtcacctttggccttgttctgggtggaaaattgaaaatcgtcacaggagtttgctattgggttgctcagcttcttggctccaccgctgcttgtttccttcttaaatttgtcaccggtggtttggcgattccaatccacagcgttgcggctggagtagggtccactgaaggagtagtgatggagatcataatcacatttgcattggtctacactgtttacgccacagccgttgatcccaagaatggcactctcggaatcatcgcaccacttgctattggtctcatcgtcggtgctaacattcttgccgctggcccgttctctggtggttccatgaaccctgctcgttcctttggaccagctcttgtggctggtgacttttcaggacattgggtctattgggtcggtccacttgttggtggtggactcgctggagttatatactcaaacgcttttatcgccgagtccaaccaagagactgagtctgagcatgttcctcttatctctgcttaa

SEQ ID NO: 1219 - protein, 253 aa, Brassica napus
MAGIDFSCEDSFKLVSLKAYLAEFISTLLFVFAGVGSAIAFGKLTNNAALDAPGLVAIAVCHGFALFVAVSIAANHSGGHVNPAVTFGLVLGGKLKIVTGVCYWVAQLLGSTAACFLLKFVTGGLAIPIHSVAAGVGSTEGVVMEIIITFALVYTVYATAVDPKNGTLGIIAPLAIGLIVGANILAAGPFSGGSMNPARSFGPALVAGDFSGHWVYWVGPLVGGGLAGVIYSNAFIAESNQETESEHVPLISA

SEQ ID NO: 1220 - DNA, 762 bp, Brassica napus
  CDS (1)..(762)
atgccgaccagaaacatcgccatcggcggagtccaagaagaagtgactcaccccagcgcacttagggcggccctcgctgagtttatctcgactttgatctttgtcttcgccggctcaggctcaggaattgctttcaacaagctcactgacaatggagccaccactccttcaggccttgtcgccgctgccttagctcatgctttcggtctcttcgtcgctgtttctgtcggtgccaacatctccggtggacacgttaaccctgccgttaccttcggtgccttcctgggtggaaacatcactctcctccgtggtctcctctactggattgctcagcttcttggctcagtcgtcgcttgcttcctccttcagttcgccaccggtggcttggcagttccagcgttcggtctctccgcaggagttggaaccttgaatggtctcgtcttcgagatcgtgatgaccttcgggctcgtctacaccgtctacgccacagccatcgaccccaaaaacggtagcctaggaacaatcgcacccatcgccattggtttcatcgtcggagctaacatccttgctggtggagctttcagcggagcctccatgaacccagccgtcgctttcggaccagccgtcgtgagctggtcatggagtaaccactggatttattgggttggtcctcttgtcggtggtggactcgccggaatcatctacgactttgtttacatcatcgaaaacggccacgagcaattgcccaccactgattactga

SEQ ID NO: 1221 - protein, 253 aa, Brassica napus
MPTRNIAIGGVQEEVTHPSALRAALAEFISTLIFVFAGSGSGIAFNKLTDNGATTPSGLVAAALAHAFGLFVAVSVGANISGGHVNPAVTFGAFLGGNITLLRGLLYWIAQLLGSVVACFLLQFATGGLAVPAFGLSAGVGTLNGLVFEIVMTFGLVYTVYATAIDPKNGSLGTIAPIAIGFIVGANILAGGAFSGASMNPAVAFGPAVVSWSWSNHWIYWVGPLVGGGLAGIIYDFVYIIENGHEQLPTTDY

SEQ ID NO: 1222 - DNA, 756 bp, Brassica napus
  CDS (1)..(756)
atgccgatcagaaacatcgccgttggaagtcccaatgaggccacccgtcccgacgccttaaaggcggcgttggctgagtttatttcaactatgatctttgtcttcgccggctcaggctcaggaatggctttcaacaagctcactgaaaatggagccaccactcccgccggtctcgtagctgcctcactggcacacgcttttggactctttgttgctgtctcagttggcgccaacatctccggcggacacgttaaccccgccgtcactttcggcgctttcgttggtggaaacatcactctcctccgtggtatactctactggattgctcagctactcggctcagtcgttgcttgtctcctgctcaagttcgccaccggcggtttggttgtgccggcttttggcctctccgccggagttggagtgtcgaacgctttggttttcgagatcgtgatgaccttcgggcttgtttacacagtctacgccaccgccgttgatcccaagaacggaagtcttggaacaatagctcccatagcaattggtttcattgttggtgccaacatcttagcaggaggagcctttagcggagcctcaatgaaccccgccgtggctttcggaccagctgtggtaagctggtcgtggaacaaccactgggtttactgggccggacctcttgttggcggtggactcgctggactcatctacgaggttttcttcatcaacaccactcacgaacagctccccaccaccgactactga

SEQ ID NO: 1223 - protein, 251 aa, Brassica napus
MPIRNIAVGSPNEATRPDALKAALAEFISTMIFVFAGSGSGMAFNKLTENGATTPAGLVAASLAHAFGLFVAVSVGANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLVGGGLAGLIYEVFFINTTHEQLPTTDY

SEQ ID NO: 1224 - DNA, 861 bp, Brassica napus
  CDS (1)..(861)
atggaaggcaaggaagaagacgttagggttggagctaacaagttcccggagagacaaccaataggaacttcagctcagagcgacaaggactacaacgagccaccaccagcgccgcttttcgagcctggtgagctttcttcatggtccttctggcgagctggtatcgctgaatttatagctactttcctcttcctctacatcactgttttgaccgtcatgggagttaaaaggtcaccgaacatgtgtgcttccgtcggaatccaaggtatcgcttgggccttcggtggtatgatctttgctcttgtctactgcaccgcccgtatctccggtggacacatcaacccagcggtcacttttggtctgttcttagcccggaagctgtcgctcaccagagctctgtactacatagtgatgcagtgcttgggagccatatgcggagctggtgtggttaaagggttccagcctaaccaataccaggctctaggaggaggagccaacactgtggctcctggatacaccaaaggaagtggtcttggtgctgagatcatcggtacatttgtccctgtttacacagttttctcagccactgatgcaaagagaaacgcacgtgactctcatgttcccattcttgcaccactcccaatcgggtttgcagttttcttggttcacttagcaaccatcccaatcactggcacaggcatcaacccggctagaagtcttggagctgcaatcatctacaacaaagaccattcctgggacgaccactgggtgttttgggttggacccttcattggtgctgcacttgctgctctttaccatgtgattgtcatcagagcaatccccttcaagtccagaaactaa

SEQ ID NO: 1225 - protein, 286 aa, Brassica napus
MEGKEEDVRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTARISGGHINPAVTFGLFLARKLSLTRALYYIVMQCLGAICGAGVVKGFQPNQYQALGGGANTVAPGYTKGSGLGAEIIGTFVPVYTVFSATDAKRNARDSHVPILAPLPIGFAVFLVHLATIPITGTGINPARSLGAAIIYNKDHSWDDHWVFWVGPFIGAALAALYHVIVIRAIPFKSRN

SEQ ID NO: 1226 - DNA, 765 bp, Glycine max
  CDS (1)..(765)
atggcaactcgaagatatgagtttggaaggatgaatgaggctagccacccagactccatcagagctgccttggctgaattcctctccacttgcatctttgtctttgctggagaaggctctgcccttgctttgcgacaaatttacaaggaaccagggtcatcagcgggtgagctagtggtaattgcactagctcatgcatttgctctatttgctgctatttctgctagcatgcatgtgtctggtggacacgtcaaccctgccgtcacttttggcgctcttcttggtggaaggatctccgtccttagagcagtttactattgggttgctcaacttctaggttctatagtggctgctctcttgttgaggcttgtcactaacaacatgagaccacaggggttcagtgtgtcaatcgggcttggagcgttccacggtcttgtacttgagattgctctcacatttggtctgatgtacacagtctatgcaactgctattgatcctaaaaggggtagcattggctcaattgcacccttagccattggattcgttgttggggcaaacatccttgctggtgggccgtttgatggagcatgcatgaaccctgctcgggcttttgggcctgccatggtgggctggagatggcactaccactggatcttctgggtgggcccattcattggagctgcccttgcagcactcctgtatgaatacgttatggtcccaaatgagcctcctcatcaccaacctttggctgctgaagattactag

SEQ ID NO: 1227 - protein, 254 aa, Glycine max
MATRRYEFGRMNEASHPDSIRAALAEFLSTCIFVFAGEGSALALRQIYKEPGSSAGELVVIALAHAFALFAAISASMHVSGGHVNPAVTFGALLGGRISVLRAVYYWVAQLLGSIVAALLLRLVTNNMRPQGFSVSIGLGAFHGLVLEIALTFGLMYTVYATAIDPKRGSIGSIAPLAIGFVVGANILAGGPFDGACMNPARAFGPAMVGWRWHYHWIFWVGPFIGAALAALLYEYVMVPNEPPHHQPLAAEDY

SEQ ID NO: 1228 - DNA, 798 bp, Triticum aestivum
  CDS (1)..(798)
atgctgccaactcgtttccctagccgcggtgccgacaacgctgcggggctggagaccctgctgccggcagcttcccgcgccgtgctgtcggagttcatagccaccgccgtgttcgtcttcgccgccgaaggctccgtctacggcctctggaagatgtacaaggacacggggacgctgggtggcctgctcgtggtggcggtggcgcacgcgctcgctctggccgcggcggtggcgctggcgagcggcgcctcgggcgggcacgtcaacccggccgtcacgttcggcgtgctcgtcggcaggcgcatctcctttgcgcgcgccgtgctctactgggcggcgcagcttctcggcgccgtgctcgccgccgctctcctcaggatcatctccggcggcgtgcgccccatggggttcacgctcggccacggcatccacgagcggcacgccctgctgctcgaggtcgtcatgacgttcgggctcatgtacaccgtgtacgccaccgccgttgaccggaaccgcggcggcaacgtcggcaccatcgcgcccatcgccatcggcttcgtcctgggcgccaacatcctcgccggcggcccgttcgacggcgccgccatgaacccggcgcgggcgttcggcccggcgctcgtcggctggacctggcgccaccactgggtctactgggtcggcccgctgatcggcgccgggctggccggcgcgctgtacgagtttgtcatgaccgagcaacccgaggagccggcggcagcggccaggcgtgagctgcccgtgcccgcccaggattactga

SEQ ID NO: 1229 - protein, 265 aa, Triticum aestivum
MLPTRFPSRGADNAAGLETLLPAASRAVLSEFIATAVFVFAAEGSVYGLWKMYKDTGTLGGLLVVAVAHALALAAAVALASGASGGHVNPAVTFGVLVGRRISFARAVLYWAAQLLGAVLAAALLRIISGGVRPMGFTLGHGIHERHALLLEVVMTFGLMYTVYATAVDRNRGGNVGTIAPIAIGFVLGANILAGGPFDGAAMNPARAFGPALVGWTWRHHWVYWVGPLIGAGLAGALYEFVMTEQPEEPAAAARRELPVPAQDY

SEQ ID NO: 1230 - DNA, 753 bp, Zea mays
  CDS (1)..(753)
atggtgaagctcgcattcggaagcgtcggtgactccttcagcgccacctccatcaaggcctacgtggccgagttcatcgccaccctcctcttcgtcttcgccggcgtgggttccgccatcgccttcgggcaactgacgaatggcggcgcgctggaccctgcgggtctggtggcgatcgcggtggcgcacgcgctggccctcttcgtgggcgtctccgtggccgcgaacacctccggcggccacctgaaccccgccgtgacgttcggcctggccgtgggcggccacatcaccgtcctcaccggcctcttctactgggtggcccagctgctgggcgcgtccgtggcgtgcctgctcctcaggttcgtgacccacggcaaggccatcccgacccacggcgtctccggcggcaccaccgagctggagggcgtcgtgttcgagatcgtcatcaccttcgcgctcgtgtacaccgtgtacgccaccgccgccgaccccaagaagggctccctcggcaccatcgcgcccatcgccatcggcttcatcgtcggcgccaacatcctcgccgcggggcccttcagcggcggctccatgaaccccgcccgctccttcggccccgccgtcgccgcggccgacttcgccggcaactgggtctactgggtcggcccgctcatcggcggcggactcgctggcctcgtctacggcgacgtcttcatcggcggctcctaccagcaggtcgccgaccaggactacgcctaa

SEQ ID NO: 1231 - protein, 250 aa, Zea mays
MVKLAFGSVGDSFSATSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 1232 - DNA, 771 bp, Linum usitatissimum
  CDS (1)..(771)
atgcctagaagatacggatttgggagagcggaagaggccacccaccctgattccttcagagctactctagctgaactcgtttctactttcatctttgtctttgctggggaaggctccggtcttgctcttgacaagctgtaccaggaaacaggcccccctgcttctggactggtgatgattgcacttgcgcatgcactagcactcttcgccgcagtagcatccagcatcaacgtctccggtggacatgtcaatccagctatcacctttgctgctcttcttggaggaaggatttcggtcgtccgagccatatattactggattgctcagcttctcggctccatcgtcgcctccctcttgctccgccttgtcaccaacgggatgaggccggtcgggttctacgtgcactccgaagtgagcgaggtggaaggattgatactcgaaatcgcgctgacgttcgggctagtttacacggtttacgcgactgcaatcgatcccaagagagggagcatcgggatcatggcgcccctggcgatcgggttgatcgtcggggcaaacatcttggtcggagggccgttcgatggtgcagcaatgaatccagccagagcattcgggccaacattggtcgggtggagatggaagaaccactggatctactggttgggtcctttccttggtgcgggtttggcagcgattgtttacgagttcttggttatccccactgagccaacaattcatacccatcatcagcctttggctcctgaagactactaa

SEQ ID NO: 1233 - protein, 256 aa, Linum usitatissimum
MPRRYGFGRAEEATHPDSFRATLAELVSTFIFVFAGEGSGLALDKLYQETGPPASGLVMIALAHALALFAAVASSINVSGGHVNPAITFAALLGGRISVVRAIYYWIAQLLGSIVASLLLRLVTNGMRPVGFYVHSEVSEVEGLILEIALTFGLVYTVYATAIDPKRGSIGIMAPLAIGLIVGANILVGGPFDGAAMNPARAFGPTLVGWRWKNHWIYWLGPFLGAGLAAIVYEFLVIPTEPTIHTHHQPLAPEDY

SEQ ID NO: 1234 - DNA, 747 bp, Zea mays
  CDS (1)..(747)
atggtgaagctcgcatttggaagctttcgcgactctttgagcgccgcgtcgctcaaggcctatgtggccgagttcattgccacgctgctcttcgtgttcgccggcgtcgggtccgccattgcctactcgcaattgacgaagggcggcgctctggaccccgccggcctggtggccatcgccatcgcccatgcgttcgcgctcttcgtcggcgtctccatggccgccaacatctccggcggccacctgaaccccgccgtcaccttcggcctcgccgtcggcggccacatcaccatcctcaccggcatcctctactgggttgcccagcttctcggcgcttccgtggcgtgctttctcctgcagtacgtcacccacggacaggctatcccgacgcacggcgtctccgggatcagcgagatcgagggcgtggtgatggagatcgtgatcaccttcgcgctggtgtacaccgtgtacgccaccgcggccgacccgaagaaggggtccctgggcaccatcgcgcccatggccatcggcttcatcgtcggcgccaacatcctggccgccggccccttcagcggcggctccatgaacccggcccgctccttcggccccgccgtggcggccggtaacttcgccggcaactgggtgtactgggtcggccccctcgtcggcggtggcctggcggggctcgtctacggcgacgtgttcatcgcctcctaccagccggtcggccagcaggagtacccatga

SEQ ID NO: 1235 - protein, 248 aa, Zea mays
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGLAGLVYGDVFIASYQPVGQQEYP

SEQ ID NO: 1236 - DNA, 747 bp, Hordeum vulgare
  CDS (1)..(747)
atgccaggctccatcgcctttggtcgcttcgatgactccttcagcgtggcctctctcaaggcctacgtcgccgagttcatctccaccctcatcttcgtcttcgccggcgtcggctctgccattgcctacaccaaggtgagcggcggcgcgccccttgacccatccgggctgattgccgtggcgatctgccacgggttcgggctgttcgtcgcggttgccatcggcgccaacatctccggcggccacgtgaaccctgccgtcaccttcggcctcgcgctcggcggtcagatcaccatcctcaccggcctcttctactgggttgcgcagctcctcggtgccatcgtcggcgccttcctcgtccagttctgcaccggcgtggcgacccctacacacgggctttccggcgtgggcgcttttgagggcgtggtgatggagatcatcgtcaccttcgggctcgtctacaccgtgtacgccaccgccgccgaccccaagaagggatccctcggcaccatcgcccccatcgccatcggcttcatcgtcggggccaacatcctcgttgccggccccttctccggcggttccatgaaccctgcacgctcattcggccccgccgttgccagcggcgacttcaccaacatctggatctactgggccggcccgctcatcggcggtggcctcgccggcatcgtctaccggtacctgtacatgtgcgacaaccacacccccgtcgccagcaacgactactaa

SEQ ID NO: 1237 - protein, 248 aa, Hordeum vulgare
MPGSIAFGRFDDSFSVASLKAYVAEFISTLIFVFAGVGSAIAYTKVSGGAPLDPSGLIAVAICHGFGLFVAVAIGANISGGHVNPAVTFGLALGGQITILTGLFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWIYWAGPLIGGGLAGIVYRYLYMCDNHTPVASNDY

SEQ ID NO: 1238 - DNA, 762 bp, Hordeum vulgare
  CDS (1)..(762)
atgccgaccagaaacatcgccattggtggagtccaagaagaggtctatcaccccaacgcacttagggcggcgctcgctgagtttatctcgactttgatcttcgtcttcgccggctcaggctccggaattgctttcaacaagatcactgacaatggagccaccactccttccggcctcgtcgccgctgccttagctcatgctttcggtctctttgtcgctgtctctgttggcgctaacatttccggtggccacgttaaccctgccgttaccttcggtgtcttactcggtggtaacatcactctcctccgtggtattctctactggattgctcagcttcttggctccgtcgccgcttgtttcctccttagctttgccaccggtggcgagccaattccagcgttcggtctctctgccggagtcggatcattaaacgctctcgtcttcgagatcgtgatgaccttcgggctcgtctacaccgtctacgccacagccgttgaccccaagaacggtagtctcggaacaatcgcaccaatcgccataggtttcatcgttggagctaacatcctcgctggtggagctttcagcggagcttccatgaacccagccgttgctttcggaccagccgtcgtaagctggacgtggaccaaccactgggtttactgggctggtcctcttattggtggtggactcgccggaattatctacgactttgtcttcatcgatgaaaatgcccacgagcaattgcctaccaccgattactga

SEQ ID NO: 1239 - protein, 253 aa, Hordeum vulgare
MPTRNIAIGGVQEEVYHPNALRAALAEFISTLIFVFAGSGSGIAFNKITDNGATTPSGLVAAALAHAFGLFVAVSVGANISGGHVNPAVTFGVLLGGNITLLRGILYWIAQLLGSVAACFLLSFATGGEPIPAFGLSAGVGSLNALVFEIVMTFGLVYTVYATAVDPKNGSLGTIAPIAIGFIVGANILAGGAFSGASMNPAVAFGPAVVSWTWTNHWVYWAGPLIGGGLAGIIYDFVFIDENAHEQLPTTDY

SEQ ID NO: 1240 - DNA, 747 bp, Helianthus annuus
  CDS (1)..(747)
atgcctggaattgcctttggtagttttgatgattccttcagctccagctccatcaaagcctacattgctgagttcatctccactttgctcttcgtcttcgcgggtgtcggttctgctatcgcttatgcgaaactaacggcggatgctgccttagacccatctggtctagtagctatcgcggtttgccatgggcttgctctctttgtggcggtttctatcgcggctaacatctctggcggtcatgtgaacccagctgtcacctttggattggccgttggcggccagatcaccatcctaacgggcttgttttactggattgctcaactccttggctccgttgccgcatgcttcctcctcagtttcgtcactggaggcctggctgtccctacacacggtgttgcggcaggcgttggagtgctacaaggggtagtttttgaaatcattatcacatttgcgttggtgtacactgtttacgccaccgcatgtgacccaaagaagggcgcactaggcacaattgccccaattgcaatcgggttcatcgtgggtgccaatatcttggctgctggcccattctcaggtggatcaatgaacccagcccgatctttcgggccagccgtggctgcctttgacttctccggacactggatctactgggtcggacctctcattggcggtggcttagccggtgctatttacccgaatgtgttcatttccaatgaacatattcccctcaccaatgactactaa

SEQ ID NO: 1241 - protein, 248 aa, Helianthus annuus
MPGIAFGSFDDSFSSSSIKAYIAEFISTLLFVFAGVGSAIAYAKLTADAALDPSGLVAIAVCHGLALFVAVSIAANISGGHVNPAVTFGLAVGGQITILTGLFYWIAQLLGSVAACFLLSFVTGGLAVPTHGVAAGVGVLQGVVFEIIITFALVYTVYATACDPKKGALGTIAPIAIGFIVGANILAAGPFSGGSMNPARSFGPAVAAFDFSGHWIYWVGPLIGGGLAGAIYPNVFISNEHIPLTNDY

SEQ ID NO: 1242 - DNA, 747 bp, Helianthus annuus
  CDS (1)..(747)
atgcctggaattgcatttggtagttttgatgattcctttagcttgagctccatcaaatcctacattgccgagttcatctccacccttctcttcgtctttgcgggtgtcggctccgccattgctttcgccaagttgacagcggatgctgaccttgatccagccggtctggtggctatcgcggtctgccatggactcgcactctttgtcgcggtctccatcgccgccaacatctctggtggccatgtcaatccagctgtcaccttcggattggctgttggcggtcaaatcaccatcctaactggcatcttttactggattgcccaatgcattggctccatcgccgcatgctaccttcttagcttcgtcactggaggcttggcggtgcctacccatgcggttgctgctggtgttggagctatccaaggagtagtgatggaaatcattatcacatttgcattggtgtacaccgtttacgccaccgcagttgaccccaagaagggcgatttgggcacaatcgcgccgcttgccattggtctcattgtaggtgccaacattttggccgccggtccattctctggtggatcaatgaacccggcccgatccttcggtcctgctgtggccgctggtgatttctccggccactggatctactgggttggacctctcgttggtggtggcttagccggagcaatttacagcaatgtgtttattagtaatgaacatgctcccctttccagcgagttttaa

SEQ ID NO: 1243 - protein, 248 aa, Helianthus annuus
MPGIAFGSFDDSFSLSSIKSYIAEFISTLLFVFAGVGSAIAFAKLTADADLDPAGLVAIAVCHGLALFVAVSIAANISGGHVNPAVTFGLAVGGQITILTGIFYWIAQCIGSIAACYLLSFVTGGLAVPTHAVAAGVGAIQGVVMEIIITFALVYTVYATAVDPKKGDLGTIAPLAIGLIVGANILAAGPFSGGSMNPARSFGPAVAAGDFSGHWIYWVGPLVGGGLAGAIYSNVFISNEHAPLSSEF

SEQ ID NO: 1244 - DNA, 750 bp, Brassica napus
  CDS (1)..(750)
atgaagaagatcgacttggggaaccaccgcgaggcggctcagccggagtgcatcaaagctctcattgtcgaattcatcaccacctttttctttgttttcgccggcgtcggatccgccatggccacagacagcttagtcggaaacactttggtgggacttttggcggtcgcggtggctcatgcccttgtggtggcggttatgatatctgcgggccatatctccggtggtcacctcaatcccgctgtcaccatcggcctacttttcggaggtcacatcagcgtcttccgcgcattcctctattggattgatcagctgttggcctcctccgcagcctgcttcctcttaagttaccttactggaggaatgggaactccggttcacactttggcaagtggaatcagctacacccagggaatcgtatgggagatcatcttaacattctcacttctcttcactgtctacgccacgatggtggatcccaagaaaggctcccttgatgggctaggcccacttctcacaggattcgtcgtcggagccaacatccttgccggtggcgccttctctggagcctcaatgaacccggccagatcatttggacctgctttggtctctgggaactggactgaccattgggtatattgggttggaccgttgatcggtggtggacttgcaggattcatctacgagaacgtcctcattgaccgttcagatgccccactcgccgacgacgagcaaccattcctaaattga

SEQ ID NO: 1245 - protein, 249 aa, Brassica napus
MKKIDLGNHREAAQPECIKALIVEFITTFFFVFAGVGSAMATDSLVGNTLVGLLAVAVAHALVVAVMISAGHISGGHLNPAVTIGLLFGGHISVFRAFLYWIDQLLASSAACFLLSYLTGGMGTPVHTLASGISYTQGIVWEIILTFSLLFTVYATMVDPKKGSLDGLGPLLTGFVVGANILAGGAFSGASMNPARSFGPALVSGNWTDHWVYWVGPLIGGGLAGFIYENVLIDRSDAPLADDEQPFLN

SEQ ID NO: 1246 - DNA, 753 bp, Brassica napus
  CDS (1)..(753)
atggtgaagattgcaattggaagtttaggtgattcctttaccgttgcgtctctaaaggcttacttatctgagtttatcgcaactcttcccttcgtgtttgccggcgttggttctgctattgcttttggcaaactaacatccaatgcggccctggacccagctggtcttgtcgctgtggccgtggctcacgcctttgctcttttcatcggtgtgtccatagccgccaacatctccggtggacaccttaacccagccgtgactctcggcctcgcagtcggcggtaacatcactgtcatcaccggtttcttttactggatagctcagtgccttggctccatcgtcgcttgtctcctcctagccttcgttactaatggcgagagcgtaccgacccatggagtagcagccggtttaggagcggttgaaggaatagtgatggagattgtggtgacatttgctctggtgtacacagtttacgccaccgcagctgatccgaagaagggatcgcttggaaccattgctcctattgccattggtttcatcgttggtgccaacatccttgccgccggtccattcagcggaggctctatgaaccccgccaggtcatttggaccagctgttgttagtggtgacttctctcagatatggatccactgggtaggcccacttgtcggcggtgcactagctggactcatctacggtgacgtcttcaccggatcctacgcaccggctccgaccacagaaagctacccttga

SEQ ID NO: 1247 - protein, 250 aa, Brassica napus
MVKIAIGSLGDSFTVASLKAYLSEFIATLPFVFAGVGSAIAFGKLTSNAALDPAGLVAVAVAHAFALFIGVSIAANISGGHLNPAVTLGLAVGGNITVITGFFYWIAQCLGSIVACLLLAFVTNGESVPTHGVAAGLGAVEGIVMEIVVTFALVYTVYATAADPKKGSLGTIAPIAIGFIVGANILAAGPFSGGSMNPARSFGPAVVSGDFSQIWIHWVGPLVGGALAGLIYGDVFTGSYAPAPTTESYP

SEQ ID NO: 1248 - DNA, 861 bp, Brassica napus
  CDS (1)..(861)
atggaaggcaaggaagaagatgttagagtcggagctaacaaattccccgagagacaacccatcggaacatcggctcagagcgacaaagactacaaggagccgcctcctgcgccgttgttcgagcccggcgagctcgcgtcgtggtccttctggagagccggaatcgccgagttcatcgccacgtttctctttctttacataactgtgttgaccgtcatgggtgtcaagaggtcaccgagcatgtgtgcttccgtcggaatccaaggcatcgcttgggctttcggtggtatgatcttcgctctcgtctactgtaccgctggtgtctccggtggacacatcaacccagcagtcacgttcggtctgttcttggctcggaagctttcactcacacgagctgtgtactatatagtgatgcagtgcttaggagccatctgtggagccggtgtggtcaaggggttccaaccaaagcagtaccaagctctaggaggtggagctaacaccgtagctcctggctacaccaaaggaagtggtctcggtgctgagattattggaacctttgtgctagtttacaccgtcttctccgctactgacgctaagagaaacgctcgtgactctcatgttcctattcttgcacctctcccaatcggattcgctgtgttcttggtccacttggcaaccatcccaatcactggaactggaatcaacccagcaagaagtcttggagctgcaatcatcttcaacaaggacaatgcttgggacgaccattgggtgttttgggttggaccattcatcggcgctgcacttgctgctctttaccacgtgatagtcatcagagccatcccattcaagtccagaagctga

SEQ ID NO: 1249 - protein, 286 aa, Brassica napus
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGVSGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1250 - DNA, 747 bp, Brassica napus
  CDS (1)..(747)
atggcaggagttgcctttggttcttttgatgattctttcagcttggcttctctaagagcttacctcgctgagttcatctccactttgctctttgttttcgctggtgttggttccgccattgcctacgcgaagctgacgtcagatgcggctcttgatacgccggggcttgtcgccatcgctgtgtgccatggtttcgccctcttcgtggcggttgcaatcggagccaacatctccggtggccatgtgaacccagccgtcacttttggccttgctgtcggtggtcaaatcacactaatcaccggagttttctactgggtggctcagcttctcggctctaccgccgcttgcttccttcttaaatacgtcaccggtggtttggcagttccaacccacagcgttgctgctggagtaggagcgatagaaggagtagtgatggagatcatcatcaccttcgctttggtctacaccgtctatgccactgccgctgatcccaagaaaggttctcttggaaccatcgctcctctggccattggtctaatcgtcggtgccaacatcctcgctgctggtccattctccggtggatccatgaacccagcacgttcctttggaccagctgttgcagcaggagacttctctggtcactgggtctactgggtcggaccactcatcggtggtggactcgctggaattacctacggaaatgtcttcatgacttccgaacatgtccctcttgcttctgacttctaa

SEQ ID NO: 1251 - protein, 248 aa, Brassica napus
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASDF

SEQ ID NO: 1252 - DNA, 861 bp, Brassica napus
  CDS (1)..(861)
atggaaggcaaggaagaagacgttagggttggagctaacaagttcccggagagacaaccaataggaacttcagctcagagcgacaaggactacaacgagccaccaccagcgccgcttttcgagcctggtgagctttcttcatggtccttctggcgagctggtatcgctgaatttatagctactttcctcttcctctacatcactgttttgaccgtcatgggagttaaaaggtcaccgaacatgtgtgcttccgtcggaatccaaggtatcgcttgggccttcggtggtatgatctttgctcttgtctactgcaccgccggtatctccggtggacacatcaacccagcggtcacttttggtctgttcttggcccggaagctgtcgctcaccagagctgtgtactacatagtgatgcagtgcttgggagccatatgtggagctggtgtggtgaagggtttccaacctaagcaataccaagctctaggaggtggagccaacactgtagctcctggttacaccaaaggaagtggtcttggagctgagattattggaacctttgtcctcgtttacaccgtcttttccgccactgacgccaagagaaacgctcgtgactctcatgttccgattcttgcacctctccctattggattcgctgtgttcttggtccacttggcaaccatccccatcactggaactggaatcaacccagcaagaagtcttggtgctgccatcatcttcaacaaggacaacgcttgggatgaccattgggtcttctgggttggaccattcatcggtgctgcacttgctgctctgtaccacgtgatcgtcatcagagccatcccattcaagtccagaagctga

SEQ ID NO: 1253 - protein, 286 aa, Brassica napus
MEGKEEDVRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1254 - DNA, 861 bp, Brassica napus
  CDS (1)..(861)
atggagggcaaggaagaagatgttagagtcggagctaacaaattccccgagagacaacccatcggaacatcggctcagagcgacaaagactacaaggagccgcctcctgcgccgttgttcgagcccggcgagcttgcgtcgtggtccttctggagagccggaatcgccgagttcatcgccacgtttctctttctttacataactgtgttgaccgtcatgggtgtcaagaggtcaccgagcatgtgtgcttctgtcggaatccaagggatcgcttgggctttcggtggtatgatcttcgctctcgtctactgtaccgctggtgtctccggtggacacatcaacccagcagtcacgttcggtctgttcttggctcggaagctttcactcacacgagctgtgtactatatagtgatgcagtgcttaggagccatctgtggagccggtgtggtcaaggggttccaaccaaagcggtaccaagctctaggaggtggagctaacaccgtagctcctggctacaccaaaggaagtggtctcggtgctgagattattggaacctttgtgctagtttacaccgtcttctccgcaactgacgctaagagaaacgctcgtgactctcatgttcctattcttgcacctcttccaatcggattcgctgtgttcttggtccacttggcaaccatcccaatcactggaactggaatcaacccagcaagaagtcttggagctgcaatcatcttcaacaaggacaatgcttgggacgaccattgggtgttttgggttggaccattcatcggcgctgcacttgctgctctttaccacgtgatagtcatcagagccatcccattcaagtccagaagctga

SEQ ID NO: 1255 - protein, 286 aa, Brassica napus
MEGKEEDVRVGANKFPERQPIGTSAQSDKDYKEPPPAPLFEPGELASWSFWRAGIAEFIATFLFLYITVLTVMGVKRSPSMCASVGIQGIAWAFGGMIFALVYCTAGVSGGHINPAVTFGLFLARKLSLTRAVYYIVMQCLGAICGAGVVKGFQPKRYQALGGGANTVAPGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 1256 - DNA, 750 bp, Brassica napus
  CDS (1)..(750)
atggctggagttgcctttggttcttttgatgattctttcagcttggcttctctaagagcttacctcgctgagttcatctccactttgctctttgttttcgctggtgttggttccgccattgcctacgcgaaactgacgtctgatgcggctcttgatacgccgggacttgtcgccattgctgtgtgccatggtttcgctctcttcgtggcggttgcaatcggagccaacatctccggtggccatgtgaacccagccgtcacttttggccttgctctcggtggtcaaatcacactcattaccggagttttctactggatcgctcagcttctcggctccaccgccgcttgcttccttcttaagttcgttaccggtggcttggcggttccaacacacagcgttgcggctggagtaggagccattgaaggagtagtgatggagatcatcatcaccttcgctttggtctacacagtctatgccaccgccgctgatcccaagaaaggttctcttggaaccatcgctcctctggccattggtcttatcgttggtgccaacatcctcgccgctggtccattctcaggtggatccatgaacccagcacgttcctttggaccagctgttgcagctggagacttctctggtcactgggtctactgggtgggaccactcatcggtggtggactcgctggacttgtttacggaaatgtcttcatgccttcttcagaacatgttcctcttgcctctgaattctaa

SEQ ID NO: 1257 - protein, 249 aa, Brassica napus
MAGVAFGSFDDSFSLASLRAYLAEFISTLLFVFAGVGSAIAYAKLTSDAALDTPGLVAIAVCHGFALFVAVAIGANISGGHVNPAVTFGLALGGQITLITGVFYWIAQLLGSTAACFLLKFVTGGLAVPTHSVAAGVGAIEGVVMEIIITFALVYTVYATAADPKKGSLGTIAPLAIGLIVGANILAAGPFSGGSMNPARSFGPAVAAGDFSGHWVYWVGPLIGGGLAGLVYGNVFMPSSEHVPLASEF

SEQ ID NO: 1258 - DNA, 861 bp, Brassica napus
  CDS (1)..(861)
atggaaggcaaggaagaagacgttagggttggagctaacaagttcccggagagacaaccaataggaacttcagctcagagcgacaaggactacaacgagccaccaccagcgccgcttttcgagcctggtgagctttcttcatggtccttctggcgagctggtatcgctgaatttatagctactttcctcttcctctacatcactgttttgaccgtcatgggagttaaaaggtcaccgaacatgtgtgcttccgtcggaatccaaggtatcgcttgggccttcggtggtatgatctttgctcttgtctactgcaccgccggtatctccggtggacacatcaacccagcggtcacttttggtctgttcttagcccggaagctgtcgctcaccagagctctgtactacatagtgatgcagtgcttgggagccatatgcggagctggtgtggttaaagggttccagcctaaccaataccaggctctaggaggaggagccaacactgtggctcctggatacaccaaaggaagtggtcttggagctgagatcatcggtacattcgtccttgtttacacagtcttctcagccactgacgccaagagaaacgcacgtgactctcatgttcccattcttgcaccactcccaatcgggtttgcggttttcttggttcacttagcaaccatcccaatcactggcacaggcatcaacccggctagaagtcttggagctgcaatcatctacaacaaagaccattcctgggacgaccactgggtgttttgggttggacccttcattggtgctgcacttgctgctctttaccatgtgattgtcatcagagcaatccccttcaagtccagaaactaa

SEQ ID NO: 1259 - protein, 286 aa, Brassica napus
MEGKEEDVRVGANKFPERQPIGTSAQSDKDYNEPPPAPLFEPGELSSWSFWRAGIAEFIATFLFLYITVLTVMGVKRSPNMCASVGIQGIAWAFGGMIFALVYCTAGISGGHINPAVTFGLFLARKLSLTRALYYIVMQCLGAICGAGVVKGFQPNQYQALGGGANTVAPGYTKGSGLGAEIIGTFVLVYTVFSATDAKRNARDSHVPILAPLPIGFAVFLVHLATIPITGTGINPARSLGAAIIYNKDHSWDDHWVFWVGPFIGAALAALYHVIVIRAIPFKSRN

SEQ ID NO: 1260 - DNA, 756 bp, Brassica napus
  CDS (1)..(756)
atggtgaagatcgaagttggaagtgtgggtgactcgttcagtgttgcatctctaaaggcttacttgtctgagtttatcgcaactcttatctttgtattcgctggcgttggctcagctattgcctttggcaaactgacttccgatgccgccttggacccagctggtcttgtggctattgcggtggctcacgcgtttgccttatttgttggagtttccattgcggctaacatctctggtggccaccttaaccctgccgtgactctcggtcttgccgttggcggaaacataacactgatcacgggtttcttatactggatcgctcagtgtcttggctccatcgttgcttgccttctccttgtctatgttaccaacggcgagagcgtaccaacccacggagtcggagccggtttgggagcactcgaaggtatcgtgatggagatcattgtgacatttgctttgatctacaccgtttacgccacagctgctgatccaaagaaaggatcgctcggaaccatcgcaccaatcgctattggtttcatcgttggtgccaacatcctcgctgctggtccatttagtggtggctccatgaacccagcaaggtcgttcggaccagctattgtcagtggagacttgtcacaaatctggatatactgggtgggtccactcgttggtggtgcacttgctggactcatctacggagacgtgttcataggttctccttacgaagctgttgaaacccgcgagatccgagtttaa

SEQ ID NO: 1261 - protein, 251 aa, Brassica napus
MVKIEVGSVGDSFSVASLKAYLSEFIATLIFVFAGVGSAIAFGKLTSDAALDPAGLVAIAVAHAFALFVGVSIAANISGGHLNPAVTLGLAVGGNITLITGFLYWIAQCLGSIVACLLLVYVTNGESVPTHGVGAGLGALEGIVMEIIVTFALIYTVYATAADPKKGSLGTIAPIAIGFIVGANILAAGPFSGGSMNPARSFGPAIVSGDLSQIWIYWVGPLVGGALAGLIYGDVFIGSPYEAVETREIRV

SEQ ID NO: 1262 - DNA, 747 bp, Brassica napus
  CDS (1)..(747)
atggctggagttgcctttggttcttttgatgattctttcagcttggcttctctaagagcttacctcgctgagttcatctccactttgctctttgttttcgctggtgttggttccgccattgcctacgcgaagctgacgtcagatgcggctcttgatacgccggggcttgtcgccatcgctgtgtgccatggtttcgccctcttcgtggcggttgcaatcggagccaacatctccggtggccatgtgaacccagccgtcacttttggacttgctctcggtggtcaaatcacactcatcaccggagttttctactggattgctcagcttctcggctccaccgccgcttgcttccttcttaagttcgtcaccggtggattggcggttccaactcacagcgttgcggctggactaggagcgatagaaggagtagtgatggagatcatcatcaccttcgctttggtctacaccgtctatgccactgccgctgatcccaagaaaggttctcttggaaccatcgctcctctggccattggtctaatcgtcggtgccaacatcctcgctgctggtccattctccggtggatccatgaacccagcacgttcctttggaccagctgttgcagcaggagacttctctggtcactgggtctactgggtcggaccactcatcggtggtggactcgctggaattacctacggaaatgtcttcatgacttccgaacatgtccctcttgcttctgacttctaa

SEQ ID NO: 1263 - protein, 248 aa, Brassica napus
MAGVAFGSFDDSFSLASLRAYLAEFISTLLFVFAGVGSAIAYAKLTSDAALDTPGLVAIAVCHGFALFVAVAIGANISGGHVNPAVTFGLALGGQITLITGVFYWIAQLLGSTAACFLLKFVTGGLAVPTHSVAAGLGAIEGVVMEIIITFALVYTVYATAADPKKGSLGTIAPLAIGLIVGANILAAGPFSGGSMNPARSFGPAVAAGDFSGHWVYWVGPLIGGGLAGITYGNVFMTSEHVPLASDF

SEQ ID NO: 1264 - DNA, 768 bp, Zea mays
  CDS (1)..(768)
atggcgaagctcatgaacaagttggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggcaatcgcgcacgcgctggccgctggcgtcctggtgacggccgggttccacgtctccggcggccacctgaaccccgcggtgacggtggggctcatggtgcgcggccacatcaccaagctccgggcggtgctgtacgtcgccgcccagctgctggcctcctccgccgcctgcgtcctcctccgcttcctcagcggcggcatggtgaccccggtgcacgccctgggcaggggcatcagcccgatgcagggcctggtgatggaggtcatcctcaccttctccctgctcttcgtcacctacgccatgatcctggacccgcggagccaggtccgcgccatcggcccgctgctgacgggcctcatcgtcggcgccaacagcctcgccggcggcaacttcaccggcgcgtccatgaacccggcacgctccttcggcccggccctggccaccggggactggacaaaccactgggtctactggatcggcccgctgctcggcgggcccctggcaggcttcgtgtacgagtcgctgttcctggtgcagaagatgcacgagccgctgctcaatggggaagtctga

SEQ ID NO: 1265 - protein, 255 aa, Zea mays
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVRAIGPLLTGLIVGANSLAGGNFTGASMNPARSFGPALATGDWTNHWVYWIGPLLGGPLAGFVYESLFLVQKMHEPLLNGEV

SEQ ID NO: 1266 - DNA, 759 bp, Glycine max
  CDS (1)..(759)
atgccgatttctagaattgccattggaaatccttcagagtttggccaagcggatgcgcttaaggctgctcttgctgagttcatctcaatgctaatatttgtctttgcaggagaaggctctggcatggcatataacaaactcacagacaatggttcggcaacaccagctggggtggtggcagcatccctgtctcatgcatttgctctttttgttgcggtctctgttggtgctaacatctcaggtgggcatgttaaccctgctgtcacatttggtgcctttattggtggccacatatccctcctcagaggcattctgtactggattgctcagttgcttggttctgtagttgcttgcttgctccttaaatttgccactggtggattggaaacatctgcgttctcattgtctcctggggtgggagccgcaaatgcacttgtttttgagattgtgatgacttttggtttggtttacacagtgtatgctactgcagtggacccaaagaagggtaaccttgggataatagctccaattgcaattggtttcattgttggtgctaacatcttggcaggtggtgcctttgatggtgcatccatgaacccagcagtttcttttggacctgctgttgttagcgggacatgggctaatcactgggtctactgggttggcccattaattggttccgctattgctgccattatatatgagacttttttcatcacccctaactcttatgaacatcttcctgtaacagattattag

SEQ ID NO: 1267 - protein, 252 aa, Glycine max
MPISRIAIGNPSEFGQADALKAALAEFISMLIFVFAGEGSGMAYNKLTDNGSATPAGVVAASLSHAFALFVAVSVGANISGGHVNPAVTFGAFIGGHISLLRGILYWIAQLLGSVVACLLLKFATGGLETSAFSLSPGVGAANALVFEIVMTFGLVYTVYATAVDPKKGNLGIIAPIAIGFIVGANILAGGAFDGASMNPAVSFGPAVVSGTWANHWVYWVGPLIGSAIAAIIYETFFITPNSYEHLPVTDY

SEQ ID NO: 1268 - DNA, 864 bp, Glycine max
  CDS (1)..(864)
atggagagcaaagaggaagatgtaagggttggagcaactaagttctcagaaaggcaaccaattggtacagcagctcagggtgacaaggactacaaagaaccacccccagcacctttgtttgagcctggtgagctaaagtcatggtccttctacagagctggaattgctgagtttgtggccactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctctttttggcaaggaagctgtccctcacaagggcgctgttctacattatcatgcagtgtcttggagccatctgtggggctggtgtggtgaagggatttgagggcaatgctaggtatgagatgttcaaaggtggagccaattttgtgaattctggatacaccaagggtgatggacttggagctgagattgttggcacttttgttcttgtctacaccgttttctctgccactgatgccaagagaaacgctagagactcacacgttcctattttggctccacttcccatcggatttgctgtgttcttggtccacttggctaccattcccatcacaggaactggcattaacccagctaggagtctcggagctgccatcatctacaacagagaccatgcatgggatgaccaatggattttctgggttggacctttcattggagctgcccttgctgctgtgtatcaccagatagtcatccgagccatccctttcaagacaagggcttag

SEQ ID NO: 1269 - protein, 287 aa, Glycine max
MESKEEDVRVGATKFSERQPIGTAAQGDKDYKEPPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNARYEMFKGGANFVNSGYTKGDGLGAEIVGTFVLVYTVFSATDAKRNARDSHVPILAPLPIGFAVFLVHLATIPITGTGINPARSLGAAIIYNRDHAWDDQWIFWVGPFIGAALAAVYHQIVIRAIPFKTRA

SEQ ID NO: 1270 - DNA, 870 bp, Glycine max
  CDS (1)..(870)
atggagagtaaagaggaagatgttaacgttggagcaaacaagttctcagaaaggcaaccaattggtacagcagctcagggtggtggtgacaaggactacaaggaggcacccccagctcctttgtttgaacctggtgagctcaaatcatggtccttctacagagctggaattgctgagtttgtggcaactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctgtttttggcaaggaagctgtccctaacaagggcactgttctacattatcatgcagtgtcttggagccatctgcggggctggtgtggtgaagggctttgagggcaatgctaactatgagttgttcaaaggaggagccaattttgtgaattctggatacaccaaaggtgatggacttggagctgagattgttggcacttttgttcttgtctacaccgttttctctgccactgatgccaagagaaacgctagagactctcacgttcctattttggctccacttcccattggatttgctgtgttcttggtccacttggctaccattcccatcacaggaactggcattaacccagctaggagtctcggagctgccatcatctacaacagagaccatgcatgggatgaccaatggattttctgggttggacctttcattggagctgcccttgctgctgtgtatcaccagatagtcatccgagccattcctttcaagacaagggcttag

SEQ ID NO: 1271 - protein, 289 aa, Glycine max
MESKEEDVNVGANKFSERQPIGTAAQGGGDKDYKEAPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNANYELFKGGANFVNSGYTKGDGLGAEIVGTFVLVYTVFSATDAKRNARDSHVPILAPLPIGFAVFLVHLATIPITGTGINPARSLGAAIIYNRDHAWDDQWIFWVGPFIGAALAAVYHQIVIRAIPFKTRA

SEQ ID NO: 1272 - DNA, 747 bp, Glycine max
  CDS (1)..(747)
atgggtggcattgcattcggacgcttggatgattctttcagtttaacctcaatcaaggcctatattgctgagttccattcaaccttgctctttgtttttgccggtgttggttcagccatagcctatggtaagttgacatcagatgcagcacttgatcctgctgggttactggcagttgctatttgccacggttttgcactctttgttgcagtttctgttggtgccaacatctctggtggccatgtcaaccctgctgtgacttttggattggctcttggtggccacatcaccatcctcactggcttcttctactggattgcacagcttcttggctccatcgtggcatgttttcttctcaactatgtcacaggaggcttgccaactccaatccacagtgtggcttctggggttggagctgttgaaggagttgtgaccgagatcatcatcacatttggtttggtgtacacagtgtatgccacagcagcagaccctaagaagggatcattgggaaccattgcaccaattgccattggtttcattgttggtgccaacatcttggcagcagggccattctctggcggctcgatgaacccggcacgctcctttgggcctgcagttgttagtggtgacttccatgacaactggatctactgggttggacctcttattggtggtggtttggctggccttatctacggcaatgtcttcattcgctctgaccatgcacctctttccagtgaattttga

SEQ ID NO: 1273 - protein, 248 aa, Glycine max
MGGIAFGRLDDSFSLTSIKAYIAEFHSTLLFVFAGVGSAIAYGKLTSDAALDPAGLLAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 1274 - DNA, 870 bp, Glycine max
  CDS (1)..(870)
atggagggaaaagaggaagatgtttccttgggagctaacaaattctcagagaggcaaccgattggaactgcggctcagagccaagacgatggaaaggactacacagagccacccccggctccacttttcgagccctccgaactcacttcttggtccttctaccgagccggaatagccgagtttgtagccacttttctctttctctacataaccatcttaaccgtcatgggtgtcaataggtccagctccaagtgtgctactgttggcattcaaggcattgcttgggccttcggtggcatgatcttcgctctcgtttactgcactgctggcatctctgggggacacataaacccggctgtgacattcggattgttcttggcgaggaaattgtcgttgaccagggcgctgttctacatggtgatgcaggttctgggtgctatcgttggtgctggcgtggtgaaaggtttcgagggaaaaaccttctacggccaacacaacggtggtgccaactttgttgcccctggttacaccaaaggtgatggacttggtgctgagattgttggcactttcattcttgtctacaccgttttctctgccaccgatgccaagcgtagcgctagagactcacacgtccctattttggcacccttgccaattgggttcgctgtgttcttggtgcacttggccacaatcccaatcactggaactggtatcaaccctgcacgaagtctcggtgctgccatcatcttcaacaaagaccttggctgggatgatcactggatcttctgggttggacctttcgttggtgcagctcttgcggctctttaccaccaagttgtaatcagagccattcccttcaaatccagttaa

SEQ ID NO: 1275 - protein, 289 aa, Glycine max
MEGKEEDVSLGANKFSERQPIGTAAQSQDDGKDYTEPPPAPLFEPSELTSWSFYRAGIAEFVATFLFLYITILTVMGVNRSSSKCATVGIQGIAWAFGGMIFALVYCTAGISGGHINPAVTFGLFLARKLSLTRALFYMVMQVLGAIVGAGVVKGFEGKTFYGQHNGGANFVAPGYTKGDGLGAEIVGTFILVYTVFSATDAKRSARDSHVPILAPLPIGFAVFLVHLATIPITGTGINPARSLGAAIIFNKDLGWDDHWIFWVGPFVGAALAALYHQVVIRAIPFKSS

SEQ ID NO: 1276 - DNA, 864 bp, Glycine max
  CDS (1)..(864)
atggagagcaaagaggaagatgtaagggttggagcaactaagttctcagaaaggcaaccaattggtacagcagctcagggtgacaaggactacaaagaaccacccccagcacctttgtttgagcctggtgagctaaagtcatggtccttctacagagctggaattgctgagtttgtggccactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctctttttggcaaggaagctgtccctcacaagggcgctgttctacattatcatgcagtgtcttggagccatctgtggggctggtgtggtgaagggatttgagggcaatgctaggtatgagatgttcaaaggtggagccaattttgtgaattctggatacaccaagggtgatggacttggagctgagattgttggcacttttgttcttgtctacaccgttttctctgccattgatgccaagagaaacgctagagactcacacgttcctattttggctccacttcccatcggatttgctgtgttcttggtccacttggctaccattcccatcacaggaactggcattaacccagctaggagtttcggagttgccatcatctacaacagagaccatgcatgggatgaccaatggattttctgggttggacctttcattggagctgcccttgctgctgtgtatcaccagatagtcatccgagccatccctttcaagacaagggcttag

SEQ ID NO: 1277 - protein, 287 aa, Glycine max
MESKEEDVRVGATKFSERQPIGTAAQGDKDYKEPPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNARYEMFKGGANFVNSGYTKGDGLGAEIVGTFVLVYTVFSAIDAKRNARDSHVPILAPLPIGFAVFLVHLATIPITGTGINPARSFGVAIIYNRDHAWDDQWIFWVGPFIGAALAAVYHQIVIRAIPFKTRA

SEQ ID NO: 1278 - DNA, 861 bp, Glycine max
  CDS (1)..(861)
atggctaaagatgttgaggttcaagagcaaggaggagagtactctgcaaaagactaccatgaccctcctccagcacccttgttcgacccagaggagctcacacagtggtccttttatagagccctaatcgctgagttcatagcaacccttctcttcctttatgtcaccgtgctcaccattattggctacaaaaggcagactgatgccacgctaggtggcaccgagtgtgatggggttggcattttgggcatcgcttgggcctttggtggcatgatcttcatccttgtttactgcaccgccggtatttcaggaggacacataaacccggcggtgacattcgggctgttcctaggacgcaaggtttcgttgataagggcgttgttgtacatggtagcacagtgtgccggtgctatctgtggcactggattggccaaggggttccaaaaatcatactacaacaggtatggaggtggtgccaactctgttgctgatggctacaacaatggtactgctttgggtgctgagattattggtaccttcgttcttgtctacactgtcttctctgccactgaccctaagaggaacgctagggactcccatgttcctgtactggcaccacttcctattggatttgccgtgttcatggttcacttggctacaatcccaattactggtactggcattaacccagcaaggagtttcggagcagctgtaatctacaacaaggacaaaatctgggatgaccagtggatattctgggttggaccaattgttggagcagcagtggctgcattctaccaccaatacatccttagagcagcagctatcaaggctcttggatccttcagaagcaacgcttaa

SEQ ID NO: 1279 - protein, 286 aa, Glycine max
MAKDVEVQEQGGEYSAKDYHDPPPAPLFDPEELTQWSFYRALIAEFIATLLFLYVTVLTIIGYKRQTDATLGGTECDGVGILGIAWAFGGMIFILVYCTAGISGGHINPAVTFGLFLGRKVSLIRALLYMVAQCAGAICGTGLAKGFQKSYYNRYGGGANSVADGYNNGTALGAEIIGTFVLVYTVFSATDPKRNARDSHVPVLAPLPIGFAVFMVHLATIPITGTGINPARSFGAAVIYNKDKIWDDQWIFWVGPIVGAAVAAFYHQYILRAAAIKALGSFRSNA

SEQ ID NO: 1280 - DNA, 870 bp, Glycine max
  CDS (1)..(870)
atggagagtaaagaggaagatgttaacgttggagcaaacaagttctcagaaaggcaaccaattggtacagcagctcagggtggtggtgacaaggactacaaggaggcacccccagctcctttgtttgaacctggtgagctcaaatcatggtccttctacagagctggaattgctgagtttgtggcaactttcttgttcctctacattaccatcttaactgtcatgggtgtcaacaggtcaccctccaagtgtgcctctgttggcattcaaggcattgcttgggcctttggtggcatgatctttgcccttgtctactgcactgctggaatttcagggggacacatcaacccagctgtgacctttggtctctttttggcaaggaagctgtccctcacaagggcactgttctacattatcatgcagtgtcttggagccatctgtggggctggtgtggtgaagggatttgagggcaatgctagctatgagatgttcaaaggtggagccaattttgtgaattctggatacaccaagggtgatggacttggagctgagattgttggcacttttgttcttgtctacaccgttttctctgccactgatgccaagagaaacgctagagactctcacgttcctattttggctccacttcccattggatttgctgtgttcttggtccacttggctaccattcccatcacaggaactggcattaacccagctaggagtctcggagctgccatcatctacaacagagaccatgcatgggatgaccaatggattttctgggttggacctttcattggagctgcccttgctgctgtgtatcaccagatagtcatccgagccattcctttcaagacaagggcttag

SEQ ID NO: 1281 - protein, 289 aa, Glycine max
MESKEEDVNVGANKFSERQPIGTAAQGGGDKDYKEAPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNASYEMFKGGANFVNSGYTKGDGLGAEIVGTFVLVYTVFSATDAKRNARDSHVPILAPLPIGFAVFLVHLATIPITGTGINPARSLGAAIIYNRDHAWDDQWIFWVGPFIGAALAAVYHQIVIRAIPFKTRA

SEQ ID NO: 1282 - DNA, 861 bp, Glycine max
  CDS (1)..(861)
atggctaaagatgttgaggttcaagagcaaggaggagagtactctgccaaagactaccatgaccctcctccagcacctttgttcgacccagaggagctcacacagtggtccttctatagagccctcatcgctgagttcatagcaacccttctcttcctttatgtcactgtgctcaccattattggctacaaaaggcagactgatacaacggtaggtggcaccgactgtgatggggttggcattttgggcatcgcttgggcctttggtggcatgatcttcatccttgtttactgcaccgccggtatttcaggaggacacataaacccggcggtgacattcgggttgttcctaggacgcaaggtgtcgttgataagggcgttgttgtacatggtggcacagtgtgccggtgctatctgtggtactggattggccaaggggttccaaaaagcatactacaacaggtatggaggtggtgccaactctgttgctgatggctacaacaatggtactgctttgggtgctgagattattggtaccttcgttcttgtctacactgtcttctctgccactgaccctaagaggaacgctagggattcccatgttcctgtactggcgccacttcctattggatttgccgtgttcatggttcacttggctacaatcccaattactggtactggcattaacccagcaaggagtttcggagcagctgtaatctacaacgaagacaaaatctgggatgatcagtggatattctgggttggaccaattgttggagcagcagtggctgcattttaccaccaatacatccttagagcagcagctatcaaggctcttggatccttcaggagcaacgcttaa

SEQ ID NO: 1283 - protein, 286 aa, Glycine max
MAKDVEVQEQGGEYSAKDYHDPPPAPLFDPEELTQWSFYRALIAEFIATLLFLYVTVLTIIGYKRQTDTTVGGTDCDGVGILGIAWAFGGMIFILVYCTAGISGGHINPAVTFGLFLGRKVSLIRALLYMVAQCAGAICGTGLAKGFQKAYYNRYGGGANSVADGYNNGTALGAEIIGTFVLVYTVFSATDPKRNARDSHVPVLAPLPIGFAVFMVHLATIPITGTGINPARSFGAAVIYNEDKIWDDQWIFWVGPIVGAAVAAFYHQYILRAAAIKALGSFRSNA

SEQ ID NO: 1284 - DNA, 747 bp, Glycine max
  CDS (1)..(747)
atgggtggcattgcattcggacgcttggatgattctttcagtttaacctcaatcaaggcctatattgttgagttccattcaaccttgctcttcgtttttgccggtgttggttcagccatagcctatggtaagttgacatcagatgcagcacttgatcctgctgggttactggcagttgctatttgccacggttttgcactctttgttgcagtttctgttggtgccaacatctctggtggccatgtcaaccctgctgtgacttttggattggctcttggtggccacatcaccatcctcactggcttcttctactggattgcacagcttcttggctccatcgtggcatgttttcttctcaactatgtcacaggaggcttgccaactccaatccacagtgtggcttctggggttggagctgttgaaggagttgtgaccgagatcatcatcacatttggtttggtgtacacagtgtatgccacagcagcagaccctaagaagggatcattgggaaccattgcaccaattgccattggtttcattgttggtgccaacatcttggcagcagggccattctctggcggctcgatgaacccggcacgctcctttgggcctgcagttgttagtggtgacttccatgacaactggatctactgggttggacctcttattggtggtggtttggctggccttatctacggcaatgtcttcattcgctctgaccatgcacctctttccagtgaattttga

SEQ ID NO: 1285 - protein, 248 aa, Glycine max
MGGIAFGRLDDSFSLTSIKAYIVEFHSTLLFVFAGVGSAIAYGKLTSDAALDPAGLLAVAICHGFALFVAVSVGANISGGHVNPAVTFGLALGGHITILTGFFYWIAQLLGSIVACFLLNYVTGGLPTPIHSVASGVGAVEGVVTEIIITFGLVYTVYATAADPKKGSLGTIAPIAIGFIVGANILAAGPFSGGSMNPARSFGPAVVSGDFHDNWIYWVGPLIGGGLAGLIYGNVFIRSDHAPLSSEF

SEQ ID NO: 1286 - DNA, 753 bp, Zea mays
  CDS (1)..(753)
atggtgaagctcgcattcggaagcgtcggcgactccttcagcgtcacctccatcaaggcctacgtggcggagttcatcgccaccctcctcttcgtcttcgccggcgtgggttccgccatcgccttcgggcaactgacgaatggcggcgcgctggaccctgcgggactggtggcgatcgcggtggcgcacgcgctggccctcttcgtgggcgtctccgtggccgcgaacacctccggcggccacctgaaccccgccgtgacgttcggcctggccgtgggcggccacatcaccgtcctcaccggcctcttctactgggtggcccagctgctgggcgcgtccgtggcgtgcctgctcctcaggttcgtgacccacggcaaggccatcccgacgcacggcgtctccggcggcaccaccgagctggagggcgtggtgttcgagatcgtcatcaccttcgcgctcgtctacaccgtctacgccaccgccgccgaccccaagaagggctccctcggcaccatcgcgcccatcgccatcggcttcatcgtcggcgccaacatcctcgccgcggggcccttcagcggcggctccatgaaccccgcccgctccttcggccccgccgtcgccgcggccgacttcgccggcaactgggtctactgggtcggcccgctcatcggcggcggcctcgctggcctcgtctacggcgacgtcttcatcggcggctcctaccagcaggtcgccgaccaggactacgcctaa

SEQ ID NO: 1287 - protein, 250 aa, Zea mays
MVKLAFGSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIVGANILAAGPFSGGSMNPARSFGPAVAAADFAGNWVYWVGPLIGGGLAGLVYGDVFIGGSYQQVADQDYA

SEQ ID NO: 1288 - DNA, 795 bp, Zea mays
  CDS (1)..(795)
atgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgtcgcatctctttcggccgtgccgcggtatactggctcgcgcagatgctcggcgccgtggtcgcgtcgttgctgctaacgctcgtctccggcggcacgcgtcccgtgggcttcgggctcgtccgcggcgtccacgagcggcacgcgctcctgctagaggccgtcatgacgttcgggctcatgtacgccgtgtacgccaccgcggtggatcaccggagccggggcggcgcggtcgcgatcgcgcccctcgccatcggcttcgtcctgggcgcgaacatcctcgccggcggcccgttcgacggcgccgcgatgaacccggcgcgggcgttcgggcccgcgctcgtcggctggagctggcgccaccactgggtctactgggtcgggccactgatcggcgccgggctggctggcggcttgtacgagtttgtcatggttgagcaggagcccgaggcgccgctagctgcagttcctcggatgccagtggcctctgaggactactga

SEQ ID NO: 1289 - protein, 264 aa, Zea mays
MLPGRHPARRADATGTGPLLPDATRAVVAEFVATAMFVFAAEGSVYGLWKLYKDTATPGGLLAVAIAHTLALVAAVAVASNASGGHVNPAVTFGLLVGRRISFGRAAVYWLAQMLGAVVASLLLTLVSGGTRPVGFGLVRGVHERHALLLEAVMTFGLMYAVYATAVDHRSRGGAVAIAPLAIGFVLGANILAGGPFDGAAMNPARAFGPALVGWSWRHHWVYWVGPLIGAGLAGGLYEFVMVEQEPEAPLAAVPRMPVASEDY

SEQ ID NO: 1290 - DNA, 765 bp, Zea mays
  CDS (1)..(765)
atgcctgtgagcaggatcgccgtgggtgctccgggcgagctgtcccaccccgacaccgccaaggccgccgtcgccgagttcatctccatgctcatcttcgtcttcgccggctcaggatcgggcatggccttcagtaagctcacggacggcggcgccaccactcccgccggcctcatcgccgcgtctctggcgcacgccctcgccctcttcgtggccgtctccgtgggtgccaacatctccggcggccacgtgaaccctgccgtgaccttcggcgcctttgtgggcggcaacatcagcctcctcaaggccctggtctactgggtggcccagctcctgggctccgtcgtcgcctgcctcctcctcaagatcgccacgggcggcgcggccattggcgccttctcgctgtcggcgggcgtcggcgccatgaacgccgtggtgctggagatggtcatgaccttcggcctcgtgtacacggtgtacgccacggccgtggaccccaagaagggcgacctcggcgtcatcgcgcccatcgccatcggcttcatcgtcggcgccaacatcctggcggggggcgccttcgacggcgcctccatgaaccccgccgtctccttcggcccggccgtcgtcaccggcgtctgggagaaccactgggtgtactgggtcggcccactcgcgggcgcggccatcgcggcgctcgtctacgacatcatcttcatcgggcagcgcccacaccagcagctgccaaccacggcagcagactactga

SEQ ID NO: 1291 - protein, 254 aa, Zea mays
MPVSRIAVGAPGELSHPDTAKAAVAEFISMLIFVFAGSGSGMAFSKLTDGGATTPAGLIAASLAHALALFVAVSVGANISGGHVNPAVTFGAFVGGNISLLKALVYWVAQLLGSVVACLLLKIATGGAAIGAFSLSAGVGAMNAVVLEMVMTFGLVYTVYATAVDPKKGDLGVIAPIAIGFIVGANILAGGAFDGASMNPAVSFGPAVVTGVWENHWVYWVGPLAGAAIAALVYDIIFIGQRPHQQLPTTAADY

SEQ ID NO: 1292 - DNA, 879 bp, Triticum aestivum
  CDS (1)..(879)
atggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctggtccttctaccgggcggggatcgccgagttcctggccaccttcctcttcctctacatctcggtgctcaccgtgatgggcgtggtgggcaacccgtccgggtccaagtgcggcacggtcggcatccagggcatcgcctggagcttcggcggcatgatcttcgtgctcgtctactgcaccgccggcatctccggcggccacatcaaccccgcggtcaccttcgggctgttcctggccaggaagctgtcgctcaccagggccgtgttctacatcgtgatgcagtgcctgggcgccatatgcggcgccggcgtggtgaaggggttccagaccacgctgtaccagggcaacggcggcggcgccaactccgtcgcgcccgggtacaccaagggggacgggctcggcgccgagatcgtcggcacgttcgtgctggtgtacaccgtcttctccgccaccgacgccaagcgcagcgccagagactcccacgtccccatcctggcgccgcttccgatcgggttcgcggtgttcctggtgcacctggcgacgatccccatcacggggaccggcatcaacccggcgaggtccctcggcgccgccatcatctacaacaagaagcaggcgtgggacgaccactggatcttctgggtgggcccgttcatcggcgcggcgctggcggccatctaccacgtggtggtgatccgggccatccccttcaagagccgcgactag

SEQ ID NO: 1293 - protein, 292 aa, Triticum aestivum
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 1294 - DNA, 765 bp, Zea mays
  CDS (1)..(765)
atgcctgtgagcaggatcgccgtgggtgctccgggcgagctgtcccaccccgacaccgccaaggccgccgtcgccgagttcatctccacgctcatcttcgtcttcgccggctcaggatcggggatggccttcagtaagctcacggacggtggcgccgccactcctgccggcctcatcgccgcgtctctggcgcacgccctcgccctcttcgtggccgtctccgtgggtgccaacatctccggcggccacgtgaaccctgccgtgaccttcggcgcctttgtgggcggcaacatcagcctcctcaaggccctggtctactgggtggcccagctcctgggctccgtcgtcgcctgcctcctcctcaagatcgccacgggcggcgcggccattggcgccttctcgctgtcggcgggcgtcggcgccatgaacgccgtggtgctggagatggtcatgaccttcggcctcgtgtacacggtgtacgccacggccgtggaccccaagaagggcgacctcggcgtcatcgcgcccatcgccatcggcttcatcgtcggcgccaacatcctggcggggggcgccttcgacggcgcctccatgaaccccgccgtctccttcggcccggccgtcgtcaccggcgtctgggagaaccactgggtgtactgggtcggcccactcgcgggcgcggccatcgcggcgctcgtctacgacatcatcttcatcgggcagcgcccacaccagcagctgccaaccacggcagcagactactga

SEQ ID NO: 1295 - protein, 254 aa, Zea mays
MPVSRIAVGAPGELSHPDTAKAAVAEFISTLIFVFAGSGSGMAFSKLTDGGAATPAGLIAASLAHALALFVAVSVGANISGGHVNPAVTFGAFVGGNISLLKALVYWVAQLLGSVVACLLLKIATGGAAIGAFSLSAGVGAMNAVVLEMVMTFGLVYTVYATAVDPKKGDLGVIAPIAIGFIVGANILAGGAFDGASMNPAVSFGPAVVTGVWENHWVYWVGPLAGAAIAALVYDIIFIGQRPHQQLPTTAADY

SEQ ID NO: 1296 - DNA, 870 bp, Zea mays
  CDS (1)..(870)
atggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgccctggctgccatctaccaccaggtgatcatcagagccatcccgttcaagagcaggtcttaa

SEQ ID NO: 1297 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 1298 - DNA, 774 bp, Zea mays
  CDS (1)..(774)
atggcgaagctcgtcaacaagctggtcgattcattcgaccacgacgaggcgccagcgccggacgtcggctgcgtgcgcgccgtgctggccgagctcgtcctcaccttcctcttcgtcttcaccggcgtctccgcctccatggccgccggggccggcgggaagcccggggaggctatgccgatggcgacgctggcggcggtggctatcgcgcacgcgctggccgctggcgtcctggtgacggccggcttccacgtctccggcggccacctcaaccccgcggtgacggtggggatcttggttcgcggccacatcaccaagctccgggcgctgctgtacgtcgccgcccagctgctggcgtcctccctcgcctgcatcctcctccgctacctcagcggcggcatggtgaccccggtgcacgccctgggcgctggcatcagcccgatgcagggcctggtgatggaggtgatcctcaccttctcgctgctcttcgtcacctacgccatgatcctggacccgcggagccaggtccgcaccatcggcccgctgctgacggggctcatagtcggcgccaacagcctcgccggcggcaacttcaccggcgcgtccatgaacccggcgcggtccttcggtcccgccatggccaccggggtctggaccaaccactgggtctactggatcggcccgctgctcggcgggtccctggccggcttcgtgtacgagtcgctgttcatggtgaacaagacgcacgagccgctgctcaatggagacatctga

SEQ ID NO: 1299 - protein, 257 aa, Zea mays
MAKLVNKLVDSFDHDEAPAPDVGCVRAVLAELVLTFLFVFTGVSASMAAGAGGKPGEAMPMATLAAVAIAHALAAGVLVTAGFHVSGGHLNPAVTVGILVRGHITKLRALLYVAAQLLASSLACILLRYLSGGMVTPVHALGAGISPMQGLVMEVILTFSLLFVTYAMILDPRSQVRTIGPLLTGLIVGANSLAGGNFTGASMNPARSFGPAMATGVWTNHWVYWIGPLLGGSLAGFVYESLFMVNKTHEPLLNGDI

SEQ ID NO: 1300 - DNA, 795 bp, Zea mays
  CDS (1)..(795)
atgctgccaggtcgccacccggcgcgccgggccgacaccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgccgcatctccttcggccgtgccgcggtatactggctcgcgcagatgctcggcgccgtggtcgcgtcgttgctgctaacgctcgtctccggcggcacgcgtcccgtgggcttcgggctcgtccgcggcgtccacgagcggcacgcgctcctgctagaggccgtcatgacgttcgggctcatgtacgccgtgtacgccaccgcggtggatcaccggagccggggcggcgcggtcgcgatcgcgcccctcgccatcggcttcgtcctgggcgcgaacatcctcgccggcggcccgttcgacggcgccgcgatgaacccggcgcgggcgttcgggcccgcgctcgtcggctggagctggcgccaccactgggtctactgggtcgggccactgatcggcgccgggctggctggcggcttgtacgagtttgtcatggttgagcaggagcccgaggcgccgctagctgcagttcctcggatgccagtggcctctgaggactactga

SEQ ID NO: 1301 - protein, 264 aa, Zea mays
MLPGRHPARRADTTGTGPLLPDATRAVVAEFVATAMFVFAAEGSVYGLWKLYKDTATPGGLLAVAIAHTLALVAAVAVASNASGGHVNPAVTFGLLVGRRISFGRAAVYWLAQMLGAVVASLLLTLVSGGTRPVGFGLVRGVHERHALLLEAVMTFGLMYAVYATAVDHRSRGGAVAIAPLAIGFVLGANILAGGPFDGAAMNPARAFGPALVGWSWRHHWVYWVGPLIGAGLAGGLYEFVMVEQEPEAPLAAVPRMPVASEDY

SEQ ID NO: 1302 - DNA, 768 bp, Zea mays
  CDS (1)..(768)
atggcgaagctcatgaacaagttggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggcaatcgcgcacgcgctggccgctggcgtcctggtgacggccgggttccacgtctccggcggccacctgaaccccgcggtgacggtggggctcatggtgcgcggccacatcaccaagctccgggcggtgctgtacgtcgccgcccagctgctggcctcctccgccgcctgcgtcctcctccgcttcctcagcggcggcatggtgaccccggtgcacgccctgggcaggggcatcagcccgatgcagggcctggtgatggaggtgatcctcaccttctccctgctcttcgtcacctacgccatgatcctggacccgcggagccaggtccgcgccatcggcccgctgctgacgggcctcatcgtcggcgccaacagcctcgccggcggcaacttcaccggcgcgtccatgaacccggcacgctccttcggcccggccctggccaccggggactggacaaaccactgggtctactggatcggcccgctgctcggtgggcccctggcaggcttcgtgtacgagtcgctgttcctggtgcacaagacgcacgagccgctgctcaatggggaaatctga

SEQ ID NO: 1303 - protein, 255 aa, Zea mays
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVRAIGPLLTGLIVGANSLAGGNFTGASMNPARSFGPALATGDWTNHWVYWIGPLLGGPLAGFVYESLFLVHKTHEPLLNGEI

SEQ ID NO: 1304 - DNA, 750 bp, Zea mays
  CDS (1)..(750)
atggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaa

SEQ ID NO: 1305 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 1306 - DNA, 753 bp, Zea mays
  CDS (1)..(753)
atggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatccccacgcacgccgtcgccgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaa

SEQ ID NO: 1307 - protein, 250 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 1308 - DNA, 768 bp, Zea mays
  CDS (1)..(768)
atggcgaagctcatgaacaagttggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgacgctggcggcggtggcaatcgcgcacgcgctggccgctggcgtcctggtgacggccgggttccacgtctccggcggccacctgaaccccgcggtgacggtggggctcatggtgcgcggccacatcaccaagctccgggcggtgctgtacgtcgccgcccagctgctggcctcctccgccgcctgcgtcctcctccgcttcctcagcggcggcatggtgaccccggtgcacgccctgggcaggggcatcagcccgatgcagggcctggtgatggaggtgatcctcaccttctccctgctcttcgtcacctacgccatgatcctggacccgcggagccaggtcctcgccatcggcccgctgctgacgggcctcatcgtcggcgccaacagcctcgccggcggcaacttcaccggcgcgtccatgaacccggcacgctccttcggcccggccctggccaccggggactggacaaaccactgggtctactggatcggcccgctgctcggtgggcccctggcaggcttcgtgtacgagtcgctgttcctggtgcacaagacgcacgatccgctgctcaatggggaaatctga

SEQ ID NO: 1309 - protein, 255 aa, Zea mays
MAKLMNKLVDSFEHDEIPDVGCVRAVLAELVLTFLFVFTGVSAAMAAGSDGKPGDAMPMATLAAVAIAHALAAGVLVTAGFHVSGGHLNPAVTVGLMVRGHITKLRAVLYVAAQLLASSAACVLLRFLSGGMVTPVHALGRGISPMQGLVMEVILTFSLLFVTYAMILDPRSQVLAIGPLLTGLIVGANSLAGGNFTGASMNPARSFGPALATGDWTNHWVYWIGPLLGGPLAGFVYESLFLVHKTHDPLLNGEI

SEQ ID NO: 1310 - DNA, 891 bp, Zea mays
  CDS (1)..(891)
atggcaggaggcacgctgcaggacagatcggaggccgaggacgtgcgcgtgggcgtggaccgtttcccggagcggcagcccatcggcacggcggcggacgacctgggccgcgactacagcgagcccccggcggcgccgctgttcgaggcgtcggagctctcctcgtggtccttctaccgcgccggcatcgccgagttcgtggccacgttcctcttcctctacgtgaccgtgctgacggtgatgggcgtgagcaagtccccctccaagtgcggcaccgtgggcatccagggcatcgcgtgggcgttcggcggcatgatcttcgcgctcgtgtactgcaccgcgggcgtgtcgggcggccacatcaacccggccgtcacgttcggcctcctcctcgcccggaagctgtcgctgacgcgggcggtctactacgtggtgatgcagtgcctgggcgccgtctgcggcgccggcgtcgtgaaggcgttcggcagcgcgctgtacgagtccgcgggcggcggcgccaacgccgtcagccccgggtacaccaagggcgacggcctcggcgccgaggtcgtgggcacgttcgtgctcgtgtacaccgtcttctccgccaccgacgccaagcgcaccgccagggactcccacgtccccgcgctggccccgctgcccatcggcttcgccgtattcctggtgcacctcgccaccatccccatcaccggcaccggcatcaaccccgccaggagcctcggcgccgccatcatctacgacaacccgcacgggtggcacggccactggatctcctgggtgggcccgttcgccggagcggcgcttgcggcggtgtaccaccaggtcgtcctcagggccatccccttcaagtccagcgctcactactag

SEQ ID NO: 1311 - protein, 296 aa, Zea mays
MAGGTLQDRSEAEDVRVGVDRFPERQPIGTAADDLGRDYSEPPAAPLFEASELSSWSFYRAGIAEFVATFLFLYVTVLTVMGVSKSPSKCGTVGIQGIAWAFGGMIFALVYCTAGVSGGHINPAVTFGLLLARKLSLTRAVYYVVMQCLGAVCGAGVVKAFGSALYESAGGGANAVSPGYTKGDGLGAEVVGTFVLVYTVFSATDAKRTARDSHVPALAPLPIGFAVFLVHLATIPITGTGINPARSLGAAIIYDNPHGWHGHWISWVGPFAGAALAAVYHQVVLRAIPFKSSAHY

SEQ ID NO: 1312 - DNA, 870 bp, Zea mays
  CDS (1)..(870)
atggaggggaaagaggaggacgtgcgcctgggcgccaacaagttctcggagcgcccccccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccccctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacattatcatgcaatgcctgggtgccatctgtggagctggagtggtgaagggtttccagcagggactttacatgggcaacggtggtggcgccaatgttgtcgcacctggctacaccaagggtgatggccttggcgctgagattgttggcaccttcatcctagtctacaccgtcttctcggccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgccctggctgccatctaccaccaggtgatcatcagagccatcccgttcaagagcaggtcttaa

SEQ ID NO: 1313 - protein, 289 aa, Zea mays
MEGKEEDVRLGANKFSERPPIGTAAQGAADDKDYKEPPPAPLFEPGELKSWSFYRAGIAEFVATFLFLYITILTVMGVSKSPSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRS

SEQ ID NO: 1314 - DNA, 870 bp, Zea mays
  CDS (1)..(870)
atggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgaccttcgggctgttcttggccaggaagctgtccctgactagggccatcttctacattatcatgcaatgcctgggtgccatctgtggagctggagtggtgaagggcttccagcaggggctttacatgggcaacggcggtggcgccaatgttgtcgcccctggatacaccaagggggacggccttggcgcagagatcgttggcaccttcatcctagtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggagccttggcgccgccatcatctacaaccgggatcatgcgtggagcgaccattggatcttctgggtcggccccttcatcggcgccgccctggctgccatctaccaccaggtgatcatcagggccatcccgttcaagagcaggtcttaa

SEQ ID NO: 1315 - protein, 289 aa, Zea mays
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 1316 - DNA, 24 bp, Artificial sequence
  primer
atgtggtttcctcagatcattgct

SEQ ID NO: 1317 - DNA, 24 bp, Artificial sequence
  primer
tcagtcttccttcttttgacctgc

SEQ ID NO: 1318 - protein, 258 aa, Artificial sequence
  consensus sequence
  Variant (3)..(4): Xaa in position 3 to 4 is any amino acid
  Variant (6)..(7): Xaa in position 6 to 7 is any amino acid
  Variant (9)..(10): Xaa in position 9 to 10 is any amino acid
  Variant (11)..(50): Xaa in position 11 to 50 is any or no amino acid
  Variant (52)..(54): Xaa in position 52 to 54 is any amino acid
  Variant (56)..(67): Xaa in position 56 to 67 is any amino acid
  Variant (68)..(68): Xaa in position 68 is any or no amino acid
  Variant (73)..(73): Xaa in position 73 is any amino acid
  Variant (77)..(80): Xaa in position 77 to 80 is any amino acid
  Variant (83)..(83): Xaa in position 83 is any amino acid
  Variant (86)..(98): Xaa in position 86 to 98 is any amino acid
  Variant (100)..(102): Xaa in position 100 to 102 is any amino acid
  Variant (104)..(105): Xaa in position 104 to 105 is any amino acid
  Variant (107)..(128): Xaa in position 107 to 128 is any amino acid
  Variant (129)..(143): Xaa in position 129 to 143 is any or no amino acid
  Variant (145)..(150): Xaa in position 145 to 150 is any amino acid
  Variant (151)..(162): Xaa in position 151 to 162 is any or no amino acid
  Variant (164)..(166): Xaa in position 164 to 166 is any amino acid
  Variant (168)..(169): Xaa in position 168 to 169 is any amino acid
  Variant (171)..(183): Xaa in position 171 to 183 is any amino acid
  Variant (184)..(193): Xaa in position 184 to 193 is any or no amino acid
  Variant (196)..(197): Xaa in position 196 to 197 is any amino acid
  Variant (200)..(206): Xaa in position 200 to 206 is any amino acid
  Variant (207)..(208): Xaa in position 207 to 208 is any or no amino acid
  Variant (210)..(215): Xaa in position 210 to 215 is any amino acid
  Variant (217)..(219): Xaa in position 217 to 219 is any amino acid
  Variant (225)..(225): Xaa in position 225 is any amino acid
  Variant (227)..(227): Xaa in position 227 is any amino acid
  Variant (229)..(237): Xaa in position 229 to 237 is any amino acid
  Variant (238)..(244): Xaa in position 238 to 244 is any or no amino acid
  Variant (246)..(247): Xaa in position 246 to 247 is any amino acid
  Variant (249)..(249): Xaa in position 249 is any amino acid
  Variant (252)..(253): Xaa in position 252 to 253 is any amino acid
  Variant (255)..(257): Xaa in position 255 to 257 is any amino acid
EFXXTXXFXXXXXXXXXXXXXXXXXXXXXXXXXXXXXXXXXXXXXXXXXXAXXXGXXXXXXXXXXXXXSGGHXNPAXXXXVTXGLXXXXXXXXXXXXXYXXXQXXGXXXXXXXXXXXXXXXXXXXXXXXXXXXXXXXXXXXXXGXXXXXXXXXXXXXXXXXXEXXXTXXLXXXXXXXXXXXXXXXXXXXXXXXAPXXIGXXXXXXXXXLXXXXXXGXXXNPARSXGXAXXXXXXXXXXXXXXXXWXXWXGPXXGXXXA

SEQ ID NO: 1319 - protein, 14 aa, Artificial sequence
  protein pattern
  Variant (2)..(2): Xaa in position 2 is Ile or Val
  Variant (3)..(3): Xaa in position 3 is Phe or Tyr
  Variant (5)..(5): Xaa in position 5 is any amino acid
  Variant (6)..(6): Xaa in position 6 is Ala, Gly or Ser
  Variant (8)..(9): Xaa in position 8 to 9 is any amino acid
  Variant (11)..(13): Xaa in position 11 to 13 is any or no amino acid
WXXWXXPXXGXXXA

SEQ ID NO: 1320 - DNA, 1764 bp, Saccharomyces cerevisiae
  CDS (1)..(1764)
atgagttccgtcaataaagatactattcatgttgctgaaagaagtcttcataaagaacaccttaccgaaggtggtaacatggccttccacaaccatttgaatgattttgctcatattgaagatcctctggaaagaagaagattggctttggagtccatcgatgacgaaggtttcggttggcaacaagttaagaccatctccattgctggtgttggtttcttgacagattcttatgatatttttgccattaatttgggtatcactatgatgtcctacgtttactggcacggtagtatgccaggtccaagtcaaaccttgttgaaggtttccacttctgttggtactgttattggtcaatttggttttggtactttagctgatattgttggtcgtaagagaatttatggtatggaacttattatcatgattgtctgtaccattctgcaaaccactgttgctcattctcctgctattaacttcgttgctgttttaacattctaccgtattgtcatgggtattggtatcggtggtgactacccactatcttctattattacttctgaatttgccactaccaaatggagaggtgccatcatgggtgctgtctttgctaaccaagcttggggtcaaatctccggtggtatcatcgctcttatcttggttgctgcttacaagggcgaactagaatacgcaaactctggtgctgaatgtgatgctagatgtcaaaaggcttgtgaccaaatgtggagaatccttattgggttgggtaccgttctagggttggcatgtttgtatttcagattaactattccagaatctcctagatatcaattggatgttaacgctaagttggaacttgctgctgccgcacaagaacaagatggcgaaaagaaaattcacgacaccagtgatgaagacatggcaattaacggtttggaaagagcttctactgccgtcgaatctcttgacaatcatcctccaaaggcttcgttcaaagatttctgcagacattttggtcaatggaagtacggtaagattttgctaggtactgctggttcatggtttaccttagatgttgctttctacgggttgagtttaaacagtgctgttattctgcaaaccatcggttatgccggttccaaaaacgtttacaagaaactgtatgatactgctgtcggtaatctgattttgatttgtgctggttcattacctggttactgggtatccgtcttcactgtcgatataatcggtagaaaaccaattcaattagccggtttcatcatcttgaccgctttgttctgtgtcatcggtttcgcataccataaacttggtgaccatggtctgttggctctttacgtcatttgtcaattcttccaaaacttcggtccaaacacaaccacctttattgttcctggtgagtgtttcccaactcgttacagatctactgctcatggtatttctgctgcatctggtaaggtcggtgccattattgcacaaaccgctttgggtactctaatcgaccataactgtgctagagacggtaagccaaccaactgttggttacctcacgtcatggaaattttcgccttattcatgttgttgggtatcttcacaaccttgttgatcccagaaactaagagaaagactctagaagaaattaacgagctataccacgatgaaatcgatcctgctacgctaaacttcagaaacaagaataatgacattgaatcttccagcccatctcaacttcaacatgaagcataa

SEQ ID NO: 1321 - protein, 587 aa, Saccharomyces cerevisiae
MSSVNKDTIHVAERSLHKEHLTEGGNMAFHNHLNDFAHIEDPLERRRLALESIDDEGFGWQQVKTISIAGVGFLTDSYDIFAINLGITMMSYVYWHGSMPGPSQTLLKVSTSVGTVIGQFGFGTLADIVGRKRIYGMELIIMIVCTILQTTVAHSPAINFVAVLTFYRIVMGIGIGGDYPLSSIITSEFATTKWRGAIMGAVFANQAWGQISGGIIALILVAAYKGELEYANSGAECDARCQKACDQMWRILIGLGTVLGLACLYFRLTIPESPRYQLDVNAKLELAAAAQEQDGEKKIHDTSDEDMAINGLERASTAVESLDNHPPKASFKDFCRHFGQWKYGKILLGTAGSWFTLDVAFYGLSLNSAVILQTIGYAGSKNVYKKLYDTAVGNLILICAGSLPGYWVSVFTVDIIGRKPIQLAGFIILTALFCVIGFAYHKLGDHGLLALYVICQFFQNFGPNTTTFIVPGECFPTRYRSTAHGISAASGKVGAIIAQTALGTLIDHNCARDGKPTNCWLPHVMEIFALFMLLGIFTTLLIPETKRKTLEEINELYHDEIDPATLNFRNKNNDIESSSPSQLQHEA

SEQ ID NO: 1322 - DNA, 1668 bp, Oryza sativa (japonica cultivar-group)
  CDS (1)..(1668)
atggcggacgcggacgggggctcgaacctggcggtgctggacgcgctggactcggcgcgcacgcagatgtaccacatgaaggcgatcgtgatcgccggcatgggcttcttcaccgacgcctacgacctgttctgcatctccacggtgtccaagctgctcggccgtctctactaccagcccgatggctcgacggacagtaagccaggcgctctgtccaagaccgccaacaacatggtcatcggcgtcgcgctcgtcggcacgctcatgggccagcttgtcttcggctacttcggcgacaagctcggccggaagcgcgtctacggcgtcaccctcatcctgatggccgcctgcgccatcggctccggcctgtcgttcggcagctcgcgcaaggcagtcatcggcacgctgtgcttcttccgcttctggctcggcttcggcatcggcggggactacccgctgtcggccaccatcatgtccgagtactcaaacaagaagacgcgcggcgcgttcatcgccgcggtgttcgccatgcagggcgtcggcatcatcttcgcggggctcgtgtccatgatcgtctctagcatcttcctcacctacaacaaggcgccgtcgtacaaggggaaccatgacctctcgaggcagatgcccgcggctgactacgtgtggcgcatcgtcctgatgatcggcgcgttcccggcgttggcgaccttctactggcggatgaagatgccggagacggcgaggtacacggcgatcatcgatggcaacgcgaagcaggcggcgaacgacatgcagaaggtgctgtcgatcgagatagaggccgagcaggagaagctggccaagttcaacgcggccaacaactacccgctcctgtcgatggagttcgcccggcgccacggcctgcacctcatcggcacgacgaccacgtggttcctccttgacatcgccttctacagccagaacctgacccagaaggacatcttcccggctatgggcctgatcagcggcgctgccgaagtcaacgctctcacggagatgttccagatatccaaggcctcgttcctcgtcgctctcctcggcaccttccccggctactgggtcaccgtcgctctcatcgacaagatgggcaggtacatgatccagctgatcggtttcttcatgatgtccatgttcatgctggcgatgggcatcctgtacgactacctcaaaacccatcacttcctgttcgggctcctgtacgcgctcactttcttcttcgccaacttcgggccgaacagcaccaccttcgtgctgccggccgagctgttcccgacgcgcgtgcgctccacctgccacgccatcagtgccgcggcgggcaaggccggcgccatcgtcgcggccttcggcattcagaagctcacgtacaactctcaagtcaaaagcatcaagaaggcgctcatcatcctctccatcaccaacatgctcggcttcttcttcacgttcctcgtcccggagaccatgggtcggtcgctcgaggagatctccggcgaggacggcaacaccggcgccggtggcggcggcgcccctgccgctgccaatgccggcgttggcgtgagcgcttcggatgtgagcagggacgagaagttccctgcttcaagcaccgaatggcagacatccatgcacgcatga

SEQ ID NO: 1323 - protein, 555 aa, Oryza sativa (japonica cultivar-group)
MADADGGSNLAVLDALDSARTQMYHMKAIVIAGMGFFTDAYDLFCISTVSKLLGRLYYQPDGSTDSKPGALSKTANNMVIGVALVGTLMGQLVFGYFGDKLGRKRVYGVTLILMAACAIGSGLSFGSSRKAVIGTLCFFRFWLGFGIGGDYPLSATIMSEYSNKKTRGAFIAAVFAMQGVGIIFAGLVSMIVSSIFLTYNKAPSYKGNHDLSRQMPAADYVWRIVLMIGAFPALATFYWRMKMPETARYTAIIDGNAKQAANDMQKVLSIEIEAEQEKLAKFNAANNYPLLSMEFARRHGLHLIGTTTTWFLLDIAFYSQNLTQKDIFPAMGLISGAAEVNALTEMFQISKASFLVALLGTFPGYWVTVALIDKMGRYMIQLIGFFMMSMFMLAMGILYDYLKTHHFLFGLLYALTFFFANFGPNSTTFVLPAELFPTRVRSTCHAISAAAGKAGAIVAAFGIQKLTYNSQVKSIKKALIILSITNMLGFFFTFLVPETMGRSLEEISGEDGNTGAGGGGAPAAANAGVGVSASDVSRDEKFPASSTEWQTSMHA

SEQ ID NO: 1324 - DNA, 1581 bp, Oryza sativa (japonica cultivar-group)
  CDS (1)..(1581)
atggcgggcgatcagatgcacgtgctctccgcgctggacagcgccaagacgcagtggtaccacttcaccgccatcgtcatcgccggcatgggcttcttcaccgacgcctacgacctcttctgcatctccctcgtcaccaagctcatcggccgcgtctactacaccgccgacggcgcgtccaagccgggcagcctgccgcccaacgtctcggcggccgtgaacggcgtcgccttcgtcggcacgctcacggggcagctcttcttcgggtggctcggcgacagggtcggccggaagagcgtctacggcatgacgctgctcttgatgatcatctgctccgtcgcgtcggggctgtcgttcggggacacgccgacgagcgtcatggccacgctctgcttcttccgcttctggctcggcttcggcatcggcggcgactacccgctcagcgccaccatcatgtcggagtacgcgaacaagcggacgcgcggggcgttcatcgccgccgtgttcgcgatgcaggggttcgggatcctcgccggcggcgcggtggcgatcgggatcaccgcgatcttcaggagccggttccccgcgccgccgttcgccgccgacccggcggcgtccaccccgccccaggccgactacgtgtggcggctcatcctcatgttcggcgcgcttcccgcggcgctcaccttctactggcggatgaggatgccggagacggcgcggtacaccgccatcgtcgccaagaacgcggagcgcgccgcggccgacatgtccaaggtgctccaggtgaagatcacggcggagcaggcggagatggcctcgccggtggacaagcccttcaccagcaagcccttcggcctcttctccggcgagttcgcgcggcgccacgggttccacctcctgggcacgacgtcgacgtggctcctcctggacatcgcctactactcccagaacctgttccagaaggacatcttcagcgccatcgggtggatcccggaggcgaagacgatgagcgcgctggacgagctgtaccacatcgcgcgcgcgcagacgctgatcgcgctgtgcgggacggtgccgggctactggttcacggtggcgctgatcgacgtggtcgggcggttcaagatccaggcggcggggttcttcgtgatgacggcgttcatgctggcgctggcggtgccgtacgaccactggacggcggcggggaaccagatcgggttcgtggtgctgtacgcgctcaccttcttcttcgccaacttcgggccgaacgcgacgacgttcatcgtgccggcggagatatacccggcgaggctgcgcgcgacgtgccacgggatatcggcggcgtcggggaaggtgggcgcgatcgtcgggtctttcgggttcctgtacctggcgcagagccccgtcccggccaaggcggcggcgcacggctacccgccgggcatcggcgtccgcaactcgctcttcgcgctcgccggctgcagcttgctcggcttcctcctcaccttccttgtgccggagcccaagggcaagtcgctcgaggagatgtcacgggagaacgaggtcggccagccgtga

SEQ ID NO: 1325 - protein, 526 aa, Oryza sativa (japonica cultivar-group)
MAGDQMHVLSALDSAKTQWYHFTAIVIAGMGFFTDAYDLFCISLVTKLIGRVYYTADGASKPGSLPPNVSAAVNGVAFVGTLTGQLFFGWLGDRVGRKSVYGMTLLLMIICSVASGLSFGDTPTSVMATLCFFRFWLGFGIGGDYPLSATIMSEYANKRTRGAFIAAVFAMQGFGILAGGAVAIGITAIFRSRFPAPPFAADPAASTPPQADYVWRLILMFGALPAALTFYWRMRMPETARYTAIVAKNAERAAADMSKVLQVKITAEQAEMASPVDKPFTSKPFGLFSGEFARRHGFHLLGTTSTWLLLDIAYYSQNLFQKDIFSAIGWIPEAKTMSALDELYHIARAQTLIALCGTVPGYWFTVALIDVVGRFKIQAAGFFVMTAFMLALAVPYDHWTAAGNQIGFVVLYALTFFFANFGPNATTFIVPAEIYPARLRATCHGISAASGKVGAIVGSFGFLYLAQSPVPAKAAAHGYPPGIGVRNSLFALAGCSLLGFLLTFLVPEPKGKSLEEMSRENEVGQP

SEQ ID NO: 1326 - DNA, 1626 bp, Oryza sativa (japonica cultivar-group)
  CDS (1)..(1626)
atgggaaggcaggaccagcagctgcaggtgctgaacgcgctcgacgcggccaagacgcaatggtaccacttcacggcgatcatcgtcgccggcatggggttcttcaccgacgcctacgacctcttctgcatctcgctcgtcaccaagcttctcggccgcatctactacaccgaccccgccagccccacccccggctcgctgccgcccaacatcgccgccgcggtgaatggcgtcgcgctctgcggcaccctctccggccagctcttcttcggatggctcggcgacaagctcggccgcaagagcgtctacgggatgacgctgctgctcatggtgatttgctccatcgcctcagggctctccttctcgcacacgccgacgagcgtcatggccacgctctgcttcttccgcttctggctcggcttcggcatcggcggtgactacccgctgagcgccaccatcatgtccgagtacgccaacaagaagacccgcggcgcgttcatcgccgccgtcttcgccatgcaggggttcggcatcctcgccggcggcgttgtcacgctcgccatgtccgcggggttccaggccgcgttcccggccccagcgtacgaggtcaatgccgctgcgtccaccgtgccgcaggccgactacgtgtggcgcatcatcctgatgctcggtgcgctgccggccatactgacgtactactggcggatgaagatgccggagacggcgcggtacacggcgctcgtcgccaaggacgcgaagcaggcgtcgtcggacatggccaaggtgctgcaggtggaaatcgaggtggaggaggagaagctccaggacatcacgaggggcagggactacggcctcttctcggcgcggttcgccaagcgccatggcgcgcacctcctgggcacggcggcgacgtggttcctcgtcgacgtcgcgtactacagccagaacctgttccagaaggacatcttcaccagcatccactggatccccaaggcgcgcaccatgagcgagctcgaggaggtgttccgcatctcccgcgcgcagacgctcatcgcgctctgcggcaccgtgccgggctactggttcaccgtcttcctcatcgacatcatcggccgcttcaagatccagctcctcggcttcgccgggatgacggcgttcatgctcggcctcgccatcccgtaccaccactggaccatgcctggcaaccaggtcatcttcgtcttcctctacggcttcaccttcttcttcgccaactttgggccgaacgcgacgacgttcatcgtgccggccgagatcttcccggcgcgtctccggtcaacctgccacggcatctccgccgcgtccggcaaggccggcgcgatcatcggagcattcggtttcctctacgcggcgcagccacaggacaaggcgcatgtcgacgccggctacaaacctgggattggcgtgcggaacgcgctcttcgtgctcgccgggtgcaacctcgttgggttcctcatgacatggatgctcgtgccggaatcgaaagggaagtcgctggaggagatgtccggcgaggccgacgacgaggaagcttctgccaacggcggtgccaccgccgtcaactcgtccggagttgagatggtgtaa

SEQ ID NO: 1327 - protein, 541 aa, Oryza sativa (japonica cultivar-group)
MGRQDQQLQVLNALDAAKTQWYHFTAIIVAGMGFFTDAYDLFCISLVTKLLGRIYYTDPASPTPGSLPPNIAAAVNGVALCGTLSGQLFFGWLGDKLGRKSVYGMTLLLMVICSIASGLSFSHTPTSVMATLCFFRFWLGFGIGGDYPLSATIMSEYANKKTRGAFIAAVFAMQGFGILAGGVVTLAMSAGFQAAFPAPAYEVNAAASTVPQADYVWRIILMLGALPAILTYYWRMKMPETARYTALVAKDAKQASSDMAKVLQVEIEVEEEKLQDITRGRDYGLFSARFAKRHGAHLLGTAATWFLVDVAYYSQNLFQKDIFTSIHWIPKARTMSELEEVFRISRAQTLIALCGTVPGYWFTVFLIDIIGRFKIQLLGFAGMTAFMLGLAIPYHHWTMPGNQVIFVFLYGFTFFFANFGPNATTFIVPAEIFPARLRSTCHGISAASGKAGAIIGAFGFLYAAQPQDKAHVDAGYKPGIGVRNALFVLAGCNLVGFLMTWMLVPESKGKSLEEMSGEADDEEASANGGATAVNSSGVEMV

SEQ ID NO: 1328 - DNA, 1584 bp, Oryza sativa (japonica cultivar-group)
  CDS (1)..(1584)
atggcgggagggcagctcaacgtgctgagcacgctcgaccaggcgaagacgcaatggtaccacttcatggcgatcgtcatcgccggcatgggcttcttcaccgacgcctacgacctcttctgcatttccctcgtcaccaagctgctcggccgcatctactacaccgacgattccaaggacacccccggcgcgctcccgcccaacgtgtcggccgccgtcaccggcgtcgcgctctgcggcacgctcgccggccagcttttcttcggatggctcggcgacaagctcggacgcaagagcgtgtatggtttcacgctgattctgatggtcgtgtgctcggtcgcgtccgggctctcgttcgggagctcggccaagggcgtcgtgtctacgctctgcttcttccggttctggctcggcttcggcatcggcggcgactacccgctcagcgccaccatcatgtcggagtacgcgaacaagaggacgcgcggggccttcatcgccgccgtgttcgccatgcaggggttcgggatcctcttcggcgccatcgtcgcgctcgcggtgtcggcggggttccggcacgcgtacccggcgccgtcctactccgacaaccacgccgcgtcgctcgtcccgcaggccgactacgtgtggcgcatcatcctcatgttcggcaccgtcccggcggcgctcacctactactggcggatgaagatgcccgagacggcgcggtacacggcgctcatcgcccgcaacgcgaagcaggcggcggccgacatgtccaaggtgctgcacacccagattgaggagagcgcggaccgcgccgagacggtggccgtcggcggcgagagctggggcctcttctcgcgccagttcctgcgccgccacggcctccacctcctcgccaccaccagcacgtggttcctcctcgacatcgccttctacagccagaacctgttccagaaggacatcttcagcaaggtcgggtggatcccgccggcgaagaccatgaacgcgctcgaggagctctaccgcatcgcccgcgcccaggcgctcatcgcgctctgcggcaccatcccgggctactggttcaccgtcgcattcatcgagatcatgggcaggttctggatccagatcatgggcttcgccatgatgacggcgttcatgctcggcctcgccatcccgtaccaccactggacgacgccggggcaccacaccggcttcatcgtcatgtacggattcaccttcttcttcgcgaacttcgggccaaacagcaccaccttcatcgtgccggcggagatatacccggcgcggctccggtcgacgtgccacggcatctccgccgccgccgggaaggccggcgccatcatcggagcgttcgggttcctgtacgcggcgcaggaccagcacaagcccgagcctgggtaccccagggggatcggcatcaagaacgcgctcttcgtgctcgccggcacaaacttcctcgggacgatcatgacgctgctcgtgccggagtccaagggcatgtcgctcgaggttatctcgcaggaggtcgccgacggcgacgacgaggaggcggcctacccgaagtaa

SEQ ID NO: 1329 - protein, 527 aa, Oryza sativa (japonica cultivar-group)
MAGGQLNVLSTLDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYSQNLFQKDIFSKVGWIPPAKTMNALEELYRIARAQALIALCGTIPGYWFTVAFIEIMGRFWIQIMGFAMMTAFMLGLAIPYHHWTTPGHHTGFIVMYGFTFFFANFGPNSTTFIVPAEIYPARLRSTCHGISAAAGKAGAIIGAFGFLYAAQDQHKPEPGYPRGIGIKNALFVLAGTNFLGTIMTLLVPESKGMSLEVISQEVADGDDEEAAYPK

SEQ ID NO: 1330 - DNA, 1587 bp, Oryza sativa (japonica cultivar-group)
  CDS (1)..(1587)
atggcgggatcgcagctcaacgttttggtcaagctcgaccaggccaagacgcaatggtaccatttcatggcgatcgtcatcgccgggatggggttcttcacagacgcctacgacctcttttgcatcgcgctggtcaccaagctgttgggtcgcctttactacaccgacatcaccaagcccaacccagggacactcccgcccaacgtgtcgtccgccgtcaccggcgtcgcgctctgcggcacgctcgccggccagctcttcttcggatggctcggcgacaagctcggccgcaagagcgtctatggattcacgctcatcctcatggtcgtgtgctccatcgcctccggtctctcgtttggccacacgcccaagagcgtgattgccacgctctgcttcttccgcttctggctcggcttcggcatcggcggcgactacccgctcagcgccaccatcatgtcggagtacgcgagcaagaagacccgcggggccttcatcgccgccgtgttcgccatgcaggggttcgggatcctcttcggcgccatcgtcgcgctcgtcgtctcggccggcttccgtcacgcgtacccggcgccgtcgtacgcccagaaccccgccgcgtcgctcgcgccgcaggctgactacacgtggcggctcatcctcatgttcggcaccatcccggctgggctcacctactactggcgcatgaaaatgcccgagacggcgcggtacacggcgctcgtcgcccgcaacgccaagcaggcggcggctgacatgtccaaggtgctccacgccgagatcgaggagcggccggaggtggtcgagagccaggtggtcgccggggagacctggggcctcttctcacggcagttcatgaagcgccacgggatgcacctcctggcgaccaccagcacgtggttcctgctcgacatcgccttctacagccagaacctgttccagaaggacatcttcagcaaggtcgggtggataccgccggcgaagaccatgaacgcgctcgaggaactctaccgcatctcccgcgcccaggcactcatcgcactctgcggaaccatcccgggctactggttcaccgtcgccttcatcgacatcgtcggcaggttctggatccagatcatgggcttcttcatgatgaccgtgttcatgctcgcgctcggcgtgccctacgaccactggacgcacccggcgcaccacaccggcttcgtcgtgctctacgcactcaccttcttcttcgccaacttcgggcccaacagcaccaccttcatcgtgccggctgagatcttcccggcgaggctccggtcgacgtgccacggcatctccgccgcgtccggcaaggccggcgcgatcatcggcgcgttcgggttcctgtacgctgcgcaggaccagcacaatcccgacgcgggatactcccgcggcatcggcatccggaacgcgctcttcgtgctcgccggcacaaacttcctcggtatgctcatgacgctgctggtgccggagtccaagggcttgtcgctggaggagatgtccaaggacaacgtcgtcgacgagaccgcccaagaagcgatcgcccaagcgtga

SEQ ID NO: 1331 - protein, 528 aa, Oryza sativa (japonica cultivar-group)
MAGSQLNVLVKLDQAKTQWYHFMAIVIAGMGFFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIVALVVSAGFRHAYPAPSYAQNPAASLAPQADYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKVGWIPPAKTMNALEELYRISRAQALIALCGTIPGYWFTVAFIDIVGRFWIQIMGFFMMTVFMLALGVPYDHWTHPAHHTGFVVLYALTFFFANFGPNSTTFIVPAEIFPARLRSTCHGISAASGKAGAIIGAFGFLYAAQDQHNPDAGYSRGIGIRNALFVLAGTNFLGMLMTLLVPESKGLSLEEMSKDNVVDETAQEAIAQA

SEQ ID NO: 1332 - DNA, 1647 bp, Oryza sativa (japonica cultivar-group)
  CDS (1)..(1647)
atggttcaggatcgcaaggtgctcgacgcgctggacacggcgaagacgcagtggtaccacttcacggcggtggtgatcgccggcatgggcttcttcaccgacgcctacgacctcttctccatctccctcgtcaccaagctgctcggccgcatctactacttcaacccggcgtccaagagccccggctccctcccgcccaacgtctccgccgccgtcaatggcgtcgccttctgcggcacgctcgccggccagctcttcttcggctggctcggcgacaagatggggcgcaagaaggtgtacgggatgacgctcatgctcatggtcatctgctgcctcgcctccggcctctcgttcgggtcgtcggcgaaaggcgtcatggccacgctctgcttcttccgcttctggcttgggttcggcatcggtggcgactacccgctctcggcgaccatcatgtcggagtatgctaacaagcgtacccgtggcgcgttcatcgccgccgtgttcgccatgcagggcttcggcaacctcaccggcggcatcgtggccatcatcgtgtccgccgcgttcaagttgcggttcgacgcgccggcgtacagggacgaccgggccggctccaccgtgccgcaggctgactacgcgtggcgcatcgtgctcatgttcggcgccatcccggcgctgctcacctactactggcggatgaagatgccggagacggcgcgctacaccgcgctggtcgccaagaacgacaagaaggcagccgccgacatggcgcgcgttctcaacgtcgagctcgtcgacgagcaggagaaggcagcggcggcgacggcggcggctgcggaggaggaggcagcacggcgcgagcagtacgggctcttctcccgggaattcgcacggcgccatggccaccacctgctgggcacgacggtgtgctggttcgtgctggacatcgcctactactcgcagaacctgttccagaaggacatctacacggcggtgcagtggctgcccaaggcggacaccatgagcgccctggaggagatgttcaagatctcccgggcacagacgctcgtggcgctgtgcggcaccatcccgggctactggttcaccgtcctcttcatcgacatcgtcggccgcttcgccatccagctcggcggcttcttcctcatgacggcgttcatgctcggcctcgccgtgccgtaccaccactggacgacgccggggaaccacgtcggcttcgtggtcatgtacgccttcaccttcttcttcgccaacttcgggccaaactccacgaccttcatcgtgccggccgagatcttcccggcgaggctgcgttccacctgccacggcatctcgtcggcggccgggaagatgggcgccatcgtcgggtcgttcgggttcttgtacgccgcgcagagcaccgacccgagcaagacggacgccggctacccgcggggcatcggcgtgcgcaactcgctgttcctgctcgccggatgcaacgtcgtcggcttcttgttcacgttcttggtgccagagtcgaaggggaagtcgctggaggagctctccggcgagaacgaaatggaggctgagccggcggcagcaactaactcctacaggcagaccgtccctgacagcggacagtccgagtaa

SEQ ID NO: 1333 - protein, 548 aa, Oryza sativa (japonica cultivar-group)
MVQDRKVLDALDTAKTQWYHFTAVVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKLRFDAPAYRDDRAGSTVPQADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIYTAVQWLPKADTMSALEEMFKISRAQTLVALCGTIPGYWFTVLFIDIVGRFAIQLGGFFLMTAFMLGLAVPYHHWTTPGNHVGFVVMYAFTFFFANFGPNSTTFIVPAEIFPARLRSTCHGISSAAGKMGAIVGSFGFLYAAQSTDPSKTDAGYPRGIGVRNSLFLLAGCNVVGFLFTFLVPESKGKSLEELSGENEMEAEPAAATNSYRQTVPDSGQSE

SEQ ID NO: 1334 - DNA, 1617 bp, Oryza sativa (japonica cultivar-group)
  CDS (1)..(1617)
atggccggcgagctcaaggtgctgaacgcgctcgactcggcgaagacgcagtggtaccatttcacggcgatcgtgatcgccggcatggggttcttcaccgacgcctacgacctcttctccatctccctcgtcaccaagctgctcggccgcatctactacttcaacccggcgtccaagagccccggctccctcccgcccaacgtctccgccgccgtcaatggcgtcgccttctgcggcaccctcgccggccagctcttcttcggttggctcggcgacaagatggggcgcaagaaggtgtacggcatgacgctcatgctcatggtcatctgctgcctcgcttccggcctctcgttcgggtcgtcggcgaaaggcgtcatggccacgctctgcttcttccgcttctggctcggcttcggcatcggcggcgactacccgctctcggcgaccatcatgtcggagtacgctaataagcgcacccgtggagcgttcatcgccgccgtgttcgccatgcagggcttcggcaacctcaccggcggcatcgtggccatcatcgtgtccgccgcgttcaagtcgcggttcgacgcgccggcgtacagggacgaccggaccggctccaccgtgccgcaggccgactacgcgtggcgcatcgtgctcatgttcggcgccatcccggcgctgctcacctactactggcggatgaagatgccggagacggcgcgctacaccgcgctggtcgccaagaacgcgaagcaggccgccgcggacatgacgcaggtgctcaacgtcgagatcgtggaggagcaggagaaggctgacgaggtcgcgcggcgcgagcagttcgggctcttctcccgccagtttttgagacgccatgggcgccacctgctgggcacgacggtgtgctggttcgtgctggacatcgccttctactcgtcgaacctgttccagaaggacatctacacggcggtgcagtggctgcccaaggcggacaccatgagcgccctggaggagatgttcaagatctcccgggcacagacgctcgtggcgctgtgcggcaccattccgggctactggttcaccgtcttcttcatcgacatcatcggccgcttcgtcatccagctcggcggcttcttcttcatgacggcgttcatgctcggcctcgccgtgccgtaccaccactggacgacgccggggaaccacatcggcttcgtggtcatgtacgccttcaccttcttcttcgccaacttcgggcccaactccacgaccttcatcgtgccggcggagatcttcccggcgaggctgcgttccacctgccacggcatctcggcggcggcggggaaggccggcgccatcgtcgggtcgttcgggttcctgtacgcggcgcagagcacggacgcgagcaagacggacgccggctacccgccgggcatcggcgtgcgcaactcgctcttcttcctcgccggatgcaacgtcatcgggttcttcttcacgttcctggtgccggagtcgaaggggaagtcgctggaggagctctccggcgagaacgaggacgatgacgatgtgccggaagcgcccgcgacggccgatcaccggactgcgccggcgccgccagcttga

SEQ ID NO: 1335 - protein, 538 aa, Oryza sativa (japonica cultivar-group)
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKSRFDAPAYRDDRTGSTVPQADYAWRIVLMFGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPATADHRTAPAPPA

SEQ ID NO: 1336 - DNA, 1425 bp, Oryza sativa (japonica cultivar-group)
  CDS (1)..(1425)
atggccggcaaccagcagctgcgggtgctgcacgccctggacattgcaaggacacagctgtaccatttcatcgcgatcgtgatcgccggtatgggcttcttcaccgacgcctacgacctcttctccatctcccttgtcgccgacctcctcggccacgtctactaccacggcgagctgccccggaacatccacgccgccgtcaccggcatcgcgctttgtggcaccgtccctggacagctcgtcttcggctggctaggcgacaaaatgggccggaagcgtgtctatggaatcaccctcctcctcatggttgtctcctctctcgcctccggactctccttcagtaagcacgaggggatgaacattatcgctgtgctttgcttcttccggttctggcttggcgtcagcatcggtggggattacccactctccgccaccatcatgtcagagtacgccaacaagaggactcgtggtgccttcattgctgctgtctttgctatgcaaggtttcggcaaccttgctgctgggatcattggaatgatagtatctgcagctttcaagcattcatcggcatcaaagattgactatgcctggcggataatcctcatgtttggcgccattcctgctgctctcacttaccactggcgcatgaagatgccagaaacagcacgttacactgccctcatctctaagaatgcaaagaaggccgccaaggacatgtctgccgtgctcaatgtcaacataaccccggacgatgaagttatcaatgagcttgcaaggcaggacgagtatggcctcttctcgttcgagtttctccaccgccatggcctccacctccttggcaccaccgtctgttggttcgtcctcgacgtcaccttctactcgctcaacattttcatgaagaatatcttcaccgaggtcggtcttcttcctcgtctagatagcgaataccaccataccctccagcggatgatcaccatgacagcagttcacacatttatctcgctttgcggtgcacttcccgggtacttcttcactgtcgccttcgttgatcgcatcggccgtgtcaagatccagctgattggattcaccatgatgactgttttcatgctttgtcttgcaattccttatgatcagtggctgaggcacaagaacaagtacggatttgcagtcatgtatggcctgaccttcttcttcgccaactttgggccaaatactacaaccttcataattccagctgagattttccctgcaaggctacggtccacatgccatgggatatctggtgcggttgggaagatcggtgcgattgtcgagtcgaaagggaagtccctcgaggatctcactggggagattgaagagttccaggaggaagatgaaggaagtgaagttgctttgtctagacccatacatactgtgcctttatag

SEQ ID NO: 1337 - protein, 474 aa, Oryza sativa (japonica cultivar-group)
MAGNQQLRVLHALDIARTQLYHFIAIVIAGMGFFTDAYDLFSISLVADLLGHVYYHGELPRNIHAAVTGIALCGTVPGQLVFGWLGDKMGRKRVYGITLLLMVVSSLASGLSFSKHEGMNIIAVLCFFRFWLGVSIGGDYPLSATIMSEYANKRTRGAFIAAVFAMQGFGNLAAGIIGMIVSAAFKHSSASKIDYAWRIILMFGAIPAALTYHWRMKMPETARYTALISKNAKKAAKDMSAVLNVNITPDDEVINELARQDEYGLFSFEFLHRHGLHLLGTTVCWFVLDVTFYSLNIFMKNIFTEVGLLPRLDSEYHHTLQRMITMTAVHTFISLCGALPGYFFTVAFVDRIGRVKIQLIGFTMMTVFMLCLAIPYDQWLRHKNKYGFAVMYGLTFFFANFGPNTTTFIIPAEIFPARLRSTCHGISGAVGKIGAIVESKGKSLEDLTGEIEEFQEEDEGSEVALSRPIHTVPL

SEQ ID NO: 1338 - DNA, 1605 bp, Oryza sativa (japonica cultivar-group)
  CDS (1)..(1605)
atgggcggcggcggcggggagcagcagcagcttgaggtgctccacgccctggacgtggccaagacgcaatggtaccatttcacggccatcgtggtggccggaatggggttcttcaccgacgcctatgacctcttctgcatctccctcgtcaccaagctgctgggccgcatctactaccgcgtcgacgggtccccgtcccccggcacgctccccccgcacgtctccgcctccgtcaacggcgtggccttcgtgggcacgctctcagggcaactcttctttggctggctgggcgacaagctcggccgtaagcgcgtctatggcatcaccctcatgctcatggtgctctgctccctcgcctccgcgctctcctttggccacaccccgacctccgtcatggccaccctctgcttcttccgcttctggctcggcttcggcatcggcggcgactacccgctctccgccaccatcatgtccgagtacgccaacaagaagacgcgtggcgccttcatcgccgccgtcttcgcgatgcagggcttcggcatcatcaccggcggcctcgtcgccatcctcgtctccgcctccttcagggccgccttcccggcgcctccctacggcgaggaccccgtggcctccacgccgccgcaggccgacttcgtgtggaggatcatactcatgctgggcgcgctgccggcggcgctcacctactactggcgcaccaagatgcccgagacggcgcgctacacggcgctcgtggccaacaacgccaagcaggccgcggccgacatgtccaaggtgctgcaggtggtggagatgcgtaatattggtaataatggtggcagcaggaggccgttcgggctgttctccggcgagtttgtccggcggcacgggctgcacctggtgggcacgtcggcgacgtggttgctgctggacattgcgttctacagccagaacctgttccagaaggacatattcagcgcggtggggtggatccccaaggcggcgacgatgagcgcgctggaggagctgttccgcatcgcgcgggcgcagacgctgatcgcgctgtgcgggacggtgcccggctactggttcaccgtcgcgctcatcgacgtggtgggccgtttcaagatccaggccgttggcttcttcatgatgaccctcttcatgctcaccctcgccctgccgtaccaccactggacggcgccggggaagaaccacgtcggcttcctgctgctctacggcctcaccttcttcttcgccaacttcggccccaactccaccaccttcatcgtgccggcggagattttcccggcgcggctgcgggccacgtgccacggcatctcggcggcgtcggggaagctgggcgccatcgtcggatccttcgggttcctgtacctggcgcagagccccgaccggagcaagacggagcacgggtaccctccgggcatcggcgtccgcaactcgctcttcctgctcgccgcctgcaacctgctgggcctgctcttcaccttcctcgtgccggagtccaaggggaagtcgctggaggagatgtccggcgacgccgaggcccaggaggaggcgccgccgcccctgcaaactgtactgtag

SEQ ID NO: 1339 - protein, 534 aa, Oryza sativa (japonica cultivar-group)
MGGGGGEQQQLEVLHALDVAKTQWYHFTAIVVAGMGFFTDAYDLFCISLVTKLLGRIYYRVDGSPSPGTLPPHVSASVNGVAFVGTLSGQLFFGWLGDKLGRKRVYGITLMLMVLCSLASALSFGHTPTSVMATLCFFRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVANNAKQAAADMSKVLQVVEMRNIGNNGGSRRPFGLFSGEFVRRHGLHLVGTSATWLLLDIAFYSQNLFQKDIFSAVGWIPKAATMSALEELFRIARAQTLIALCGTVPGYWFTVALIDVVGRFKIQAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 1340 - DNA, 1626 bp, Oryza sativa (japonica cultivar-group)
  CDS (1)..(1626)
atggcgcggcaggagcagcagcagcacctgcaggtgctgagcgcgctggacgcggcgaagacgcagtggtaccacttcacggcgatcgtcgtcgccggcatgggcttcttcaccgacgcctacgacctcttctgcatctccctcgtcaccaagctgctcggccgcatctactacaccgacctcgccaaggagaaccccggcagcctgccgcccaacgtcgccgcggcggtgaacggagtcgcgttctgcggcacgctggcggggcagctcttcttcgggtggctcggcgacaagctcggccggaagagcgtgtacgggatgacgctgctgatgatggtcatctgctccatcgcgtcggggctctcgttctcgcacacgcccaccagcgtcatggcgacgctctgcttcttccggttctggctcggattcggcatcggcggcgactacccgctgtcggcgacgatcatgtcggagtacgccaacaagaagacccgcggcgcgttcatcgccgccgtgttcgcgatgcaggggttcggcatcctcgccggcggcatcgtcaccctcatcatctcctccgcgttccgcgccgggttcccggcgccggcgtaccaggacgaccgcgcgggctccaccgtccgccaggccgactacgtgtggcggatcatcctcatgctcggcgccatgccggcgctgctcacctactactggcggatgaagatgccggagacggcgcgctacaccgccctcgtcgccaagaacgccaagcaggccgccgccgacatgtccaaggtgctccaggtcgagatccaggaggagcaggacaagctggagcagatggtgacccggaacagcagcagcttcggcctcttctcccgccagttcgcgcgccgccacggcctccacctcgtcggcaccgccacgacatggttcctcctcgacatcgccttctacagccagaacctgttccagaaggacatcttcaccagcatcaactggatccccaaggccaagaccatgtcggcgctggaggaggtgttccgcatcgcgcgcgcccagacgctcatcgccctgtgcggcaccgtcccgggctactggttcaccgtcttcctcatcgacatcgtcggccgcttcgccatccagctgctagggtttttcatgatgaccgtgttcatgctcggcctcgccgtgccgtaccaccactggacgacgaaggggaaccacatcggcttcgtcgtcatgtacgccttcaccttcttcttcgccaacttcggccccaactccaccaccttcatcgtgccggcggagatcttcccggcgaggctgcgttccacctgccacggcatctcggcggcggcggggaaggccggcgccatcatcggatcgttcgggttcctgtacgcggcgcaggacccgcacaagcccgacgccgggtacaaacccgggatcggggtgaggaactcgctgttcgtgctcgccggatgcaacctgctcgggttcatctgcacgttcctcgtgccggagtcgaaggggaagtcgctggaggagatgtccggcgaggcggaggacgacgacgacgaggtggccgccgccggcggtggcgccgccgtgcggccgcagacggcgtag

SEQ ID NO: 1341 - protein, 541 aa, Oryza sativa (japonica cultivar-group)
MARQEQQQHLQVLSALDAAKTQWYHFTAIVVAGMGFFTDAYDLFCISLVTKLLGRIYYTDLAKENPGSLPPNVAAAVNGVAFCGTLAGQLFFGWLGDKLGRKSVYGMTLLMMVICSIASGLSFSHTPTSVMATLCFFRFWLGFGIGGDYPLSATIMSEYANKKTRGAFIAAVFAMQGFGILAGGIVTLIISSAFRAGFPAPAYQDDRAGSTVRQADYVWRIILMLGAMPALLTYYWRMKMPETARYTALVAKNAKQAAADMSKVLQVEIQEEQDKLEQMVTRNSSSFGLFSRQFARRHGLHLVGTATTWFLLDIAFYSQNLFQKDIFTSINWIPKAKTMSALEEVFRIARAQTLIALCGTVPGYWFTVFLIDIVGRFAIQLLGFFMMTVFMLGLAVPYHHWTTKGNHIGFVVMYAFTFFFANFGPNSTTFIVPAEIFPARLRSTCHGISAAAGKAGAIIGSFGFLYAAQDPHKPDAGYKPGIGVRNSLFVLAGCNLLGFICTFLVPESKGKSLEEMSGEAEDDDDEVAAAGGGAAVRPQTA

SEQ ID NO: 1342 - DNA, 1431 bp, Thermoplasma volcanium GSS1
  CDS (1)..(1431): transl_table=11
atggctaaaggcatcattgaagagcttgataattcaaagataaattcctttcatctacgcacctggttgattgcaggtatgggattcttcacggatgcatacgatctttttgtaataggtacagttatatcaatactcccactagctgggtgggataaactcaacacatacgatatttcaatattatcctcaatatctcttcttgcttctgtaataggtgcagtgatatttggaaggcttctcgacgcactaggaagaaaaagagtctatggatttgagctgatgttgcttatattgggagctttaggcagtgcatttgtggttccagtaaacggtataaattaccttatagcatggagatttatacttggactaggaattgggggggactacgcaggaagttcaactataatgactgaattttctaatacgaagaataggggacaacttgtaggcatggtcttttctctccaaggcgtcggtcttatagcagggcctttaataacgctaggccttctaagctttatacacaacctagaccttgtatggagggtgctgtttttcataggtgctgtgcctgctttcatagtactgtacggcaggcgggcaataggcgaaacacccagatacgcacttagagtaaagggagatgcgagttcagcaatgcagagtgtcgaaaaaatttcaggagattcaaaggtttcagtatcaagggaagatttagagatgtcaaatataaaatggacggatttattcaaaaacagatactttatgctttcacttattggaacggcagggacatggtttttgcttgattgggcgttttatggaaattcgataatgtctcatgaaatgttgagcgcccttatcccgtcatctatgtcaggcttaaacaagttaaagctatctacgttttacacgcttataatattcgccgtttctgcttttcctgcatattggatagctacttttactgtagacagaatcggaagaaaaaggatgcaggtaattggttttctaataatgggcataacatttggtattctcggcatattcaggtaccttatgtcccctacattcgttacttatttccttttagtgtatggaataagctattttttcacagagttcggcccaaacgtgactaccttcatttatgctccagagatgtttccaacagcaatacgcggactcggatctggaatatcctctgcagggggtaaaactggggcattcataggaaccgcgctaaacgtaattatatttacactttatggggaaggcgaacttttccttatacttgctggaatatcgatgttaggtatgttaatgactttagtacttctacctgaaacatctagaagaaaactcgaggatatttcaggcgagggtagatatatagtaagaactgcttccggatttaaaaaatag

SEQ ID NO: 1343 - protein, 476 aa, Thermoplasma volcanium GSS1
MAKGIIEELDNSKINSFHLRTWLIAGMGFFTDAYDLFVIGTVISILPLAGWDKLNTYDISILSSISLLASVIGAVIFGRLLDALGRKRVYGFELMLLILGALGSAFVVPVNGINYLIAWRFILGLGIGGDYAGSSTIMTEFSNTKNRGQLVGMVFSLQGVGLIAGPLITLGLLSFIHNLDLVWRVLFFIGAVPAFIVLYGRRAIGETPRYALRVKGDASSAMQSVEKISGDSKVSVSREDLEMSNIKWTDLFKNRYFMLSLIGTAGTWFLLDWAFYGNSIMSHEMLSALIPSSMSGLNKLKLSTFYTLIIFAVSAFPAYWIATFTVDRIGRKRMQVIGFLIMGITFGILGIFRYLMSPTFVTYFLLVYGISYFFTEFGPNVTTFIYAPEMFPTAIRGLGSGISSAGGKTGAFIGTALNVIIFTLYGEGELFLILAGISMLGMLMTLVLLPETSRRKLEDISGEGRYIVRTASGFKK

SEQ ID NO: 1344 - DNA, 1416 bp, Thermoplasma volcanium GSS1
  CDS (1)..(1416): transl_table=11
atgaccactgaatcaaaaccggagttgatagaatccataaatgatgccaaaacaagtgggttccattacaagacatggattgtgtcaggtctaggtttctttacggatgcctatgacctgttcataataggggttgtaacgagcatacttgttctatcaggctggaacaagtttacaacacttcagtcatcgctacttgattccacagcccttttgtctgctgtaattggagcattgatatttggaaggctaatagacaagctcgggagaaagacggtgtatggcctcgaactcataatacttatagtaggtgcacttggaagtgcgttcctgacaccgttaaatggtgtatatgtattgattatctggaggttcatactgggtatcggaataggaggggactatgcaactagttcaacaataatggctgaatactctaatacggcccacaggggaaaactcgtcggaatggtgttttcgatgcagtccctggggcttcttgccgggccgttgataactctcggtttgttatattcaggcatgagcctttcactcgtctggaagcttctcctagcatttggtgccataccagccctcatagtcgtgtatttcagaagaaaaatgcctgagacgccaaggtacctactcagagtcaaaggagatgctgaggcagccgtcaagaactgggagaaatatactggcatagaagcgtctgcagatgctcaagctgaagtcataaagaaatcctggacgcagataattaaacaaaaggagtttctaattacccttgttggaacagcaggggcatggttcctaatggattgggctctttacggtaattccataatgtctagttctatgcttggagttcttgtcccctcatctgtgactggtctggatcatctgataaggacaacaatatattctgcgatgatttttggatttgcggcattccccggatactggctcgcaactttcacaatagaccgtattgggaggaaaactatacagtccataggttttgcagcaatggcactttcatttggaatacttggtgtctttcatcagcttctttctccgtcgtatattgttcagttcctattactgtatggtatgagctatttcttcataaacttcgggccaaatgtaactacattcatatacccacctgaagtgtttcctacaaaggttagggggctaggagcaggcgcttcagcagctggtggaaaaataggggccttcgtcggaacattccttaatgcaattatattacgttcttcaataggtgaatctggtctcttcatgatactagcattgctggcagcttttggcttgatcataacactggttctgcttccagagcctaagaaacttgacctagatgagtcttctggagagaaggcacttcttgtttga

SEQ ID NO: 1345 - protein, 471 aa, Thermoplasma volcanium GSS1
MTTESKPELIESINDAKTSGFHYKTWIVSGLGFFTDAYDLFIIGVVTSILVLSGWNKFTTLQSSLLDSTALLSAVIGALIFGRLIDKLGRKTVYGLELIILIVGALGSAFLTPLNGVYVLIIWRFILGIGIGGDYATSSTIMAEYSNTAHRGKLVGMVFSMQSLGLLAGPLITLGLLYSGMSLSLVWKLLLAFGAIPALIVVYFRRKMPETPRYLLRVKGDAEAAVKNWEKYTGIEASADAQAEVIKKSWTQIIKQKEFLITLVGTAGAWFLMDWALYGNSIMSSSMLGVLVPSSVTGLDHLIRTTIYSAMIFGFAAFPGYWLATFTIDRIGRKTIQSIGFAAMALSFGILGVFHQLLSPSYIVQFLLLYGMSYFFINFGPNVTTFIYPPEVFPTKVRGLGAGASAAGGKIGAFVGTFLNAIILRSSIGESGLFMILALLAAFGLIITLVLLPEPKKLDLDESSGEKALLV

SEQ ID NO: 1346 - DNA, 1356 bp, Sulfolobus solfataricus P2
  CDS (1)..(1356): transl_table=11
atgggttataataaaccggacttttcctcactagaattcaagagcgtcttaacagccggtatgggagtatttactgatggatatgaactttatgcgatttcattagttttctattatatacaaaaggaatttctattaaatggactagaggaagggatagttatagctagtgcatattatggtgcagcagtttccgcaattctattaggctttttatcagataaactaggaagaaagtttatttacggtctcgatgtagctttaatgagtttaggaatactatttcagtcaatatcaacaaattttgcagagttagtcatgtctagaataatcttaggttttgggattggcgcagattatgttctttctcctataattactgcagagaattcaaatcccaaaaatagaggaaaacgaatgatagtaacttttgcactactttggggaatgggtgcagttactgcagcatttgttgagcaaatcttgctgttagtgaacatggagaatgatctcatatggagaatagtattgtttatgggaattctcccagcaatttctgtattttacttaaggagaaaaattcctgaaacatataaattcttaactagaattaaaccgaaaccagaagagctaaaaaaactagaaaaagaaataaaaagtaaagttgcaatttctccagatgaagtcccgttctcaaaaagattcgtatcagctataggaattacaattatatcttctattctctggcttctttacgatatgtattcctctacatttgcaatctatggaccaataacaatagcgggaaatttaggtctaaatcccatagaattcacctatttggcacagtttcttgcaggtttgccaggtcagataattagcatttatctagttgacaaaataggaagaaaaccattaatcgtaataggttatgctggtgttgcattttggctttttatgtactcgatactcctcatggatccgtattactttggacttaagatacatataagtaatcctttaaaagcggcagaaagtttaaccggagaggcagcattattaggactatcattttatcttatgaactatttgtcatcagcaattggacccgcgtccataataggatcagcgatgttaaccccagagttagttccaaccaaagttagagggaccagccaagctattagtgtggcagtagatagacttgctgcagcttttagtattactgcgtttcctttgttattagctaagtttggactcccagtactactaggaatatattcgataatagctttagtatcgtgtagtataactctatttttaataccagaaactaagggagtagaattaagttga

SEQ ID NO: 1347 - protein, 451 aa, Sulfolobus solfataricus P2
MGYNKPDFSSLEFKSVLTAGMGVFTDGYELYAISLVFYYIQKEFLLNGLEEGIVIASAYYGAAVSAILLGFLSDKLGRKFIYGLDVALMSLGILFQSISTNFAELVMSRIILGFGIGADYVLSPIITAENSNPKNRGKRMIVTFALLWGMGAVTAAFVEQILLLVNMENDLIWRIVLFMGILPAISVFYLRRKIPETYKFLTRIKPKPEELKKLEKEIKSKVAISPDEVPFSKRFVSAIGITIISSILWLLYDMYSSTFAIYGPITIAGNLGLNPIEFTYLAQFLAGLPGQIISIYLVDKIGRKPLIVIGYAGVAFWLFMYSILLMDPYYFGLKIHISNPLKAAESLTGEAALLGLSFYLMNYLSSAIGPASIIGSAMLTPELVPTKVRGTSQAISVAVDRLAAAFSITAFPLLLAKFGLPVLLGIYSIIALVSCSITLFLIPETKGVELS

SEQ ID NO: 1348 - DNA, 1416 bp, Sulfolobus solfataricus P2
  CDS (1)..(1416): transl_table=11
atggataaaggaatttcaaaaacaccctttggatctatagattcgttgaagttaactttcaatcatataaaagtctggtatacttcaggtatgggattttttactgatgcctatgatttattcataataagtgcgattctagatgttttattacagttacatgaccctaatttcccacttaatagcgtaacagaaggtcttttagcgtcttcagcattatgggctgcaataatcgggcaattagtatttggttttctaggtgacaaaataggaaggaaggcaatatatggggttgaggcaattttaatgacagtaggtgctttactctccgcactctctcctaatatatattggcttataattttcagatcaattatgggtttagggataggtggggattatccaatctctgccaccataatgagtgaatacgctaatgttaaagataggggtaagctgatagctttagtttttgcaaatcaaggattaggttctttagctgcagtttcagttggtattggttctgttctagcgtttcccttagatatttcttggagagtaatggcagccataggtgcaataccggctgcgactgtaatctaccttagaagaaaaacaccagaaactcctagatattcaatgttggtgaaaggtaatgttcaagaggctaagaaagctgctgagttcctgggtgcaaaaattgaagaaaagagagcttattcgaaaccattatcattgtcagaattcctctccaagtattggttaatacttattggaactgcggttccgtggtttattctcgatatagctttctatggaactggtatatactctggtgcaataactcaattgatattaggaaaacctactagtatagcaaatttaatattggaacaaggtttaccatatatggtaggatttttcggttactttactgcagtagcattaatggacaaattagggagaaaaatcatacagttgcaaggttttatattaatgactataatttacgcagttgtttcttcgttcctaatagttagtggaactaaagtagttggtttgacaattccagctggaattggattcttgatatatgcactatcattcttcttcatagactttggtcctaatactacgacttttatactgccagctgaagcttatccaactagggctagaactactggccatggaattagtgcggcttcaggcaaattaggggcagcaataactacttacctattcccttcacttttagcctcaatgggaataaagaatattttactaatgctttctgcgctatcactagtaggcgcaattgtgacaataatagctgttaaagaaactaagggcaaaagtttagaggaaataagcaaggaagaggtaattgttcaagaagaacaattctcgacataa

SEQ ID NO: 1349 - protein, 471 aa, Sulfolobus solfataricus P2
MDKGISKTPFGSIDSLKLTFNHIKVWYTSGMGFFTDAYDLFIISAILDVLLQLHDPNFPLNSVTEGLLASSALWAAIIGQLVFGFLGDKIGRKAIYGVEAILMTVGALLSALSPNIYWLIIFRSIMGLGIGGDYPISATIMSEYANVKDRGKLIALVFANQGLGSLAAVSVGIGSVLAFPLDISWRVMAAIGAIPAATVIYLRRKTPETPRYSMLVKGNVQEAKKAAEFLGAKIEEKRAYSKPLSLSEFLSKYWLILIGTAVPWFILDIAFYGTGIYSGAITQLILGKPTSIANLILEQGLPYMVGFFGYFTAVALMDKLGRKIIQLQGFILMTIIYAVVSSFLIVSGTKVVGLTIPAGIGFLIYALSFFFIDFGPNTTTFILPAEAYPTRARTTGHGISAASGKLGAAITTYLFPSLLASMGIKNILLMLSALSLVGAIVTIIAVKETKGKSLEEISKEEVIVQEEQFST

SEQ ID NO: 1350 - DNA, 1257 bp, Sulfolobus tokodaii str. 7
  CDS (1)..(1257): transl_table=11
atgagttttgaaaaaataccttgggcaataaaagttagggcattcttcgtaagctccggaggtttcctattagatggttatgatctttcagtaatatcctttgcttccacaataatttctaaggaattttctttaacttcagccgaattaggattacttgtatcctcttcccttattggaatgattcctgggtcaataatttttggttatttagcggataagattggtaggaaaaaactgatgggattcgacctattgattttcctagttttcggcattttaacagctatctctaatagtttcgctagccttttcctttcaagactgtttttaggttttggtataggtggtgattatccgataagtagcactataatgagtgaactttcgccttctttctcaagaggaaaatatctagttggctctatatcaatgtactggatcggtactgcaatatcagccttatttaccttactcctcttacctactggtgaatatttctggagatatgtattcctagtcggtgcgataatttctttacctatagtattgctaagagttaaacttatagaatcccctagatggttagtagcaattggaaaagaaaaaggagaaaaagaacttcaagtaaaaggtgctacatcgttcatggatatatttaagggaagactacttgtagtaacattttttgtaacgtcagtatggtttttatttgatgttgcttcttatggaataggtttatattatccatatgtacttgagcagttcgcttttccgtcaaaatatgaagtagttttagggactttagcaatatcagtgggtgctataataggttacataatagcaataaacattgtggatcctttaggaagaagacttacattgattacaggtctttcagtaatgtctattttactttacttaggcgcattaacccacatatctggaagtattttagtaccatactttatgactttcgtagcttttgaacagtgggctggtgctgttacactgttctatcctacagaactttacccaacttcagtaagggcaagcgggcaaggattcgcaactgcaataagcagaattggcggtgttcttggcacattttattttcctatactagagcatcagttgggatttgctaatgtccttatgttgtttggtagtttatcccttttagccgatataatatccatagtgttagcgaaagaaacctcaagaaaaccgttagaggagactagtatttcagtttga

SEQ ID NO: 1351 - protein, 418 aa, Sulfolobus tokodaii str. 7
MSFEKIPWAIKVRAFFVSSGGFLLDGYDLSVISFASTIISKEFSLTSAELGLLVSSSLIGMIPGSIIFGYLADKIGRKKLMGFDLLIFLVFGILTAISNSFASLFLSRLFLGFGIGGDYPISSTIMSELSPSFSRGKYLVGSISMYWIGTAISALFTLLLLPTGEYFWRYVFLVGAIISLPIVLLRVKLIESPRWLVAIGKEKGEKELQVKGATSFMDIFKGRLLVVTFFVTSVWFLFDVASYGIGLYYPYVLEQFAFPSKYEVVLGTLAISVGAIIGYIIAINIVDPLGRRLTLITGLSVMSILLYLGALTHISGSILVPYFMTFVAFEQWAGAVTLFYPTELYPTSVRASGQGFATAISRIGGVLGTFYFPILEHQLGFANVLMLFGSLSLLADIISIVLAKETSRKPLEETSISV

SEQ ID NO: 1352 - DNA, 1485 bp, Sulfolobus tokodaii str. 7
  CDS (1)..(1485): transl_table=11
atgtcaaataacccctttaaatcgttggattctttgaaactttcctttaatcacataaagatatggtatactgcaggaatgggtttttttactgatgcatatgatctactaatcataggttatataatagccactatagagtatgcacatacttatgcaggaatcattataccaggttttactgaatatttgattgggcataatgcagccttttggacaggtttattagcatcttcagcaatttggacagcaattataggtcagttattatttggttatttgggtgacagattaggaagaaagagtgtttacggtattgaagctatgctgttaacactaggcgcttttctaagtgcattagcatggaatttaccagcacttatagcattcagaatgttaatgggatttggaattggtggagattacccaatatcttcaactataatgagtgaatatgctaatgttaaggacagaggaaaattagtatccttagtatttgctaatcaaggtattggatctatagtagctgcagttgtaggtattgtatcagccttaacattaccaccagatattgcatggagagtgatggcaggtattggtgctattccagctgctacagttatctatttaaggagaaaagttcccgagactcccagatattctctacttgctaagggaaacatagaagaagctaaaaaagctgccgaattacttggaacaaaattagatgtagataagcgtgtaatatcaaagagacttagtatttctgaattctttgcaaaatatggtttattattaataggaaccgctggaacgtggtttattctagatatagcattctacggtactggaacatactcttctgctgtattagctccaatctttggtagtccgtttccagctactcatgtaactttatcattagcggagttccaagcagatttagctaaagatttatttctaggtgcaataccattcttagttggatttccaggatatttcacagcagtagctttaatggataaattaggtaggaaagtaattcaattacaaggcttcgtaatgatggctttaatttacggaattgtggcatcaatagctctaacttctggaactaaaataactggatttataataccatcaactttggcatttgcaatatattcgctatcctacttctttatagacttcggtcctaatacaactacatttgttataccagctgaagtttatccagtaagatatagaacaactggtcatggaatatcagctgccagtggtaaattaggagcagctataacaacctatctattcccattgttattagcatcaataggtattaagaatattttgataatgctagcaatagtaagcattattggtgcagtactaacgtatttctttgtaccagaacctaaacataagcctttagaggaagtagcaaaagaggaattagaagaagaacaaaatgtgcaaagtcaataa

SEQ ID NO: 1353 - protein, 494 aa, Sulfolobus tokodaii str. 7
MSNNPFKSLDSLKLSFNHIKIWYTAGMGFFTDAYDLLIIGYIIATIEYAHTYAGIIIPGFTEYLIGHNAAFWTGLLASSAIWTAIIGQLLFGYLGDRLGRKSVYGIEAMLLTLGAFLSALAWNLPALIAFRMLMGFGIGGDYPISSTIMSEYANVKDRGKLVSLVFANQGIGSIVAAVVGIVSALTLPPDIAWRVMAGIGAIPAATVIYLRRKVPETPRYSLLAKGNIEEAKKAAELLGTKLDVDKRVISKRLSISEFFAKYGLLLIGTAGTWFILDIAFYGTGTYSSAVLAPIFGSPFPATHVTLSLAEFQADLAKDLFLGAIPFLVGFPGYFTAVALMDKLGRKVIQLQGFVMMALIYGIVASIALTSGTKITGFIIPSTLAFAIYSLSYFFIDFGPNTTTFVIPAEVYPVRYRTTGHGISAASGKLGAAITTYLFPLLLASIGIKNILIMLAIVSIIGAVLTYFFVPEPKHKPLEEVAKEELEEEQNVQSQ

SEQ ID NO: 1354 - DNA, 1431 bp, Thermoplasma acidophilum DSM 1728
  CDS (1)..(1431): transl_table=11
atggcacaaggactgctccagcagcttgataatgcaaaggttggaaagttccatctgagggcatgggtcatatctggaatgggctttttcacggatgcatatgatcttttcataataggcacagtagtatcactgctaccgcttgctggctggaactccctaacaacagcggatatttcgctgatatcttcagtcgcccttcttgcatcggtcataggggcatttacctttggcaggttgctggatctgctcggaaggagcagagtttacggtttcgaactcatgcttctcataataggtgctgttggcagtgcatttcttgttcctgtcaacggtgtcctgtatctgctcatttggaggttcatacttggtctcggcataggcggagattacgcaggcagctccaccataatggctgagttttcaaatgcaaagaacaggggccagctcatcggcatggtcttctccatgcagggcttcggcctcgtcttcgggccggtgatagcgcttgtgatgcttagatacatacccagcatagaccttgtatggaggctgttgctgtttctgggtgcaatacctgccgcgatcgttctctatggaaggaggacgataggtgagacgccgaggtattcaataaatgtgtcaggagacatctcttcagcaaaaaaagcgatccaggagatatccggaaaatccacagtgcaggcaaatccggatgagctgattggtgagcacataagctggaagaagatgttcacggacaggtacttccttatgacgctcataggcacggccggcgcatggtttgcccttgactgggcattttatggcaactcgataatgagccaccagatgctatctgccatagttcctgcgtctctcggaggggtggcgaaggtaaagatgaccactttctatgccctcataatatttgccgtatccgcccttcctggatactggattgcgacgtttactgtggacagaataggaagaaagccccttcagatactcgggttcttcatgatggcgttatcctacatcatactgggcgtattcagattcatatctgcgccttcttacataatctggttcatgatcatatacggccttagctacttcttcacggaattcgggccaaacgttaccactttcatatacgggccagaaatgttcccgacgtctctgaggggcatgggctcaggtctgtcatctgcaggtggcaaactgggagcgttcatagggactgcacttaacgttgtgatatacgcgatcttcggtgaaagtgtgttgttcatcattctcgcattcatatccattgccggcgcacttctgaccatgttcttcctcccggagacgtccggcaggagtcttgaggatatctccggcgagagaaactacaaaagggcactgagcagtggatccaagaagtga

SEQ ID NO: 1355 - protein, 476 aa, Thermoplasma acidophilum DSM 1728
MAQGLLQQLDNAKVGKFHLRAWVISGMGFFTDAYDLFIIGTVVSLLPLAGWNSLTTADISLISSVALLASVIGAFTFGRLLDLLGRSRVYGFELMLLIIGAVGSAFLVPVNGVLYLLIWRFILGLGIGGDYAGSSTIMAEFSNAKNRGQLIGMVFSMQGFGLVFGPVIALVMLRYIPSIDLVWRLLLFLGAIPAAIVLYGRRTIGETPRYSINVSGDISSAKKAIQEISGKSTVQANPDELIGEHISWKKMFTDRYFLMTLIGTAGAWFALDWAFYGNSIMSHQMLSAIVPASLGGVAKVKMTTFYALIIFAVSALPGYWIATFTVDRIGRKPLQILGFFMMALSYIILGVFRFISAPSYIIWFMIIYGLSYFFTEFGPNVTTFIYGPEMFPTSLRGMGSGLSSAGGKLGAFIGTALNVVIYAIFGESVLFIILAFISIAGALLTMFFLPETSGRSLEDISGERNYKRALSSGSKK

SEQ ID NO: 1356 - DNA, 1380 bp, Thermoplasma acidophilum DSM 1728
  CDS (1)..(1380): transl_table=11
atgtttgagggcttagattcacgcagaataacgttctttcagataaagagcgtcatagtcagcggcataggtatattctcagattcttacaatctttacgctatatcgcttgtatactatctcgtatctgcttcactggatctttctccacttcaggattctttgatgacttcagcatcctttatgggcgcggcggccggagccttcctctttggcttcatcgcggacagaatagggcgaaagccaatgtatgggatagaccttgcattcatagccctcggttcgttccttcaattattcactgtaaacttctatgagcttgttatattcaggtcgattctgggattcggaataggtggggactacgttctttcgccggttataatggcagagaatgcagacaccagggacaggggtaaactgatgataatgacattcccaataatggctgcctttggagccatgctcgtagcattcgtggatcagatatctctcctatatttgccgtctagtgcagtttggcatgttgtcctcgcttttggaggcgtgccagctctgcttgttatatatctgaggagaaaaatacctgaaacgccgaggttcgaagccagggttaggggcaattctacggaactatccaagatagaaaccgagatcggatcagccgttaacgtggacatagatcgaaaaccgttcatatctaggctgcgtgcctcgattctcatgataaccgtatccgccgttctgtggatactctatgacatgtactccactacattcgccatctacggaccgataacgatagcatacaaccttggcctaaccccgataaccttcacatattatgcggaattatttgctggcatacccggcgcgataatatctgcacttctcatagaccgggttggaaggcgtaagctcatagtggttggatatgctggagttttcgtctggctcttaatgtattcgcttctccttgcaaaggcatccatatttgcaggccttgcttccgatatcacaccggcaggcctcataggaaaggctgcgatactgggattcttcttctacataatgaactacctgttttcagccacagggccggcatcgataataggcggggcgatggttacgccggagataacgccaacaaaagtcaggggcacctcacagggaataactgttggtattgatcgaacagccgatgctgtaggcctcacagcttttccgatattgctttcaaaatttggcttatctgccatggtactggcctacgccatgatagcggttctttccataataatgatcttcatgatacctgaagctgcaggcaagagcctcgaagaggtgtcaaaggattacgatacgacaacacaaatataa

SEQ ID NO: 1357 - protein, 459 aa, Thermoplasma acidophilum DSM 1728
MFEGLDSRRITFFQIKSVIVSGIGIFSDSYNLYAISLVYYLVSASLDLSPLQDSLMTSASFMGAAAGAFLFGFIADRIGRKPMYGIDLAFIALGSFLQLFTVNFYELVIFRSILGFGIGGDYVLSPVIMAENADTRDRGKLMIMTFPIMAAFGAMLVAFVDQISLLYLPSSAVWHVVLAFGGVPALLVIYLRRKIPETPRFEARVRGNSTELSKIETEIGSAVNVDIDRKPFISRLRASILMITVSAVLWILYDMYSTTFAIYGPITIAYNLGLTPITFTYYAELFAGIPGAIISALLIDRVGRRKLIVVGYAGVFVWLLMYSLLLAKASIFAGLASDITPAGLIGKAAILGFFFYIMNYLFSATGPASIIGGAMVTPEITPTKVRGTSQGITVGIDRTADAVGLTAFPILLSKFGLSAMVLAYAMIAVLSIIMIFMIPEAAGKSLEEVSKDYDTTTQI

SEQ ID NO: 1358 - DNA, 1431 bp, Thermoplasma acidophilum DSM 1728
  CDS (1)..(1431): transl_table=11
atgacagaaaacaacggaggtctggacgctataaatgaggctatcaacacgtctcatggtagtttccatctgaagaccgttcttatatccggattgggcttctttacggatgcctacgatctattcataatcggtgtggtcgtttctctgctttcgctggcaggctggacgaccgtggacactttctacaagggtctcataagctcaactgcgctaatatctgcagtcataggagccataatcttcggcaggctcctcgattacctgggcaggaagagagtctacgggcttgagctggcgatccttatagtcggtgccttgggcagcgctttcctgacgccttacaacaacgttatagccttaatagcgtggaggttcatcctgggtataggtatcggcggcgattacgccactagctcaaccataatagcagagtattcgaataccaagagcaggggcaagctcataggcagtgtattctcaatgcagagctttggactggttgcaggcccattggtagcgcttgcgttcatgcttcacggtattccgccggcaataacctggaaggccctgctggccataggggccataccggcagcaatcgtgatatacttcaggctgaagatgcccgagccgcctagatacacggcagcagcaaagggagacgtacacaaggctgcaaaggatctcaaggagtacaccggaatacatgttgaagtatcatccaaggataaatacgttgtgaaggccaaatggaccgcacttttcaaggacaggacttttctccttacgctgatcggtaccatgggtgcctggttcatgatggactgggcgctgtacggcaactcgataatgtcatcgacgatactttccgcacttgtaccatccacgattaaaggccttccagctctgataagatccacagaatacaccctgttgatatttgctggtgcagcattccctggctactggatagcaacttcagtgctggataagataggcaggaagaccatacagctcattggattcgcagttatggcactttcgtatgcactaattgcgataggctaccactcgataataggcaacataagcatgttcctggcgctgtacgggctcagctatttcttcatagagttcgggccaaacgtcaccacgttcgtgtatccgcccgaggtgtttccggtcacaacaagggggcttggaacaggtatgtcggcggcaggaggcaagataggcgcattcatcggtacctttgccgatgcgataatactcggcacagatgcgtctgcgcatctaccattcctgttctcgctcctcgccgtattcgcagttataggtttcgcactgacgctggtattgcttcctgagacaaagggaaggaatcttgaggacacgtcaggtgagaagaggtatacggtaaaggcctga

SEQ ID NO: 1359 - protein, 476 aa, Thermoplasma acidophilum DSM 1728
MTENNGGLDAINEAINTSHGSFHLKTVLISGLGFFTDAYDLFIIGVVVSLLSLAGWTTVDTFYKGLISSTALISAVIGAIIFGRLLDYLGRKRVYGLELAILIVGALGSAFLTPYNNVIALIAWRFILGIGIGGDYATSSTIIAEYSNTKSRGKLIGSVFSMQSFGLVAGPLVALAFMLHGIPPAITWKALLAIGAIPAAIVIYFRLKMPEPPRYTAAAKGDVHKAAKDLKEYTGIHVEVSSKDKYVVKAKWTALFKDRTFLLTLIGTMGAWFMMDWALYGNSIMSSTILSALVPSTIKGLPALIRSTEYTLLIFAGAAFPGYWIATSVLDKIGRKTIQLIGFAVMALSYALIAIGYHSIIGNISMFLALYGLSYFFIEFGPNVTTFVYPPEVFPVTTRGLGTGMSAAGGKIGAFIGTFADAIILGTDASAHLPFLFSLLAVFAVIGFALTLVLLPETKGRNLEDTSGEKRYTVKA

SEQ ID NO: 1360 - DNA, 1380 bp, Thermoplasma acidophilum DSM 1728
  CDS (1)..(1380): transl_table=11
atgatatcctcaatgactgaatcatgggaggaattaaaagaaagagcttatggcccaatggacaaacaaaaatcaaaatggttcaactataaaatgctattattgactggaggtggcatattcgttgatggatacaatatagtcatcatatccttcggtttagcaggaatagaaacactgttcggtctacaacacaatgcttttttagttgggctcataggaatatcggtgattatagggaatttagtaggagccttgctttcaggttattttgtcgacaaggtcggaaggcgaacgatatttataattgatcttatattatttgtattttttgcaataatatccgggctagtgacaaatgcatacgaactcgtagtagcgcgcctcttggtaggtttaggaataggattagattatccaatagccacttcatatctcagtgaatataccccaattaatccaaggggaaaattcttggtcatgaatataacattcttcaatattgcaggagttgttgcagctatagttggatactcactcttgccattgggtgcaacgattgcctggagatatatgttaatgtctgctgcagttccagccgccattacaatagctggaagaatacgaactccagaatctccaagatggttacttgagcatggaaggaaaaaagaagctatacaggccattgaaagagtaacagagagcaccttgccagatgatacccaaaaattcataatggattccaacgtaaaaccaccggtatcaggctattataaagagcttcttacgaaatatactaaaagtgcaattttcataggtcttttctatttcttcttcgcaattgcatttgtaaacgcctctttgtatgggccttcaatccttgcatcctttggagaagctggtcttatcggttcttcattatattggttgcttttcgtcgtaggagacatcatctgtatactagtaatcgattcatttggtcgaagaaattctacgctaacaggctgggctggtatgctgataactatgataatcttagccttcgctccatcaaatctaaaattactttctcttggtgcatttatactatttgcaatgttccagggtatagggcctggtagtcttcatatggtatattctccagagctctttccaaccagaatcagagccactgcggagggatggaaacaaggtataggtagattaggtggagtgcttacaggtctgttcttcccaagtctggtgataggagataagctgttaatattaattctaacctctatagctggacttgtattatcaatactgatggctccagaaactaagagaaaagggctggaagagatttcagaaaaagacataaaccttcagatataa

SEQ ID NO: 1361 - protein, 459 aa, Thermoplasma acidophilum DSM 1728
MISSMTESWEELKERAYGPMDKQKSKWFNYKMLLLTGGGIFVDGYNIVIISFGLAGIETLFGLQHNAFLVGLIGISVIIGNLVGALLSGYFVDKVGRRTIFIIDLILFVFFAIISGLVTNAYELVVARLLVGLGIGLDYPIATSYLSEYTPINPRGKFLVMNITFFNIAGVVAAIVGYSLLPLGATIAWRYMLMSAAVPAAITIAGRIRTPESPRWLLEHGRKKEAIQAIERVTESTLPDDTQKFIMDSNVKPPVSGYYKELLTKYTKSAIFIGLFYFFFAIAFVNASLYGPSILASFGEAGLIGSSLYWLLFVVGDIICILVIDSFGRRNSTLTGWAGMLITMIILAFAPSNLKLLSLGAFILFAMFQGIGPGSLHMVYSPELFPTRIRATAEGWKQGIGRLGGVLTGLFFPSLVIGDKLLILILTSIAGLVLSILMAPETKRKGLEEISEKDINLQI

SEQ ID NO: 1362 - DNA, 1752 bp, Schizosaccharomyces pombe 972h-
  CDS (1)..(1752)
atgggcttcaagttgaatccattttcaaaaaagcccaaagatgaggagcctttacccttagagcaatatgaagcttctgagcaaaaaattttaggccttgtcactaaaaaggaggccaaacttcttgcaattgctggtactggttttcttttggacagttacgatcttttcattattaacttggtttcgccaattcttgcttatttgtattggggtggattgacaggacatcaagattatccttctggtattcgcggtgttgtaaatgctgctaccaacattggaaatattatgggtcaacttttatttgggtttttgggtgatttcttcggtcgtaaatttgtctatggcaaagaaatgatggttgtcattatcgctactattttaatcatttgtctccctgatcgtattcctacaccgactgctaaaatgatgtggctttttgctttccgtgttatgttgggtattggtattggtggtgattatcctatgtctgcatccatcacttcagagcagtcattgattaaccgccgtggtgctttgctcgcttggattttctccaaccaaggatggggtactctggctggctgtgttgctactttgattattttggcttgtttcgaaaaacctttgaatgatcgcggtgagtatacgaagctgaatggcgtttggcgcattcagtttggcattgctctctttccagctgtgatcgttttgattccacgcttgcgtatgcaggaatcagaacaatttaagaattcaaaaaacatgaaatctcccggggagggtgatcttgattctgcctctcaaatcgaattacatgatttcaagaaaaaagagtccttaactgcggagtttacaacttcttccccttctacagcttccttgtccgataaaaagaacccaggttccgttcatatccgtcccaataacgaagttgctcccagcagtgctcctagtcgtgctccttctactacctctgtcgaatctaatacggaaggtaaggagtctgatattcaaaccggttcttcgtttgtttcatactttaaagagtggagacatgctaaacttttaattgggtctgcgctttcatggtttttgcttgatattgctttttacgggataaatttgaatcagtctgttattcttcaagaaatggggtttaacaaaggtgtcaacgaatatcatattcttcaaaagaatgcaatcggtaatctgattattgcagttgctggctacattcctggatattgggtgagtgtcgtattgattgaggtaatgggccgaaaatggattcaaattcaaggtttccttatttgctgtcttttatttggcgttttagctggaacatgggaaactatttcaactggtggtcgctttgcgtgcgtcgctcttgcccaatttttcttcaactttggtccaaacaccacctgctttgtcattcctgcggaagtgtttccctccagagttcgtgctttttcacatggcatatgcgctgcatgtggtaaggccggtgccattttatctgctcttctattcaataaacttaccgaggtaattggttttggcaatgttttgtggatattcttcggatgcatggttgctggagctgttgttactttaattttgcctgaaactgctaatcgtgatgcggatttgattgatcgtcttgaaattgctgccatgcaacaaggtagaacttctattatcgatagaagcgagaagtgggcctggtggaaacatggcatttaa

SEQ ID NO: 1363 - protein, 583 aa, Schizosaccharomyces pombe 972h-
MGFKLNPFSKKPKDEEPLPLEQYEASEQKILGLVTKKEAKLLAIAGTGFLLDSYDLFIINLVSPILAYLYWGGLTGHQDYPSGIRGVVNAATNIGNIMGQLLFGFLGDFFGRKFVYGKEMMVVIIATILIICLPDRIPTPTAKMMWLFAFRVMLGIGIGGDYPMSASITSEQSLINRRGALLAWIFSNQGWGTLAGCVATLIILACFEKPLNDRGEYTKLNGVWRIQFGIALFPAVIVLIPRLRMQESEQFKNSKNMKSPGEGDLDSASQIELHDFKKKESLTAEFTTSSPSTASLSDKKNPGSVHIRPNNEVAPSSAPSRAPSTTSVESNTEGKESDIQTGSSFVSYFKEWRHAKLLIGSALSWFLLDIAFYGINLNQSVILQEMGFNKGVNEYHILQKNAIGNLIIAVAGYIPGYWVSVVLIEVMGRKWIQIQGFLICCLLFGVLAGTWETISTGGRFACVALAQFFFNFGPNTTCFVIPAEVFPSRVRAFSHGICAACGKAGAILSALLFNKLTEVIGFGNVLWIFFGCMVAGAVVTLILPETANRDADLIDRLEIAAMQQGRTSIIDRSEKWAWWKHGI

SEQ ID NO: 1364 - DNA, 1326 bp, Coxiella burnetii RSA 493
  CDS (1)..(1326): transl_table=11
atgaccaaccaggttcaaaaccctacactagaatctttagacgaacagaaacttaaccgcctgcattggcgtatggtgattaccgctgggacgggattttttacggatgcttatgatttattcgttatcggcgttgtcacggcattattgatgccgttatggcaccttagcgcctctcaaattgcgctattaaacggtgcttcgcttgcctcggcagctgtaggggcggtaatgtttggatggtttgccgataaatttggtcgaaagaaaatgtatggcattgaagtgcttatcctatttatcggcgctttgctttcggctgtttcgccgtcttttgcttggcttttggtttcccgaattatcgtaggcattggaatcggaggcgattatccaactagtgctgtcgtggcgagtgaatatgccaatcgaaaaaaccgtggctttttagtgctgctcgtgtttgcgatgcaggcggtagggttgattataggtccgctgtttgcctctttattgatggcgtttcatctgccgcatgcacttgtatggcgactattgctcgcctttggagcgctaccagcagcctctgttttttatttacgaagaagaatagcggaaacgccgcgatttttattaaacaaatctccggtggaagtaagtcgtgtggtcagtgacctggcgggtcattctgacacagcggtcgccactcctgtccagaaactcttctccccgaaatggcttaaatgcttgatcggaaccgctggtgcctggtttttgctagacgtcgctctttatggcaatggtgtctcctccgtgcttatcatgaaagcgattagtccgcacgcctcgttattaaaacacacccttctttctgcccttatttttctttgttttgcggttcccggctatttttccgctgcgacctatgtcgataagattggacgaaaaacgcttcaaatagcgggttttgtcatgatgggtttatgttatttactcattgccggaatcccgcatattagtgatcagttacctctctttgtgggaatctttggaatcagtttcttttttatcaatttcgggcctaatgcaacgacttttctgattccttccgaaatataccccattcacctacgtgcgcgagcacacgggttatccgccgccgtgggtaaagcaggcgcgtttatcggtgctttctttttacctttgttattaaaaaatatggggttggcctacacaatggcggtcgtagcaatcgcttcttttctcggtatttttgcaacttttttagtgcctgaaatgaaaggggtctctctggaaaaaccccagtag

SEQ ID NO: 1365 - protein, 441 aa, Coxiella burnetii RSA 493
MTNQVQNPTLESLDEQKLNRLHWRMVITAGTGFFTDAYDLFVIGVVTALLMPLWHLSASQIALLNGASLASAAVGAVMFGWFADKFGRKKMYGIEVLILFIGALLSAVSPSFAWLLVSRIIVGIGIGGDYPTSAVVASEYANRKNRGFLVLLVFAMQAVGLIIGPLFASLLMAFHLPHALVWRLLLAFGALPAASVFYLRRRIAETPRFLLNKSPVEVSRVVSDLAGHSDTAVATPVQKLFSPKWLKCLIGTAGAWFLLDVALYGNGVSSVLIMKAISPHASLLKHTLLSALIFLCFAVPGYFSAATYVDKIGRKTLQIAGFVMMGLCYLLIAGIPHISDQLPLFVGIFGISFFFINFGPNATTFLIPSEIYPIHLRARAHGLSAAVGKAGAFIGAFFLPLLLKNMGLAYTMAVVAIASFLGIFATFLVPEMKGVSLEKPQ

SEQ ID NO: 1366 - DNA, 1329 bp, Coxiella burnetii RSA 493
  CDS (1)..(1329): transl_table=11
atgcgatgggttatcgtcgtgaaggatgatgagagtaatatcaaagcattccattggcgaatcgtttttacggcgggaatggggttttttaccgatgcttatgatttatttatcatcggggttgttaccaccatcctcactccaatctggcatttaaccatttcccaattagctttattaaacggcgccgcgctggcggcggcggctgttggcgccatttcttttggtgttttgtctgacaaatttgggcgaaaaaggctgtatggtgtagaagttcttatcctttttttcggagctattctttctgcgtttcccccctcctacggatggcttttgttctctcgaatagtcgtcggtttaggcattggtggtgattatccttccagtgctattatcgccagcgaatatgcgcccagtcaaagacgtggttttttagtcttgctcgtctttgccatgcaagcgctcggtttggtggtcggccctttattggcttctcttttattggtcaccccgctttcgcacacgctggtttggcgcattttgctaggtattggggccatcccagcggcttctgttttctatcttcgacgacaaattgaagaaacgccccactatcttctgaaaaaatcgccgccggttgccgttagccgagtcgtgtcagatttaacaggcttcaccaaaaaaattaaagcccagcaagttcctcacccacagcactatttatttgaaaaaaaatggctcgtccgtctcattgggacggcgagtgcatggtttctgctggatgtcgccttttatggaaacagcgtttcatcggtccttattttaaaatggcttaatcctcaagctcaattagtcactaatacccttttaaccgctttaactttttttgtttttgctgtccctggttatctcttagccgctacttatatcgaccgcattgggagaaaatttttgcaaatgtttggattttttatgattgcagtggcttacggcgctatcgcgcttatccctcacttgactcagcacatcccgttatttattgccattttcggcatcagctttttcttcgttaattttggaccaaataccaccacttttttaattccttcggaaatctaccccaccagtttgcgcgcaagggcccatggaatttcagccgcttggggtaaggtaggcgcttttgtaggcgcttttttcttaccccacattttgcacacccaaggattacgctacaccatggcgcttcttgcagttgtttgtcttattggcattttagtcactttgttattaccggaaatgaaaggtaaagccattgatgtgatcgaataa

SEQ ID NO: 1367 - protein, 442 aa, Coxiella burnetii RSA 493
MRWVIVVKDDESNIKAFHWRIVFTAGMGFFTDAYDLFIIGVVTTILTPIWHLTISQLALLNGAALAAAAVGAISFGVLSDKFGRKRLYGVEVLILFFGAILSAFPPSYGWLLFSRIVVGLGIGGDYPSSAIIASEYAPSQRRGFLVLLVFAMQALGLVVGPLLASLLLVTPLSHTLVWRILLGIGAIPAASVFYLRRQIEETPHYLLKKSPPVAVSRVVSDLTGFTKKIKAQQVPHPQHYLFEKKWLVRLIGTASAWFLLDVAFYGNSVSSVLILKWLNPQAQLVTNTLLTALTFFVFAVPGYLLAATYIDRIGRKFLQMFGFFMIAVAYGAIALIPHLTQHIPLFIAIFGISFFFVNFGPNTTTFLIPSEIYPTSLRARAHGISAAWGKVGAFVGAFFLPHILHTQGLRYTMALLAVVCLIGILVTLLLPEMKGKAIDVIE

SEQ ID NO: 1368 - DNA, 1755 bp, Magnaporthe grisea 70-15
  CDS (1)..(1755)
atggcatccgagggcgtcgtcacaactcctgatgctgagcgcatcgcagcagtcaaggccaacaacttgactgctggcggcaacgcggccttcaagaacttcaacaaccagtttgcccacatcgacgaccgggccgagcgtcgccgactggctcttgcagagattgaccgtgcaccatttgggtggtaccatgtcaggactatctgcatcgcaggtataggtttcatgaccgactcgtacgacatttttgctgtcggtctgattacaagtctccttggcattgtctacttcaacggcaagatctcaagccaggatgacacagccatcaaagtcgctacctcttgcggaactgttgttggccaggtcggatttggagtcattgcagactggatcggacgaaagaagatatatggtgttgagcttatcatcattatcgtaaccactctgatccaggccttgtcctccaactctccggctgtttccatcatcggcctcttggttttctggcgtatcctcatgggcatcggcattggtggagactaccccctatcggctacgatcacttccgagtttgcgaccaccaagtggcgcggcttcatgatgaacgccgtgtttgccatgcaaggcattggtcagctttgcgctgccctggttctgctcgtcctctcggcggcattcaaatcgcagcttgaactggcctctagcccggccacttgttcaacgacaggtgcttgccttactgctgttgacaggatgtggaggcttatcattggctttggcgctattcctggttgcatcgctctctatttccgcttgacaatacccgagaccccacggtatacttttgacgtcgagaacgacgcagacaccgccaggggggcgctcaagtctgacgccaacgccactaccgctgtcactgagagccccgaggaggagacagcttcgcgagcagagttcatgaggcactacaagcagtggaagaacctgaaagtccttctcggctgtgccttgtcctggtttttcttggacattgcattctacggacttggtctcaacaaccccattattctgaacgcgatcggctggtcaggcggcagcaacatgtaccaggtcctttacaacactgccgttggcaacctcgttctcgttctcgccggtgccgtccccggatattgggtatcggccgggctcattgacactgtcggacgcaaacctatccagctttttggattctttgccctgacacttatcttcttcgtcattggcttcaagttctgggacctcaccggcaacgagcttttggctctctacaccatcgcccagttcttcttcaactgcggacccaacagcaccacctttatcatcccaggcgaagtcttcccgacacgctaccgatccactagtcacggcatttcagcagcatctggcaaaatgggtgccatcattgcacaagtcgtatttggacctttgaaggacattggtgccaacccgacccttgccaagacggacccgaagtgggctgccccgtggctcaaccacatcatgcagatctttgcctgcatcatggctctgggcttcttcacgacccttctgcttccagagacggcgaggaaaacccttgaagagctcgggggcacagatgctaccatcggccattcagtttccgacgtggttgaggagaaatcaagctctccggaatttaggagcaccagctcggacgatagggctgcctctgagcatcgtgctgacgcgtaa

SEQ ID NO: 1369 - protein, 584 aa, Magnaporthe grisea 70-15
MASEGVVTTPDAERIAAVKANNLTAGGNAAFKNFNNQFAHIDDRAERRRLALAEIDRAPFGWYHVRTICIAGIGFMTDSYDIFAVGLITSLLGIVYFNGKISSQDDTAIKVATSCGTVVGQVGFGVIADWIGRKKIYGVELIIIIVTTLIQALSSNSPAVSIIGLLVFWRILMGIGIGGDYPLSATITSEFATTKWRGFMMNAVFAMQGIGQLCAALVLLVLSAAFKSQLELASSPATCSTTGACLTAVDRMWRLIIGFGAIPGCIALYFRLTIPETPRYTFDVENDADTARGALKSDANATTAVTESPEEETASRAEFMRHYKQWKNLKVLLGCALSWFFLDIAFYGLGLNNPIILNAIGWSGGSNMYQVLYNTAVGNLVLVLAGAVPGYWVSAGLIDTVGRKPIQLFGFFALTLIFFVIGFKFWDLTGNELLALYTIAQFFFNCGPNSTTFIIPGEVFPTRYRSTSHGISAASGKMGAIIAQVVFGPLKDIGANPTLAKTDPKWAAPWLNHIMQIFACIMALGFFTTLLLPETARKTLEELGGTDATIGHSVSDVVEEKSSSPEFRSTSSDDRAASEHRADA

SEQ ID NO: 1370 - DNA, 2055 bp, Gibberella zeae PH-1
  CDS (1)..(2055)
atgccagactacgacgacatgctccccgagcctgcctccggctctcatcaggatcgaacttggggcggcaacaatgcttttcacaactttttcaacgatttctctcacatccccgacccaaatcttcgccgccgtcttgccttgtctgagattgataaggttccttttggcgcataccatatccgtgctgttttagtggcaggtgttggtttcttcctggattcatatgatatctttgctattaacctcatcacaatacttcttggagtcgtcttctggggagatccaaaccctcagaatgggtttagcggcaatgatggttacctccctgaccgagttaaccaagctttcaaagcatccaccagtgctggaattgtggtgggcatgatatggttttggccgacgacccctgctatggggtcaaccggcctcctgatcttctggcgcatcatcatgggaatcggcatcggcggtgattatccactatccagtgttattacatctgagttcgcacccacaaggtggcgtggtgctatggttgctgctgtcttttctatgcaaggacttggacaacttgcggctgctatcgttgccctgatcactaccgttgcgttcaagaatgcttttgtcggcgttgccgatgaaagcctatgcggtttcgaatgtcgattagctgccgaccgagcatggcgaattatcgttggggtcggcgccattcctgcttgtgccgccctctactaccgaattactattccagaaacgcctcgatacacattcgacgttgagctcgacgtcgaaaaagccgatgccgacatcaaagcatacgtagcgagcaagtccaaagggtcattcgatgtggttcatcaggttcgatccaagcgctcatctacgcgtggccttaatgtgcctcgcgcatcatggtctgatcttattgccttcttccgccaatggaccaacttgaaaatgctccttggcacaaccctttcgtggttcttcctggatctggctttttatggtctaggactcaacaatacctttatcctccacgcagtcggttacggtgctggcaacaatcttttcgaaaaacttcaaaaccaagcagtgggaatgatcatcttgacttgtgccggctcgctccctggctactggatggctattctcacagtcgacacaataggacgcaagccactgcaagtcattggtttccttctactcacaattctcttctgcgttcttggttttacatacaacaacctaacccaagggggcctacttgcactgtacatcgtcgggcagtttcttttcaacgctggcccaaacacaaccacgttcatcgttcctggcgaatgcttcccgacccgatatcgctccactggacacggaatcagtgccgctatgggcaagattggtgctatcgttgcccaagctattagcatccctatggttcgtcaaggagcctcagagaattgcaaagatgctgaatgcacaccaaatatgcatcggttgctccaactctttgctcttttcatgttattcggtacttttacctctttgttgattcccgaaaccaagggcatgaccttggaggagctgtctggggagccccggacgagctataactcgggatgtaatggaagcataagtctcggatcacctaaactcagggcatggaatcctttccatggtggtcagcctgcaggattctcatatcctaggtccagagcgagccagtttcgaaagagcgatcgtgttggcatcatgacgtcgccggagctcatggccgaaacgtctcgactccggaaaacgcgtctctggaggagacatcgcaaggccaagtcgagcagtggtacagacatcgccttgagcacccgaagctcgggcacggcggatgacgatatcttcccggcaggaccacctgctgctacaacaaccagtcctcctccgccaccgcctccaagttggggagctggctggggacggatagaccgaggagggccacctccgttgttgaactcggttcagctacaggatgttggtagcctccttacaaaatga

SEQ ID NO: 1371 - protein, 684 aa, Gibberella zeae PH-1
MPDYDDMLPEPASGSHQDRTWGGNNAFHNFFNDFSHIPDPNLRRRLALSEIDKVPFGAYHIRAVLVAGVGFFLDSYDIFAINLITILLGVVFWGDPNPQNGFSGNDGYLPDRVNQAFKASTSAGIVVGMIWFWPTTPAMGSTGLLIFWRIIMGIGIGGDYPLSSVITSEFAPTRWRGAMVAAVFSMQGLGQLAAAIVALITTVAFKNAFVGVADESLCGFECRLAADRAWRIIVGVGAIPACAALYYRITIPETPRYTFDVELDVEKADADIKAYVASKSKGSFDVVHQVRSKRSSTRGLNVPRASWSDLIAFFRQWTNLKMLLGTTLSWFFLDLAFYGLGLNNTFILHAVGYGAGNNLFEKLQNQAVGMIILTCAGSLPGYWMAILTVDTIGRKPLQVIGFLLLTILFCVLGFTYNNLTQGGLLALYIVGQFLFNAGPNTTTFIVPGECFPTRYRSTGHGISAAMGKIGAIVAQAISIPMVRQGASENCKDAECTPNMHRLLQLFALFMLFGTFTSLLIPETKGMTLEELSGEPRTSYNSGCNGSISLGSPKLRAWNPFHGGQPAGFSYPRSRASQFRKSDRVGIMTSPELMAETSRLRKTRLWRRHRKAKSSSGTDIALSTRSSGTADDDIFPAGPPAATTTSPPPPPPPSWGAGWGRIDRGGPPPLLNSVQLQDVGSLLTK

SEQ ID NO: 1372 - DNA, 1707 bp, Gibberella zeae PH-1
  CDS (1)..(1707)
atggcccaagaagcgcgtcccgtcgcaaagacgagtggcggaaataatgcctttcacaacttccacaacgactttgcccacatcgccgaccccaatgagcgtcgccgtctcgcccttgcagagattgacaaggctccctttggatggtatcatgttcgagcatgcatcgtcgcaggtgtcggtttcttcactgactcgtacgatatcttctgtgtctccatgttgaccatcatgctcggcatcgtctactatcccgggaagggtaagttgcccaccagctctgacaatgccatcaagctgtctacttctgccggtacggtgataggacagcttggctttggtatgctggccgatattgtcggtcgaaagcgcatgtatggtctggagttgatcgtcatcatctttgctacgcttgctcaggccctgactgctggatcgccttccacctcccttgttggacttatcatcttctggcgtgttatcatgggcgtgggtatcggtggtgactatccattgtcttccatcattacttcagagttcgctactaccaagtggcgaggtgccatgatggctgccgtctttgccatgcaaggtatcggccaacttgtcgcagctcttgtcatgatgttcctcactctcggcttcaagtcttctcttgagcaagctgccgatacaaagagctgcactggagattgccaaattgctgttgacaagatgtggcgaacacttgttggcttcggagctgtccccgcttgcattgccctctactaccgtcttactatccctgagactcctcgttacacctttgacgtcgcccgtgacgtcgagcaggccgatgaggacgtcaaggcttatatcaacggcaagagcgaaggcaacaccgacgaagtcacccgtgcccagaaccttcaatccgccaagactaacctcgaagtccccaaggccagctggagagacttctttcagcactacagcaagtggaagaacgcctctctgcttcttggaactgctggttcatggttctgtctcgatgtggctttctatggtctctctttgaataacggaaccatcctcaaggttattggatattccaccaaggatgctactaatgtctacgagtttctccacaacacagctgtcggaaatatcattattgtcttggcaggagctgttccaggttactgggtttctgtggcgactattgatactcttggacgaaagacgattcaacttggtggtttcattatcctaactatccttttcattgtcatgggctttgcttacaaccacatcccttccaacggacttttggctatttacgttcttgcccaattctttttcaactttggccccaacaccactactttcatcgtccctggtgaagtattccctactcgataccgttcaacctcccacggtatctctgctgccagcggtaaaatcggttccatcatcggccaaggtgccatttccatcctccgaacccacggagccacagataagaacgaggcaccttggatggaccacgttcttgagatttacgctcttttcatgcttcttggtatcttcactactctgttgattcccgagactgctcgcaagactcttgaggagctttcgggtgaagatgactacgccaaccatgatcatgcgttggagtcagagactcaggctagtcacgacaaggctggacgaaccagcgtttag

SEQ ID NO: 1373 - protein, 568 aa, Gibberella zeae PH-1
MAQEARPVAKTSGGNNAFHNFHNDFAHIADPNERRRLALAEIDKAPFGWYHVRACIVAGVGFFTDSYDIFCVSMLTIMLGIVYYPGKGKLPTSSDNAIKLSTSAGTVIGQLGFGMLADIVGRKRMYGLELIVIIFATLAQALTAGSPSTSLVGLIIFWRVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGKSEGNTDEVTRAQNLQSAKTNLEVPKASWRDFFQHYSKWKNASLLLGTAGSWFCLDVAFYGLSLNNGTILKVIGYSTKDATNVYEFLHNTAVGNIIIVLAGAVPGYWVSVATIDTLGRKTIQLGGFIILTILFIVMGFAYNHIPSNGLLAIYVLAQFFFNFGPNTTTFIVPGEVFPTRYRSTSHGISAASGKIGSIIGQGAISILRTHGATDKNEAPWMDHVLEIYALFMLLGIFTTLLIPETARKTLEELSGEDDYANHDHALESETQASHDKAGRTSV

SEQ ID NO: 1374 - DNA, 1743 bp, Candida glabrata CBS 138
  CDS (1)..(1743)
atgagcagaaacgagaaggacgagatcgaagtagacaccagggagaagaaagtccctgtgcacatcacggaaggtggtaacatggccttccacaactacttgaacgatttcgcacacattgaggacccattggagagaaggaggctggctttgcagaagatcgacgagaggccgttcggctgggaccaagtccgtaccattctgatcgcgggtgtcggtttccttacagactcgtacgatatcttcgccatcaacttgtctatatcaatgatgtcctacgtgttctggcaaggtaacatgccaaactccacacagacgctgctgaaggtctccacctctgtcggtacagtcatcggtcaattgggtttcggtaccatggccgacattgtcggtcgtaagaagatatacggtttggaactgatagtcatgatcgctactaccatcttgcagaccaccattggccgttccccaggtattaacttcccagccgtgctgaccttctaccgtattgtgatgggtatcggtatcggtggtgactacccattgagttccatcatcacatctgagttcgctaccactaagtggagaggtgccatcatgggtgccgtgttcgctaaccaggcatggggtcagatcgcgggcggtctggttgcgttgatcgttatccgtgcttacaaaggtgatttgatctatgccaactctggtgccgagtgtgactacgcctgtcaaaaggcctgtgaccaaatgtggagaatcctaattggtttcggtgccgtcccaggtattatcggtctatacttcagattgaccatccctgaatccccaagatacgccctagatgtcaaggaagaagttgacttgccatctaacattgagaaggtccgtgccactgccgacgatgagcacttggaggacctagaaagatcatccactgttgtcgaagacggtatcgtcgtcccaccaccaaagaaggcctcctggaaggatttcagaagccatttcggtaagtggaagtacggtaagattctattgggtaccgccggttcttggttcgtgctggatgtggccttctacggtttaagtttgaacaccgccattatcttgcaaaccattggttatgctggttccaagaacgtgtaccacaagcttgacgactccgctgtcggtaacctgatcttgatctgtgctggttccctgccaggttactgggccactgtgtttactgttgataccattggtagaaagcctatccagatgatgggtttcatcatcctaaccgcgttgttctgtgtcattggtttcgcttaccacaagatcagcgaccacggtctgctggctctgtacgttatctgtcaattcttccagaacttcggtcctaacgttactactttcatcgtccctggtgaagtgttcccaaccagatacagatccactgcgcacggtatctctgctgcgtgcggtaaagtcggtgccatcattgcacagaccgccttgggtactctgatcgaccacaactgtgccagagacggcaagcctaagaactgttggttgccacacgttatggagatcttcgcgctgttcatgctgctcggtatcttcttgacgttgctgatcccagagaccaagagaatgaccctggaggagatctctgagaagtaccacgacgaagtggacatctccaagctggccccagttactgtcgccgacagcacttcctcgtcctctgtctcacacatggtttga

SEQ ID NO: 1375 - protein, 580 aa, Candida glabrata CBS 138
MSRNEKDEIEVDTREKKVPVHITEGGNMAFHNYLNDFAHIEDPLERRRLALQKIDERPFGWDQVRTILIAGVGFLTDSYDIFAINLSISMMSYVFWQGNMPNSTQTLLKVSTSVGTVIGQLGFGTMADIVGRKKIYGLELIVMIATTILQTTIGRSPGINFPAVLTFYRIVMGIGIGGDYPLSSIITSEFATTKWRGAIMGAVFANQAWGQIAGGLVALIVIRAYKGDLIYANSGAECDYACQKACDQMWRILIGFGAVPGIIGLYFRLTIPESPRYALDVKEEVDLPSNIEKVRATADDEHLEDLERSSTVVEDGIVVPPPKKASWKDFRSHFGKWKYGKILLGTAGSWFVLDVAFYGLSLNTAIILQTIGYAGSKNVYHKLDDSAVGNLILICAGSLPGYWATVFTVDTIGRKPIQMMGFIILTALFCVIGFAYHKISDHGLLALYVICQFFQNFGPNVTTFIVPGEVFPTRYRSTAHGISAACGKVGAIIAQTALGTLIDHNCARDGKPKNCWLPHVMEIFALFMLLGIFLTLLIPETKRMTLEEISEKYHDEVDISKLAPVTVADSTSSSSVSHMV

SEQ ID NO: 1376 - DNA, 1701 bp, Debaryomyces hansenii CBS767
  CDS (1)..(1701)
atgagcagtattactcaagaaatccaagctcacgaagtgtctaactcgggtggtaagaccgctttcaaagattacatcggaaagtacgcccacattgaagacccattggaaagaagaagattggcattggaagatattgataatgctggatttggatggacccaaataaagatgatcatgattgccggtgttggtttcatgactgattcatacgatattttcgcgattaacttgtctgttactatattatcgtatgtgtactggtctggtgttatgccagattccaccactaccttgattaaagtttcaacctcggttggtaccgttatcggtcaattagggtttggtattatggctgatgtcgttggtcgtaaaaagatttatggtttggaattgattgtgatgattgcagccaccattttccaatgttgtcttggtgaagcccctggtgtgaactttgtggcaatcttctccgtattgagaatcattatgggtatcggtattggaggtgattatccattatcgtccattatttcttctgaattcgctaccacgaaatggagaggtgccattatgggtgctgttttctctaaccaaggtcttggccaaattttagccggtattgttaccattgtctgcgttgccggttacaaaaatcaattgattggtgctactattgactctgccaccaaaattgccgactgtgatgctacttgtcaaaaggcttgtgaccaaatgtggagaattgtcgttggtttcggttgtgttccaggtgtcattgccttatactacagattgaccattgctgaatccccaagataccacttagatgttgatgaacatgatgaccttgaaaaagttgttgaagctgaagttgtccttgacaaggctgccgctgacattgctccaccaaaggcttctttcgttgaattctggaagcatttcggtcaatggagatacggtaagattttaatcggtactgctggttcttggtttatgttggatgttgcttattatggtttaggtttaaacactgctaccattttacaaaccattggttacgccggtggtgacaatgtgtatgatgttttatacaactctgctgctggtaacttaattttagtttgtgccggttccttgccaggttactgggccactgttgccactgttgacattattggtcgtaaaccaattcaaatcggtggtttcgttatcttgactattttattatgtgctatcgggtttggttatgataaattgaagaacgagacgactaatggtttattagccttatatgtcttatgtcaattcttccaaaatttcggtccaaatactactaccttcatcgtccctggtgaagttttcccaaccagatatagatcttctgctcatggtatttcagccgcttctggtaaagtcggtgctatcattgctcaaacctgtattggtactttaattaaccacggctgtgctgccgatgataagaactgtttcttacctcatgttatggaaatctttgcattattcatgttgattggtatctttacctcattattaatcccagaaaccaagagaaagaccttggaagagatcgctgaaagatatcatggtgaaattgataccactaagttagttcaagacagaatgaccgaagcccctcgtggccaagatgattctttcagctccgatgctaagcaatag

SEQ ID NO: 1377 - protein, 566 aa, Debaryomyces hansenii CBS767
MSSITQEIQAHEVSNSGGKTAFKDYIGKYAHIEDPLERRRLALEDIDNAGFGWTQIKMIMIAGVGFMTDSYDIFAINLSVTILSYVYWSGVMPDSTTTLIKVSTSVGTVIGQLGFGIMADVVGRKKIYGLELIVMIAATIFQCCLGEAPGVNFVAIFSVLRIIMGIGIGGDYPLSSIISSEFATTKWRGAIMGAVFSNQGLGQILAGIVTIVCVAGYKNQLIGATIDSATKIADCDATCQKACDQMWRIVVGFGCVPGVIALYYRLTIAESPRYHLDVDEHDDLEKVVEAEVVLDKAAADIAPPKASFVEFWKHFGQWRYGKILIGTAGSWFMLDVAYYGLGLNTATILQTIGYAGGDNVYDVLYNSAAGNLILVCAGSLPGYWATVATVDIIGRKPIQIGGFVILTILLCAIGFGYDKLKNETTNGLLALYVLCQFFQNFGPNTTTFIVPGEVFPTRYRSSAHGISAASGKVGAIIAQTCIGTLINHGCAADDKNCFLPHVMEIFALFMLIGIFTSLLIPETKRKTLEEIAERYHGEIDTTKLVQDRMTEAPRGQDDSFSSDAKQ

SEQ ID NO: 1378 - DNA, 1734 bp, Yarrowia lipolytica CLIB122
  CDS (1)..(1734)
atggccgataacaacgtgaccgaaggtggaaacgccgccttccacaactatgtcaacgactttgctcacattgaggaccccaacgagcgacgacgactcgccctggagaagattgacaacgccagcttcggctgggagcacattcgagccatcaccgtcgccggtgttggtttcatgactgatgcctacgatatcttcgccattaacctgggtatcaccatgatgggatacgtctactggggtcagaccatcaacggtcccggtaagccccccacctccactgccactctgctcaaggtgtccacctcagttggtaccgtcattggacagtttggtttcggtattcttgccgatatcgttggccgaaagcgaatctacggctccgagctcatgctcatgattggagccaccatctcccagtgtatggccggccattccgaggctatcaactttgttgccgttcttaccttctggcgaattgtcatgggtatcggtatcggaggtgactaccctctgtcttccattatcacttccgagttcgccaccacccgatggcgaggtgccatgatggctgctgtcttcgccaaccagggctggggtcagctcatgggtgccatcgtctccattgtttgcatggctggtttcaagaaccagctcgagccctctcacagcgccaaggactgtggcaaggtctgtcgacaggccctggacatgtcctggcgaattctggtcggatggggttgtgtccctgccatggccgctctctacttccgactgaccattcccgagaccccccgatacacctttgatgtgtctcgagacattgaaaaggcccagaaggacattgaaaagtacaccaacggtgacaccagcggcgataactccgacaagaacgatgagattgaggctctgcgagccaaggccgaggccctggccacccagcaggcttcttacgctccccccaaggcttccttcaaggatttctgccgacatttcggacagtggaagcacggaaagattctcattggtaccgccggctcgtggttcttcctggatattgccttctacggtcttggtctgaacaactcccagattcttaaggctatccatttcgataagggagacaacctgtactctactctgatgaagaactccatcggtaacctgattcttgtctgtgccggagccattcccggatactggatttctgtggtcaccatcgataccattggccgaaagcccattcagattggaggtttcctcattctggttgctctcttctgtattatcggtttcggatactacaagatccacgatggaggtctgcttgcatgctacattctgtgtcagctctttgaaaactttggccccaacaccaccaccttcattgttcccggagaggtgttccccacccgataccgatcttcggcccacggtatctctgccgctgctggtaagatcggagctattatcgcccaggtcgttattggtactctgattgaccacaactgtgctcgagacggtaagcccgccggatgttggcttaaccacgtcatggagattttcgccctcttcatgctctgtggattcttcgtctccttcctcattcccgagaccaagcgaaagaccctcgaacagctgtccgaggagctgcatggtgagatccagtggcgacccccccacgagatggagcactcttctcatgacttcaatgaggaggagaagtcggtctaa

SEQ ID NO: 1379 - protein, 577 aa, Yarrowia lipolytica CLIB122
MADNNVTEGGNAAFHNYVNDFAHIEDPNERRRLALEKIDNASFGWEHIRAITVAGVGFMTDAYDIFAINLGITMMGYVYWGQTINGPGKPPTSTATLLKVSTSVGTVIGQFGFGILADIVGRKRIYGSELMLMIGATISQCMAGHSEAINFVAVLTFWRIVMGIGIGGDYPLSSIITSEFATTRWRGAMMAAVFANQGWGQLMGAIVSIVCMAGFKNQLEPSHSAKDCGKVCRQALDMSWRILVGWGCVPAMAALYFRLTIPETPRYTFDVSRDIEKAQKDIEKYTNGDTSGDNSDKNDEIEALRAKAEALATQQASYAPPKASFKDFCRHFGQWKHGKILIGTAGSWFFLDIAFYGLGLNNSQILKAIHFDKGDNLYSTLMKNSIGNLILVCAGAIPGYWISVVTIDTIGRKPIQIGGFLILVALFCIIGFGYYKIHDGGLLACYILCQLFENFGPNTTTFIVPGEVFPTRYRSSAHGISAAAGKIGAIIAQVVIGTLIDHNCARDGKPAGCWLNHVMEIFALFMLCGFFVSFLIPETKRKTLEQLSEELHGEIQWRPPHEMEHSSHDFNEEEKSV

SEQ ID NO: 1380 - DNA, 1728 bp, Yarrowia lipolytica CLIB122
  CDS (1)..(1728)
atggacgctcagaacaagactgccggtggtaacgccgctttccacaacttcgtgaacgacttcgctcacattgaggaccccaatgagcgacgacgactcgcgctggagaagattgactccgcttctttcggatggtaccacatccgagccatcatggttgccggtatcggtttcatgacagactcttacgatatcttcgccatcaacctgggtatcaccatgatgtcctacgtttactggggccagggaactggccacgatggtcacattcccgattccaccaacaccctgctcaaggtctccacttctgtcggtaccgtcatcggtcagcttggtttcggtattcttgctgatgttgtcggccgaaagaagatctacggtgttgagctgattctcatgatcggtgctaccattgctcagtgtatgactggccactctcaggccatctccttcgttgccgtcctcaccttctggcgaattgtcatgggtatcggtatcggaggtgactatcctctgtcttccattatcacttctgagttcgctaccaccaagtggcgaggagccatgatgggtgctgtcttcgccaaccagggctggggccagctcatgggctccatcgtcgccatctgttgtgttgctggcttcaagaactctcttgagccctaccacggcgccaacgactgtggctttgactgtcagcaggctctcgataagtcttggcgaatccttgtcggatggggttgtgtccccgccatgtgcgctctgtacttccgactgaccattcccgagaccccccgatacacctttgacgtttctcgagacattgagaaggctcaggctgacattgacaagtacacttctggcgagcacggaaacgcctcccccgaggagattgaggctctcaaggcccaggctgaggagctccagacccagcagaacgcttacaacccccccgttgcctctgccggcgacttcttccgacatttctcccagtggaagcacggaaagattctgcttggtactgccggttcttggttcctgctcgatgttgccttctacggactgggtcttaacaactccaccattctgcacaccattggtttcgataagggtgacaacctgtactccaccctcatgaagaactccgtcggtaacctgattcttatctgtgccggtgccatccccggatactggctctctgttgtcaccgtcgacttcattggccgaaagcccatccagattggaggtttcaccatcctgactgctctcttctgtattattggtttcggttacgacaagattggagagggaggtctgctcgcctgttacattctgtgtcagctctttgagaactttggtcccaacgtgaccaccttcattgtccccggagagtgctaccccacccgataccgatcttccgctcacggtatctctgctgcttccggtaaggtcggtgccatcattgcccaggtcgttattggtactctggtcaaccacaactgtgaccgagacggaaagcccaagggatgttggctcaaccacgtcatggagatcttcgccctcttcatgctgctcggtatcggtacttctttcctgattcccgagaccaagcgacgaacccttgaggatcttgctgaggagctgcacggtgaggtccagtggcgaccccctgtggaggaccaggctgaggatgtctccgacttcaacgacaacgagaagtctgtctaa

SEQ ID NO: 1381 - protein, 575 aa, Yarrowia lipolytica CLIB122
MDAQNKTAGGNAAFHNFVNDFAHIEDPNERRRLALEKIDSASFGWYHIRAIMVAGIGFMTDSYDIFAINLGITMMSYVYWGQGTGHDGHIPDSTNTLLKVSTSVGTVIGQLGFGILADVVGRKKIYGVELILMIGATIAQCMTGHSQAISFVAVLTFWRIVMGIGIGGDYPLSSIITSEFATTKWRGAMMGAVFANQGWGQLMGSIVAICCVAGFKNSLEPYHGANDCGFDCQQALDKSWRILVGWGCVPAMCALYFRLTIPETPRYTFDVSRDIEKAQADIDKYTSGEHGNASPEEIEALKAQAEELQTQQNAYNPPVASAGDFFRHFSQWKHGKILLGTAGSWFLLDVAFYGLGLNNSTILHTIGFDKGDNLYSTLMKNSVGNLILICAGAIPGYWLSVVTVDFIGRKPIQIGGFTILTALFCIIGFGYDKIGEGGLLACYILCQLFENFGPNVTTFIVPGECYPTRYRSSAHGISAASGKVGAIIAQVVIGTLVNHNCDRDGKPKGCWLNHVMEIFALFMLLGIGTSFLIPETKRRTLEDLAEELHGEVQWRPPVEDQAEDVSDFNDNEKSV

SEQ ID NO: 1382 - DNA, 1995 bp, Aspergillus nidulans FGSC A4
  CDS (1)..(1995)
atgagcaaattccgcgcgagactgtataagactgatcgcgcgagggatttcgagcatgagcaggatcgccatgttcgcacccgtcaaatctacgaaaccatcgaccgccagtccttccagtggattgttgtcctcgtcgccggcgtcggcttcttcctcgatgggtataccttattcgcaagcaatatcgcccttccaatgatttcctacgtctattggcgtgaagacacctcttccttccgactgacgtgcatcaacatcgccacgctgagcggcaccctcctcggccaagtcctgttcggctatctggcggaccgcaacgggcggaagaagatgtacggcgttgaactggcgctgctgattgcgtcgacgctgggcgtcgcgatgtcctcggaggggacacacgggagcatgagcgtctttgcgtggctgatctggtggaggatcatcgtggggatcggcgtcggtgcagattacccgttgagtgccgtaattacgtctgagttcgcacccacccgccatcgcgcgcgcatgatcgcctccgtcttcttcatgcagccgctcggtcagatcgctggcaatatcgtctcactgatcgtcgccgtcctgagcaagaagcagggacatgacgatgtcacacgcgcagttgatatcatgtggcgatgggtggtcggaatcggcgtcgtgcccggcgtcatcgcgacattctttcgcttctttatccccgagagtccgcgctttctgctggaaatcgaagacgatccggtgcaggccgagttcgatgccacgacactgttcagcgacccggcgcctctgtcgagcctcgggtcgccagagattgccgttgaggagggatatcggtatcccggttcggcgtcgactgctctcactagtatgactactgccacggcgaaccaattcaacgatatcaacctcattgccccatggaatgaaatcatacttcctgctcctgcgctccccgcaacagccacaacgatgggcacgggcaagggcacgagtacagctgccggtcccgacacagccggcaccggtgctggagccctaacgattcgctccatgtccattgacgacttcacagaccggaccccttcccagtaccacgatagcctccctgaaggcacgttcctcaccccggcaacgctcaacagccactggcgcctcaccaaggtcgacataacgcaatacttctggcatgagggcaactggcgcaccctgctcgccacgtcgctctcctggctgctcctcgattttggcttctacggtataggtctctcctcgccccagtttctcgcgaagacctgggacagtctcaaactctccggtcccgccccgccctggatgacagacgacaccggcgcaactgatatatacgacatgttccgcgacacgagcatccactgcctgatcatcctcaatattggcagtttcgtcggcggggtcctgatgctgctgactatccacaaactcgaacgcgtctcgctgcagaaatacggctttctagcgctagcagcccactttatcgcgcttggaaccatgttcatcaccgtgcacaaggagggccccgtcgcggtgacgctctacattatcgggcagatcttgttcaatttcgggcccaacacgacaacttacatgatccctgctgagatcttcccaacacgataccgcgcaacgtgccacgggatcagcgcgggcgcgggaaagctcggctcgatattgattcagctgctctcggcgtattataaattcggcacggggcccggcaatgagcagacggtccgccatgggtatatgttgatcgtgtttagtgcgtgtatggttattggggcggcggtgacgcatttctggatcccgccgacgcagagaaagagcagtgatgggagggcgaagctttggggaggcaaggcggagacgctagaaacgctcgggcttgggagaagagggtggaagagtcggtttgccggtgtgagaaggtga

SEQ ID NO: 1383 - protein, 664 aa, Aspergillus nidulans FGSC A4
MSKFRARLYKTDRARDFEHEQDRHVRTRQIYETIDRQSFQWIVVLVAGVGFFLDGYTLFASNIALPMISYVYWREDTSSFRLTCINIATLSGTLLGQVLFGYLADRNGRKKMYGVELALLIASTLGVAMSSEGTHGSMSVFAWLIWWRIIVGIGVGADYPLSAVITSEFAPTRHRARMIASVFFMQPLGQIAGNIVSLIVAVLSKKQGHDDVTRAVDIMWRWVVGIGVVPGVIATFFRFFIPESPRFLLEIEDDPVQAEFDATTLFSDPAPLSSLGSPEIAVEEGYRYPGSASTALTSMTTATANQFNDINLIAPWNEIILPAPALPATATTMGTGKGTSTAAGPDTAGTGAGALTIRSMSIDDFTDRTPSQYHDSLPEGTFLTPATLNSHWRLTKVDITQYFWHEGNWRTLLATSLSWLLLDFGFYGIGLSSPQFLAKTWDSLKLSGPAPPWMTDDTGATDIYDMFRDTSIHCLIILNIGSFVGGVLMLLTIHKLERVSLQKYGFLALAAHFIALGTMFITVHKEGPVAVTLYIIGQILFNFGPNTTTYMIPAEIFPTRYRATCHGISAGAGKLGSILIQLLSAYYKFGTGPGNEQTVRHGYMLIVFSACMVIGAAVTHFWIPPTQRKSSDGRAKLWGGKAETLETLGLGRRGWKSRFAGVRR

SEQ ID NO: 1384 - DNA, 2172 bp, Ustilago maydis 521
  CDS (1)..(2172)
atgccattcggaacttcaatggatgcctgggcatccttctacgactatgccagtgacgatctcgcagtcgcaagtgctgtcggatcagcgcgtgcatcttccgagcttgatcatgccgagcctctgcccatagatgatcgactgggcgctttacgtcagtcagcactccgcccagattcagtcgttttctcagcattgcaaccaatgcagcccgagaatagtccatcttttcttccaagctggcacaatcataagtgtacgagcacaccaacccatctcagctcggtagctctagatcatcaccatgatcacgatccgtcttcacagcttcgctatccgcgtttcgatccctgctcgcgcctttctcacagccaagaagtacagaaaaatatgctgcagcaggagactaacttcagctacaatgtcacacctccattggcgctagtggaacggcatatggcaagaacatggatcggtcttacatggggtgaaatcaagctgctcgcccttgcgggtgccggattcttcatggactcatatgatttgttcatcatcaacatggtttatccaatcctcctattggcgtactaccctctgggaacaagcaatatcgaatggggcttgtccggtggagtattgaaagcgtccgcgagcatgggaaacgtcgttggccagcttcttttcggctttcttggtgacttttggggccgctcggtactctacggtaaagagcttatgcttgcgatgcttgccatcattctcatgatctcagctcctgatacccttcgtggccaaggcgtcactatctggattgcagcttttcgattcttgatgggtatcggaatcggcggtgactatcctctctcagcgactgtggttgcggatcgatcaagcaccaagacgcgcggattgctgctgtcgcttatcttcagcaaccaaggatggggtgctctagctgcggcgctgtctgcgttggctgttatcgcaagctacagctcgtcaattttgtctgacaatctgtccgagcttagtggagcttggcgcattcttcttggccttccactcgcaccgggtttcgtagtactctatttccgcttgaccctaatcgagtcggctcgtttcgtgcaagcgcgctatctacaagatcacgatgatgtggccatccgtgccgctgctgcagggatcgatcttccggaaatctcggcaacgcgagggttagtgaggccaacaagcgcctatgcaggcacagaggtggccaagcaagcccatctacgacggaaacactctgaattgccgtcgtgcccatcgtcctttctcggctcaaacggagcaagtacaaacagtggtcatggggtagccaaacatcatttccattcaagcttgcctcggcggcaactgcctttccctcgagagctgcgtgaagcgatgcgaaaggccgccacgcaaagcaagggtctttctttcaactctatcggtgtggcacgcaacgacttttgggaatactttagtgaatggcgacacctcaaagtccttttgggcacatccatctcgtggtttttggtcgacatcactttttatggcatcaacctcaaccaatcgggcatctttgcgctgattggctatacacagggcagcgcatggcaccgcatctacaagcaggcgctaggcaatttgatcgtggtgctggcgggtttccttccgggctactatctcactgtcgccttgatcgaggtcatcggacgcaagaagatccaattgtttggctttgcggccaatgcattgctgtttctggtgctggctcttagctacaacaccatcatccaccaagcggcccccttctttgccgtgtttgtgctgttgcaactcagcttcaattttggaagcaacagcaccacgtttgtagtcccggcagaggtcttccccacacgcgttcgagctactgctcacggcttctgtgcagctatgggcaagctgggtagcattgtctcttctcttggatttagcatactggccaccagtccaagctttggacacacgggcatattttggatctttctcggcgtgagcttgcttggcttcgtcgtgactctgcttctggtgccagagacaaagggttacgatgctgatatggtggatcgacaagagatgctggacagaccaagcagggcctga

SEQ ID NO: 1385 - protein, 723 aa, Ustilago maydis 521
MPFGTSMDAWASFYDYASDDLAVASAVGSARASSELDHAEPLPIDDRLGALRQSALRPDSVVFSALQPMQPENSPSFLPSWHNHKCTSTPTHLSSVALDHHHDHDPSSQLRYPRFDPCSRLSHSQEVQKNMLQQETNFSYNVTPPLALVERHMARTWIGLTWGEIKLLALAGAGFFMDSYDLFIINMVYPILLLAYYPLGTSNIEWGLSGGVLKASASMGNVVGQLLFGFLGDFWGRSVLYGKELMLAMLAIILMISAPDTLRGQGVTIWIAAFRFLMGIGIGGDYPLSATVVADRSSTKTRGLLLSLIFSNQGWGALAAALSALAVIASYSSSILSDNLSELSGAWRILLGLPLAPGFVVLYFRLTLIESARFVQARYLQDHDDVAIRAAAAGIDLPEISATRGLVRPTSAYAGTEVAKQAHLRRKHSELPSCPSSFLGSNGASTNSGHGVAKHHFHSSLPRRQLPFPRELREAMRKAATQSKGLSFNSIGVARNDFWEYFSEWRHLKVLLGTSISWFLVDITFYGINLNQSGIFALIGYTQGSAWHRIYKQALGNLIVVLAGFLPGYYLTVALIEVIGRKKIQLFGFAANALLFLVLALSYNTIIHQAAPFFAVFVLLQLSFNFGSNSTTFVVPAEVFPTRVRATAHGFCAAMGKLGSIVSSLGFSILATSPSFGHTGIFWIFLGVSLLGFVVTLLLVPETKGYDADMVDRQEMLDRPSRA

SEQ ID NO: 1386 - DNA, 1596 bp, Ustilago maydis 521
  CDS (1)..(1596)
atggctttcggtaaggacatggacgcctgggccggcgacactggcctggcccttgttgaaaagaacgagaaaaagtcgcgctttgccgtctcgtgggccgaagccaagcttctcacgattgctggtgtcggtttcttgatggacgcttgggacttattcatcatcaacatcatctactcgattatcctgatcgcttactatcccaaaggcaccaagaacatcgactggggtctcgagggcggcgtgctaaaggccgccgccaacattggtaacattgttggtcagctcttctttggtttctgcggtgacatgttcggtcgctccgctgtctacggcaaggaactcttcattgttatcgtagccgtcatcctccagatctcggctccagactctattggcggtcatggcatcactatctggcttactgtcttccgtttcatcatgggcatcggcattggcggtgactaccccatgtcagccacaatcgtctcggaccgagcgcatctcaagaaccgtggcttccttctcagctggatcttctccaaccagggttggggtaacctcactggtgccctcttcgccgttattgtcattgctggctaccgccactacgtcgacgctggcgacgtacacaagctttcgggcgcttggcgcattcttcagggcctcaccctgattcctgccttcatcgtgctctatttccgtctcacccttgtcgagtcgacccgtttcactcaggctcgtaaactccaggacgaccctgagcttattgccaagggtcagaacaacctcaaccgctccaactcggacgacgatggcattatcaaggagaaggcccttggcggcgacatgacccccatcgagaacaccgccgttggcatgtcctttaagtcgatcggaaagcccaagaacgagttcatcgactacttctcccagtggaagaatgccaagaagctcttcggttgtgctgccacctggttcctggtcgacattaccttctacggtatcaatctcaaccagtcttccatccttaacgctattggcttcaccaacggttccacctggggcaaactcatgaaaactgcgactggaaacctcatcatcacttgcgccggtttcttgcctggttacttcttcaccatgttcactgtcgacattgtcggccgtagggctatccaactctttggtttcatcatgaacgctctgttcctcggcatcctcgccggtcgcttcgatcacctcaagcaccagactggtcccttcttcgtcgtcttcgtcttcttgcaacttactttcaactggggtgccaacgcaacaacgttcatcgtccctgccgaagccttccccacccgagttcgtgccaccgctcacggtttctgtgccgcgtgcggtaagtgcggtgccattctgtcgtcgctgctcttttcgcaccttgccaccaagaccagtcttggaaaccagggtgtcttctggatcttctttggtgtctcgatcctcggtgccattgtgacctacttatttgttcccgagaccaacgagtacgacgctgatgaggaagaccgcaaggagcttgctgcccgcgccggtgttcagtag

SEQ ID NO: 1387 - protein, 531 aa, Ustilago maydis 521
MAFGKDMDAWAGDTGLALVEKNEKKSRFAVSWAEAKLLTIAGVGFLMDAWDLFIINIIYSIILIAYYPKGTKNIDWGLEGGVLKAAANIGNIVGQLFFGFCGDMFGRSAVYGKELFIVIVAVILQISAPDSIGGHGITIWLTVFRFIMGIGIGGDYPMSATIVSDRAHLKNRGFLLSWIFSNQGWGNLTGALFAVIVIAGYRHYVDAGDVHKLSGAWRILQGLTLIPAFIVLYFRLTLVESTRFTQARKLQDDPELIAKGQNNLNRSNSDDDGIIKEKALGGDMTPIENTAVGMSFKSIGKPKNEFIDYFSQWKNAKKLFGCAATWFLVDITFYGINLNQSSILNAIGFTNGSTWGKLMKTATGNLIITCAGFLPGYFFTMFTVDIVGRRAIQLFGFIMNALFLGILAGRFDHLKHQTGPFFVVFVFLQLTFNWGANATTFIVPAEAFPTRVRATAHGFCAACGKCGAILSSLLFSHLATKTSLGNQGVFWIFFGVSILGAIVTYLFVPETNEYDADEEDRKELAARAGVQ

SEQ ID NO: 1388 - DNA, 1668 bp, Cryptococcus neoformans var. neoformans B-3501A
  CDS (1)..(1668)
atgtcgagccagttcgaggttgaaaaagctcacgccaacgtcccaatgtctgccggtgaaagacgacgtgctgctcttgcggaaattgatgaagccagtttctcctggtttcacgctaaagcctgtatagttgctggcgtcggatttttcacagacgcttatgatatattttccatttctatcgccgccaccatgattggttacgtttaccacaacggtggttccaacaccagtaatcaggatttgggtatcaaagttgcccattctattggcactttcttcggtcagctcctctttggttatctcgccgatcacattggtaggaaaaggatgtacggtgttgaattgatcattatcatcattggtactctcggtcaggcggtcgccggccatgctccaggcgttaatatttatggtgttttgattatgtggcgttttatcatgggtattgggattggaggtgactatccggtttcttctgtcatcacctccgaattcgcagcccgtaagattcgaggaaggatgatggctgctgttttctcagctcaaggttggggaaacttcacttgcgctattgtcgcagtgattgtcgtcgctgcttataaggactctatccattctcagcctcttgatgacttgaaatccgtcgaccaagcgtggcgtctcatcataggtatcgggtgtgttcccgccgttatagctctctacttccgattgactattcccgaaactcctcgctacacaatggatgttgagcgaaacatcaaacaggcttctcaagatgtcgatgcgtacatcactaccggtcaatacattgcagacccagtacaaatcaatgatcgcgccgaggtccctaaggcttcatggtctgatttcgctcgtcatttcgggcagtggcagaacggcaaagttttacttggcacttcttggtcatggttcgccttggacattgcgttttatggtctaggactaaactcatcaactattttgtcaaccatcggcttcggttcttctaccgaccttccaaccaaacaagaaaacatctatcaaacattatacaatgttgctgtcggtaatattattttggctgttggaggactaattcctggatactatttctccatggcatttatcgattcatggggtcgaaaacctatccaactgatggggtttgtactccttacgatcatttttgtctgtatgggcttcggttacgataaaatgctttctaccgatcccggcaaaaaggcctttgtcttcctctattgcatggcaaactttttccaaaattttgggcccaacactacgacctttatagtccccggagaagtcttccctactcgttaccgatcaactgcccatggtatctccgccgcatcaggcaagctgggcgccatcgttgcccaggtcggattttccaggcttatcaatattggtggcacaaaccagttcctcaagcacatcttggaaatcttcgctttcttcatgcttaccggtgttttcagcacattacttcttcccgagactaagaaccgaagcctagaggacttgtcacaggaagatcaagaaaattttgttaggaactctggtatggccactgctgtccctatggtacagaagactggcacttcatcagacgatgagagggttcttgctggggctctgtag

SEQ ID NO: 1389 - protein, 555 aa, Cryptococcus neoformans var. neoformans B-3501A
MSSQFEVEKAHANVPMSAGERRRAALAEIDEASFSWFHAKACIVAGVGFFTDAYDIFSISIAATMIGYVYHNGGSNTSNQDLGIKVAHSIGTFFGQLLFGYLADHIGRKRMYGVELIIIIIGTLGQAVAGHAPGVNIYGVLIMWRFIMGIGIGGDYPVSSVITSEFAARKIRGRMMAAVFSAQGWGNFTCAIVAVIVVAAYKDSIHSQPLDDLKSVDQAWRLIIGIGCVPAVIALYFRLTIPETPRYTMDVERNIKQASQDVDAYITTGQYIADPVQINDRAEVPKASWSDFARHFGQWQNGKVLLGTSWSWFALDIAFYGLGLNSSTILSTIGFGSSTDLPTKQENIYQTLYNVAVGNIILAVGGLIPGYYFSMAFIDSWGRKPIQLMGFVLLTIIFVCMGFGYDKMLSTDPGKKAFVFLYCMANFFQNFGPNTTTFIVPGEVFPTRYRSTAHGISAASGKLGAIVAQVGFSRLINIGGTNQFLKHILEIFAFFMLTGVFSTLLLPETKNRSLEDLSQEDQENFVRNSGMATAVPMVQKTGTSSDDERVLAGAL

SEQ ID NO: 1390 - DNA, 1317 bp, Picrophilus torridus DSM 9790
  CDS (1)..(1317): transl_table=11
gtgaatgaaggttcaatactaaaaaaacttgatgcatctccaataaagagataccattattttataacagcgctttcagatgcgggttactttcttgacggctacgatcttctggtaataggaccggcacttctttttattataccaattttacatatatcagtatatatatctgcattgataggcgtttctacgattataggccagcttgtaggcggtgcattctttggagtcctggcagatctaaatggaagaaaatcaatataccagtgggacatgctcatatttgcagtgtttgcgattttaagcgggctgtcccaaaatgcaattgagctcatcatttttaggacacttcttggacttgcaataggtgcagattatgcattaacactttcaattataggtgagtacagccctgtgaaaggccgtggaaagcttcttggcacaggtttgatgtcctggtggataggcggtgcgtttgcagtctttcttggctatttgctatacccatacggatcattttcatggcgttatctgcttgccgcaggtgcaataccagcaatcatcgttttaatattaagaaggcgtgttgaggagacaccaagattcgctgttgagaagcacaatgatggtgaaataaaggacatagaggaaaagataggccttgataatgtcagttatgccaatgatgctttagataatatacctgtaaattatccaaaaagggcgttctttacatttacatcatggttttttaacgaccttatattctatggtataggaatatacacatcaacattattacttgaactgcattacagcacacacagggcatcgctttcactcacactttatttatatttaataggtgttattgcaacagtattctttgtttttacagcagatatactgggcagaaagaaatggcaggaatacacattccttgcccaggggctttcactattaatacttgcattgtatgcaataatcataggaagggcaccaccacttcttttactgttccctatgtttgcaatattttactttgcaaatgccggtggtaccggtgagaccactggcatctttgtcagcgagctgttcccgacaaggatcaggacaacggccatgggtgcaggaacggcaataagcagggttggggccattatatccgccattgttttcccaataacagtgaatatctatgggccaatacccatggagatactattatttatcatagggctgcttggattcttaataacatacttccttggaatagaaacaaagaataaatcactggaaagtcttgatagataa

SEQ ID NO: 1391 - protein, 438 aa, Picrophilus torridus DSM 9790
MNEGSILKKLDASPIKRYHYFITALSDAGYFLDGYDLLVIGPALLFIIPILHISVYISALIGVSTIIGQLVGGAFFGVLADLNGRKSIYQWDMLIFAVFAILSGLSQNAIELIIFRTLLGLAIGADYALTLSIIGEYSPVKGRGKLLGTGLMSWWIGGAFAVFLGYLLYPYGSFSWRYLLAAGAIPAIIVLILRRRVEETPRFAVEKHNDGEIKDIEEKIGLDNVSYANDALDNIPVNYPKRAFFTFTSWFFNDLIFYGIGIYTSTLLLELHYSTHRASLSLTLYLYLIGVIATVFFVFTADILGRKKWQEYTFLAQGLSLLILALYAIIIGRAPPLLLLFPMFAIFYFANAGGTGETTGIFVSELFPTRIRTTAMGAGTAISRVGAIISAIVFPITVNIYGPIPMEILLFIIGLLGFLITYFLGIETKNKSLESLDR

SEQ ID NO: 1392 - DNA, 1392 bp, Picrophilus torridus DSM 9790
  CDS (1)..(1392): transl_table=11
atggtagaggatcaaaacatattaaatcaggctgatagggcacccacagggagattccatttaaaggccatatttgtggccagcatgggtttctttacagatgcctacgatttatttgctatatctacagcactgccattgattgtttccgcatccgtctttgatgtaacaaaccattttgttcagggacttgttggtgcggccgtattgattggagccgtcataggagcccttacattcggcaggataggcgacatacgtggcaggaaatacgtctatggagttgaaatggcaatactggtaacatttgcagtaatctcggcattctcagtaaacatctggatgctgataatcacaagactgcttcttggcataggcataggcggagattatccaataagctcaacaataatgagcgagtactcaaatgtaaagagcaggggcaagatggttcagaccgtttttgcaatgcagggctttggcctgcttcttggagccgtcataggacttattgcaattcacacaatgccggttaactatgcatggaggttcatgcttggattcggagcaataccggcggcgtccgttatatatctaagaagaaagataaaggaaacaccaaggtattcactgcagaccaaaggtgatgtaaaggcagccgcagcagccgttgaggatataacaggatcaaagatagatgtaaaggactcaaatataaacgtttcaaaaaaatccggaatattaacaaaatacattgcgcttttgataggaactgccggaagctggtttttatttgatatggcattctatggaacatcaataaacaactcaataatattcaatgcaataggctatggaagcgtaacaaatgctgttctatcagcatcaaacacggcaataggaaatataataatagcggcagcatttgaaatacctggatactggatagcatttggattaatagaccgcgtcggcaggaaatttttacagtggatgggcttcagcgtcatgggaataatatatctaatatttgcactggcatttgcaccgcttaaggcagatataccattgttcatagggctttatggattatcattcctgttcgcaaacatagggcctaactcaacaacgtttatactaccaacggaattattcccaacgcaggttagaacaacagcgcatggtatatcagcaggtgccggtaaaacaggtgctgcaatatttacatttgcactgccatcaatagaggctgcccttggacttaaaggcgtctttgcacttcttacaggattttcattcatagcagttattataacattgctgttcataagggaaacaaagcagaagagccttgaacagacaagcaggcaggattcagttatggcacattaa

SEQ ID NO: 1393 - protein, 463 aa, Picrophilus torridus DSM 9790
MVEDQNILNQADRAPTGRFHLKAIFVASMGFFTDAYDLFAISTALPLIVSASVFDVTNHFVQGLVGAAVLIGAVIGALTFGRIGDIRGRKYVYGVEMAILVTFAVISAFSVNIWMLIITRLLLGIGIGGDYPISSTIMSEYSNVKSRGKMVQTVFAMQGFGLLLGAVIGLIAIHTMPVNYAWRFMLGFGAIPAASVIYLRRKIKETPRYSLQTKGDVKAAAAAVEDITGSKIDVKDSNINVSKKSGILTKYIALLIGTAGSWFLFDMAFYGTSINNSIIFNAIGYGSVTNAVLSASNTAIGNIIIAAAFEIPGYWIAFGLIDRVGRKFLQWMGFSVMGIIYLIFALAFAPLKADIPLFIGLYGLSFLFANIGPNSTTFILPTELFPTQVRTTAHGISAGAGKTGAAIFTFALPSIEAALGLKGVFALLTGFSFIAVIITLLFIRETKQKSLEQTSRQDSVMAH

SEQ ID NO: 1394 - DNA, 1326 bp, Picrophilus torridus DSM 9790
  CDS (1)..(1326): transl_table=11
atgtttgagaacagaagaattgatagcatacctgtaagcccaatgctgttaaagataacggcattatcatcaatgggcgtcttcatggacggctatattttaacaatatattcaatagcctatatttacatgtcaggttatttaaatccatcctcaaatgcggttataactgcattcatgggatcctcgctttttataggaatgctgcttggcggcttctccatggggcatcttgcagataccctgggaaggaaaagattgtatgaatacgatttatcattgactgctgtctttcttatacttactgcattatcattcaatgtctatgaattcataatctttgagatacttgcaggaataggcataggcgctgattatcctataagctcatcgatacaggcagagttctcgccgagaaacaccaggggcagatttttgatctttaacatatttgcatggacaataggaagcatcgtctttcttttattatcgataccaatcatacattacacaggggcatatcaatggcgttttatgtacggaaccgccgcgataataccattaatagttatattaagcaggagaacgctgccggagagccccttctggctatcgcatatgaacatgaaggataaggcccttgaggtctcgaacagggtctcatcgtccattggcatagaattaaacgagataccgaaaacagagagtggaagaagcagtttcagggatcttttttcaaacaggtatttaaagtacacagtttttgtttcactggcatggttttcatatgatattgcaagctacggcgtctgggagtacacaccttcggtattctttactggaagctcaagcatcgttgcatcggtttttgcaacaattctcgaggagatacctgtctttgcaggctttttaatatgcatatacttcattgaaagggcgggcaggcgtgaccttgaattaataggcttcggcggtgctgccatttcattattcatatttgaaatgatctacggttatgtaagaatagatatagtatttacatttcttgcatttgcaacgatgcatttgttccataaccttggaccgacgaatataacatacgattatcccgttgagatctttccaacaaggataaggtcaactgccatggggtttgcaacatcgatctcaaggataggcgcaatacttggaacaatagcatttcctttaatattatacacattaaatctaaggtacgttttaatctttttaataatcttcgaattgattggatttacaataacttttctcgttgcacctgagacaaagaacatggaattgaattga

SEQ ID NO: 1395 - protein, 441 aa, Picrophilus torridus DSM 9790
MFENRRIDSIPVSPMLLKITALSSMGVFMDGYILTIYSIAYIYMSGYLNPSSNAVITAFMGSSLFIGMLLGGFSMGHLADTLGRKRLYEYDLSLTAVFLILTALSFNVYEFIIFEILAGIGIGADYPISSSIQAEFSPRNTRGRFLIFNIFAWTIGSIVFLLLSIPIIHYTGAYQWRFMYGTAAIIPLIVILSRRTLPESPFWLSHMNMKDKALEVSNRVSSSIGIELNEIPKTESGRSSFRDLFSNRYLKYTVFVSLAWFSYDIASYGVWEYTPSVFFTGSSSIVASVFATILEEIPVFAGFLICIYFIERAGRRDLELIGFGGAAISLFIFEMIYGYVRIDIVFTFLAFATMHLFHNLGPTNITYDYPVEIFPTRIRSTAMGFATSISRIGAILGTIAFPLILYTLNLRYVLIFLIIFELIGFTITFLVAPETKNMELN

SEQ ID NO: 1396 - DNA, 1392 bp, Picrophilus torridus DSM 9790
  CDS (1)..(1392): transl_table=11
atgaatagtattgattcagctcttgaaaatgccgggaattcaaagttccattacagggttgttttcatatcaggtctcggtttctttacagatgcctatgaccttttcatcattggtgttgttataaatttgctgccgctgtctggatggcatttaagcatacaggaaagggcaatactggactcaatgtccctgcttgcagctgtttttggtgccctgctttacggcaggctccttgattttcttggaaggaaggctgtttacggcagcgagattataattcttgtcataggagccattggtagcgccgttgcaacgccatataataatgtaattgcactgataatatggagattcctacttggctttggcataggcggtgactattcaacaagctcgacaataatgacggagtactcaaacagaaaatccaggggaagattcataggcatggttttttcaatgcagagtataggtcttgttgcgggcccattgataacgatattatttttgacatcaagcatacctgtttatattacatggagggcactgcttttcataggtgcaataccggcaatgcttgttatatactttagaaggaccatgcctgagccgccaaggtacaccgcaagcgtccgtggtgattttaaaagggcatctgaaaatcttaaaaagttcgccggcatagattcagaggcaacaggcagaattgtgtcaataagatggacacggcttttcatggataaaaggttttttataacgttgattggaaccagtgttacatggttccttatggactgggccttgtatggaaattcaataatgtcaaatgaaatattatcatatattgttccttcgtatatcacaggtatacaaagcataataagaacttcagagtactcagcaatgatcttcggtattgctgcctttcccggatactgggctgctgcatttttaatagataagattggcagaaggttaatacagatacttgggttttccattatggggctgtcatatatattaatagcgctaacaggcatagcctctgcatcttacatatcatattttcttctggtctatggattaagctacttcttcatagagtttgggccgaacatgacaacctttgtttatccaccggagctgtttccaataacaacaaggggtcttggaactggaatatcagctgcaggcggtaagataggggcctttgctggaacattaaccgataccataatactggcattttacaatgtaaattatttaatgattatacttgcatttctttcatttgcgggtgctgtaataacctttgcactgcttcctgaaacaaagagaaaaccgcttagcgagacatctggtgagagaagatattcaattgcaaaatag

SEQ ID NO: 1397 - protein, 463 aa, Picrophilus torridus DSM 9790
MNSIDSALENAGNSKFHYRVVFISGLGFFTDAYDLFIIGVVINLLPLSGWHLSIQERAILDSMSLLAAVFGALLYGRLLDFLGRKAVYGSEIIILVIGAIGSAVATPYNNVIALIIWRFLLGFGIGGDYSTSSTIMTEYSNRKSRGRFIGMVFSMQSIGLVAGPLITILFLTSSIPVYITWRALLFIGAIPAMLVIYFRRTMPEPPRYTASVRGDFKRASENLKKFAGIDSEATGRIVSIRWTRLFMDKRFFITLIGTSVTWFLMDWALYGNSIMSNEILSYIVPSYITGIQSIIRTSEYSAMIFGIAAFPGYWAAAFLIDKIGRRLIQILGFSIMGLSYILIALTGIASASYISYFLLVYGLSYFFIEFGPNMTTFVYPPELFPITTRGLGTGISAAGGKIGAFAGTLTDTIILAFYNVNYLMIILAFLSFAGAVITFALLPETKRKPLSETSGERRYSIAK

SEQ ID NO: 1398 - DNA, 1296 bp, Picrophilus torridus DSM 9790
  CDS (1)..(1296): transl_table=11
atggaaagcgtttcctttgatgaaataccggccagcagaaaattgttaaagataacgctgttatcatcagccggtgttataatggatggctatgttttaagcatatatgcagtggccttattgtatttaaaaaactattttatgccattgccgtatcaaatatcattaatggcatcttccgcgcttcttggaatgttctttggatcactaacgtttggttatttatctgacagattcgggcggaaaaaaatatatgaatacgaccttttaataacatcggtatttttgttcttaacagggttatcaaggaacgttattgaattcataatctttgaggtacttgcaggaataggcataggcgcggattatcctataagctcgtcgatacaggcagagttctcaccgagaaacgtcaggggtaaatatcttatatacaatatattcaactggaatattggctttatagccttttacatcgtttcaatattctttgtgctttatacaggattaaatgcctggaggtacatgtacataagtgctgcggcaataccgttgatcgttgtgcttttaaggagatcaatgccagagtcaccatactatttaataaaatcaggccattatgaatctgcaattaaagtagaaaatgaattttataaaaacgtaaaaaatccatatgtaaacggtggcagaacggaaataagggaattgttcagcaaaaagtatctaaaatacacaatctttgtttcaattgcatggttctcatacgacgttgcaagctatggaatatggacttatacaccatctctgttttctgacacgtcatcatatataatcagcgttcttggttctcttcttgaggaggttcctgtcatactcggtttcatcgttctatggtatttgatagagcgtgccggcagaagaagaatggagatcattggttttcttctgcctttaataccaatgctattactttatttcaccggcagcatgggctttttaatactattttttatgttcggatttatgcatttttcacataatcttggtcctggagaattaacatttacataccctgttgagatctttccaacaagaataaggtcaacggccatgggctttgcaacactatcatcaagaataggtgcaattcttggtgttgttgcatttccagtaataatgtacagctttggttttaaatactcaatgctcttctttgcagtttttgagattattggtcttattgttacagtaagatatgcaccagaaaccaagaagaaacctcttgatgccatatga

SEQ ID NO: 1399 - protein, 431 aa, Picrophilus torridus DSM 9790
MESVSFDEIPASRKLLKITLLSSAGVIMDGYVLSIYAVALLYLKNYFMPLPYQISLMASSALLGMFFGSLTFGYLSDRFGRKKIYEYDLLITSVFLFLTGLSRNVIEFIIFEVLAGIGIGADYPISSSIQAEFSPRNVRGKYLIYNIFNWNIGFIAFYIVSIFFVLYTGLNAWRYMYISAAAIPLIVVLLRRSMPESPYYLIKSGHYESAIKVENEFYKNVKNPYVNGGRTEIRELFSKKYLKYTIFVSIAWFSYDVASYGIWTYTPSLFSDTSSYIISVLGSLLEEVPVILGFIVLWYLIERAGRRRMEIIGFLLPLIPMLLLYFTGSMGFLILFFMFGFMHFSHNLGPGELTFTYPVEIFPTRIRSTAMGFATLSSRIGAILGVVAFPVIMYSFGFKYSMLFFAVFEIIGLIVTVRYAPETKKKPLDAI

SEQ ID NO: 1400 - DNA, 1380 bp, Picrophilus torridus DSM 9790
  CDS (1)..(1380): transl_table=11
atgtcagatatatacaaggatcttgatgaaaaaagatttgggtggtttcacctcaaatcaatgataacgaccggcatgggtgtcttcactgatggctatgatctctcatcgattggccttgtacttttgcttgtgctttcattttacggtataggaaagagctcacctgattatacaattgttacaagccttcttgcaggatcggcacttattggtgctgcagttggtgcaatagtctttggcgagcttgccaggcgtggaagaaagaggttctacggcattgatgttgcaatactgggaatcggtgctttattacaggcactttcaccaaacataacatttttaatagtaataaggttcattcttggtctcggtgttggtgcagattatgttctatcaccaatgataatggcagagcattccaattcaagggatcgcggaaagacaatagcattcggctttggtttaatgtggggcttcggtgcaacactggcagccgttgtttatctattaattgcacctttggtatcaccaaaccttctatggagaattgttctatcagccggtgcaataccagcacttgccgttgtttatttaagaaggaggatgcctgagacaccaaggttcatagcaaggatcgttggcgataaggacaaattcattaacgaggtaaagtacatagcaaacagggaaataaaaataaacggcgagataaaagataataatacattcatgcactactttaaaagatatgccggattttacataacggccatgatactctggtttttatatgaccagatagcatattcaagcatactttttggcccaagtttaatagcatcaggtcttggaataccatcagatatctttcagtttgtaatggagcttgcatttacaataccaggcggcatagttgcagtatcattgatagaccgtgttggaagaaagccattgcaggtttcaggctttatattaatgggcgtattcctgttatcatttggaatcctaaaggacttttcactgcttccggcattccttggattaatgctatacggcatgcagaactttgcaaaccagtatggtccaggatcaataagcgcctcgggtatgcttggtgttgagctggcacccacaaagataagatcacagatacagtcatatacagttgcagctggaagaacaggtgcatcattgtcatcttttgttttcccgtacatgttcatagcctttggggaaagctttgcattttactatttaacagcacttgcaataatagccgggatactaacatgggtaataatacctgaaacaaaaggttctcttgaaaagacgtccggagagctaaatgaaatgagaaatatagaggtaatagaatga

SEQ ID NO: 1401 - protein, 459 aa, Picrophilus torridus DSM 9790
MSDIYKDLDEKRFGWFHLKSMITTGMGVFTDGYDLSSIGLVLLLVLSFYGIGKSSPDYTIVTSLLAGSALIGAAVGAIVFGELARRGRKRFYGIDVAILGIGALLQALSPNITFLIVIRFILGLGVGADYVLSPMIMAEHSNSRDRGKTIAFGFGLMWGFGATLAAVVYLLIAPLVSPNLLWRIVLSAGAIPALAVVYLRRRMPETPRFIARIVGDKDKFINEVKYIANREIKINGEIKDNNTFMHYFKRYAGFYITAMILWFLYDQIAYSSILFGPSLIASGLGIPSDIFQFVMELAFTIPGGIVAVSLIDRVGRKPLQVSGFILMGVFLLSFGILKDFSLLPAFLGLMLYGMQNFANQYGPGSISASGMLGVELAPTKIRSQIQSYTVAAGRTGASLSSFVFPYMFIAFGESFAFYYLTALAIIAGILTWVIIPETKGSLEKTSGELNEMRNIEVIE

SEQ ID NO: 1402 - DNA, 1317 bp, Picrophilus torridus DSM 9790
  CDS (1)..(1317): transl_table=11
atgccggtgtttattatgtatgagtttaaatccctggataatggaagatttgggaaggttcagcgaagaatgttttatctatcatcactgggcctttttctcgatggctatgatctgtcgataataaccatggccatgcttgtaataccttcacagctgcaccttggattctatgagaagatatacgttgatacatcatcatttataggcatgctcattggggcacctgttcttggaaggctcagcgacatgataggcaggaagaggatctttggccttgatctgttattctttgtggtctttgcaataacagcaggcctttcaggaaacttctatgagctgtttatatcaaggcttttaatgggctttggcataggcggtgattacccaataagttcaacaatgatgtccgagttttcaccaaagaattcaaggggcaggcttttactgggcatggttggcatgtactggcttggtgcattcatatctgctgttatgaactatatctttgttatttttacagacttctggaggtacacgtttataataggaggtataatagcactgccattgatattgcttagattaaaggttccggaaagcccaagatggcttgcctcaaaggggaagataagggatgctgaatcagtgttaaaagatatatctggcgtttcggatgtggaaaaaagcagtaaaacggtaaaaagggtccatggtttctatttcacattaatattcgttgttgccgcctggttcatatttgatgttgccgcatatggccttggcttctattatccattaatattcagcgagcttggtttcagggataatttcaggtcgatagccgagatatcaatgattatatcaataggtggaatgcttggctatgttatagcattaccagttgccgataaaataggcagaagattcttaacaatatttggtttctttgtcatgacacttttattatcccttggcagcataataaagatatcaggaatagcctctgttccattttactttctgttcgtgctcttcgagcagtgggttggcgccgttacattattctatccaacagagctttttgcaacagatgtaagatcaacggttcagggtatagcaactgccgcatcaagggccggcgcaatacttggaatagtaatctttccattttacccggtatttcactcgcttctggtttttgcagttgcatcatttattggacttattatagcaatattcatggctccagagacaaacagaaaaagccttgagcaaaatgttgagatgtatacaaataaaaatccaaaattatga

SEQ ID NO: 1403 - protein, 438 aa, Picrophilus torridus DSM 9790
MPVFIMYEFKSLDNGRFGKVQRRMFYLSSLGLFLDGYDLSIITMAMLVIPSQLHLGFYEKIYVDTSSFIGMLIGAPVLGRLSDMIGRKRIFGLDLLFFVVFAITAGLSGNFYELFISRLLMGFGIGGDYPISSTMMSEFSPKNSRGRLLLGMVGMYWLGAFISAVMNYIFVIFTDFWRYTFIIGGIIALPLILLRLKVPESPRWLASKGKIRDAESVLKDISGVSDVEKSSKTVKRVHGFYFTLIFVVAAWFIFDVAAYGLGFYYPLIFSELGFRDNFRSIAEISMIISIGGMLGYVIALPVADKIGRRFLTIFGFFVMTLLLSLGSIIKISGIASVPFYFLFVLFEQWVGAVTLFYPTELFATDVRSTVQGIATAASRAGAILGIVIFPFYPVFHSLLVFAVASFIGLIIAIFMAPETNRKSLEQNVEMYTNKNPKL

SEQ ID NO: 1404 - DNA, 1410 bp, Rhodococcus sp. RHA1
  CDS (1)..(1410): transl_table=11
atgagttccttcgacgtgatggacagacccgccaaacgcgggtttcacaccaagctcctgatcgcgtgctgtggcggaccattcctggacgggtacgtcatgagcatcatcggcgtggccctgctcggggtgaccgagcaacttcacccgacgacagccgaggcagggttgatcggtgccgcctcgctgatcggaatcttcttcggcgccacagtgttcggcttcctcaccgaccggatcggccgggagaagatgtacgccctcgacctggtggtactggtcgtcgcgtgcgcattgtcggtgttcgtccaattgccgtggcagcttatcgttctgcgcttcgtcatcggtgcggccatcggtgccgactaccccatcgccacctcgctgctcaccgagttcactcccaccaagaagcgcggcgccatggtcgggatgtcggccgtcgcgtggtcggcgggcgcggttgccgcgtacgtggtcggtgcgctcgtcgtcggcatctccggtggcaacgaccattggcgcctgctcctcgcgtccagtgcggtgctgggtctgatcgtgatcctggtgcgccgcggaatcccggagtcgccgcgctggctcctgaagaacggccgggtggccgacgccgaggccgtggtcgagaagatctacggggagaaactcgacctgagcaaggtcaccgtcgaggacacggcggacaagccgaaggccgacatccggatctacttccgcggccagtacctggcccggctgatcatgtgcagcgctttgtatctggcggtcgtcaccccgctctacgcgttgctgacattcctgcccacgatcctgtcaggcttctcgatctccggtgacggttccgcggggctcatcgtcgaaaccgtcatcatcgggctcatcgtcgccggatccatccccgcactgttcctggtcgagaagtggggccggcgtccgatcgccgtggtcccgttggccctgatggtgattccgctggcagggctgtggttgtgggcggacggtcccctctggttcatcgtcgccgccttctgcgcgtacgcgttcatctccggcggtccgagcatcctggtgtggatctaccccaacgaactcttccccaccgagttccgggcgaccgcggtgggaatcgccaccgcggtgagccggttcggcgccgcgacgggcacgtacctgctgccgctgagcatctcggcgctgggaaccggcaccacgatgctcttcggtgcggtgctgacggcggtcgcgttcgtgatctgcttcttcatgtcgccggagacgaaggggaagtcgctggaagaggtgtcctccgtaaccgctgccccggtaatggggacgagcgctccccgggtggagaagttggaggaggcgtccgcgccgcgaacctga

SEQ ID NO: 1405 - protein, 469 aa, Rhodococcus sp. RHA1
MSSFDVMDRPAKRGFHTKLLIACCGGPFLDGYVMSIIGVALLGVTEQLHPTTAEAGLIGAASLIGIFFGATVFGFLTDRIGREKMYALDLVVLVVACALSVFVQLPWQLIVLRFVIGAAIGADYPIATSLLTEFTPTKKRGAMVGMSAVAWSAGAVAAYVVGALVVGISGGNDHWRLLLASSAVLGLIVILVRRGIPESPRWLLKNGRVADAEAVVEKIYGEKLDLSKVTVEDTADKPKADIRIYFRGQYLARLIMCSALYLAVVTPLYALLTFLPTILSGFSISGDGSAGLIVETVIIGLIVAGSIPALFLVEKWGRRPIAVVPLALMVIPLAGLWLWADGPLWFIVAAFCAYAFISGGPSILVWIYPNELFPTEFRATAVGIATAVSRFGAATGTYLLPLSISALGTGTTMLFGAVLTAVAFVICFFMSPETKGKSLEEVSSVTAAPVMGTSAPRVEKLEEASAPRT

SEQ ID NO: 1406 - DNA, 1398 bp, Mycobacterium smegmatis str. MC2 155
  CDS (1)..(1398): transl_table=11
gtgtccgcacaccagccacacaccgtgtccagcccccgccatgtacccatagacgaccgaccactcaccgcgttccacaagcggctcaccgtgttctcggcgggcgggccgttcctggacggcttcgccctcacgatcatcggcatcgcgctgatcagcatggtgcccgcgctggacatgagcaccgtcgacgtgggtctggtgggcgcctcggcgctgatcgggatcttcgtcggcggtctggtgttcggctatgtcaccgatcgggtcggccgcaaagtcatgtacatcgccgacctcaccatgctcgtcgtggtgtcgatcgcatcggcgttcgcgaccgaggtgtggcaactggtcgcgctgcgtttcctgctcggcgtggcgatcggcgccgactaccccatcgccagttcgctgctcgcggagttcatcccgagccgctaccgtggccggctgctgggcgcactgttcgtcgtgtgggccggaggtgccgccgctgccgccggcgtgggctgggcgctgtcgacgatgggcccggacgcctggcggtggatgctggcaagtcccgcggtgttcggtgtcgtcaccctgatgctgcgggccggaactcccgaatcgcccaggtggcttttgagccgggggcgcaccgaggaggcgcagcgcgtgtgccgcaaggtgtggggcaacgacgccgacatcgccatgatcccggccgaacccgcgcataccccgttcaccgcgctgttccgggggatctacttgcgcagggtggtcttcgtcggggtgttcttcaccgcccacgtgatcccgctgttcgcggtgtacacgttcggcccggacatcctgcgggagatgggtgtcggtgcacacggctcccaccacgtgtacgtcgcggaacttgtgatcagcctgctgttcctggtcggcggggtccccgggctgctcctcgtggacaggatcggccgaaagcccctgctgctgtggacctttgccgtgatgagcgcggcgttcatcgcgatggccgtggtgccgggtgcgcccgcgcagatcctgttcgcactgcttgcgctctatgccgtcacgtccggagcctgcaatttcatcgagatcatctaccccaacgagcttttccccacgtcggtgcgtgcgagtgccacggggaccgtcgtcgcgatcagccgcgtcggttcggcggtcagcaccttcgtgttgccgctcgtgctcagcggcaccggactcggcggggtgatgtggctgctcgcgggggtcaacgtcgtcggcctgctggtcacgctcgtgctcggcgaggaaacgcgcggtcgcgcgctgtcggagacctcggccgccacgcgtctcaccgaaccggaaacccggtcggatcccgtggacgcgtga

SEQ ID NO: 1407 - protein, 465 aa, Mycobacterium smegmatis str. MC2 155
MSAHQPHTVSSPRHVPIDDRPLTAFHKRLTVFSAGGPFLDGFALTIIGIALISMVPALDMSTVDVGLVGASALIGIFVGGLVFGYVTDRVGRKVMYIADLTMLVVVSIASAFATEVWQLVALRFLLGVAIGADYPIASSLLAEFIPSRYRGRLLGALFVVWAGGAAAAAGVGWALSTMGPDAWRWMLASPAVFGVVTLMLRAGTPESPRWLLSRGRTEEAQRVCRKVWGNDADIAMIPAEPAHTPFTALFRGIYLRRVVFVGVFFTAHVIPLFAVYTFGPDILREMGVGAHGSHHVYVAELVISLLFLVGGVPGLLLVDRIGRKPLLLWTFAVMSAAFIAMAVVPGAPAQILFALLALYAVTSGACNFIEIIYPNELFPTSVRASATGTVVAISRVGSAVSTFVLPLVLSGTGLGGVMWLLAGVNVVGLLVTLVLGEETRGRALSETSAATRLTEPETRSDPVDA

SEQ ID NO: 1408 - DNA, 1620 bp, Capsicum frutescens
  CDS (1)..(1620)
atggctaacgatttgcaagtgctaaatgcactagatctagcaaagacacagttgtatcacttcacagcaattgtgattgctggcatgggcttttttactgatgcttatgaccttttctgcatttctatggtcacaaagttgctcggtcgcatttactaccatcatgataatgcagtgaaaccgggctctctgccccctaatgtctcagcagctgttaacggagtcgccttctgtggcacccttgctggacaactgttcttcgggtggctcggagataagcttggaaggaagaaagtctatggaatgacccttatgattatggtcatttgttcaattgcctcagggctctcttttggtcacacaccaaaaagtgtaatggctacactttgtttcttcagattctggcttgggtttggcattggtggtgattatcccctttctgccaccatcatgtccgagtatgctaacaagaagactcgtggagcgttcattgctgctgtgtttgctatgcaaggcttcggaattctggctggtggaatggtggcaatcattgtttctgcagcattcaaaggtgcattccctgcaccagcatatcaggatgctcctcttgcttcaacagtccctcaggctgattttgtgtggcgtattatcctcatgtttggtgcactccccgctgcacttacttattactggcgtatgaagatgcctgaaactgcccgttacactgccttggtggctaagaacttgaaacaggcagcgaacgacatgaccaaggtgatgcaagtcgaaattgaagcagagccagagaaaatcgaatctgtttctgaagaaagagggggagccaatgagtttggtttgttcactaagcagttcctccatcgccatggacttcacttgcttggaaccactagcacgtggttcttgttggacatagctttctacagtcaaaaccttttccagaaggacatattcagtgcaattggatggattccatcagcacaaaccatgaatgcattggatgaagtttacagaattgcaagagcacaaactcttattgctctttgcagtacggttcctggttactggttcacagtggcattcatcgatagaattggtcgatttgctattcagttgatgggattcttcttcatgacagtcttcatgtttgccctagccattccatacaatcactggactcacaaggatcacagaatcggcttcgtggtcatgtactcactcacctttttcttcgcaaactttggtccaaacgccacaacattcgttgtcccagcagagattttcccagccaggcttaggtccacatgccatggaatatcagcagcagcaggaaaagcaggagccatcgttggtgcattcggattcttgtacgctgctcagcccacggatcccaaaaaggctgaagccggttaccctgctggcattggcgtgaagaactcgctaatcgtcctaggggttgtcaactttcttggaatgttgttcacattctgtgttccagaatccaatgggaagtcattggaagatttgtcaagggaaaatgaaggggaagaggaaaatggagcagaaatgagagcaactagtggaaggacagttcctgtttaa

SEQ ID NO: 1409 - protein, 539 aa, Capsicum frutescens
MANDLQVLNALDLAKTQLYHFTAIVIAGMGFFTDAYDLFCISMVTKLLGRIYYHHDNAVKPGSLPPNVSAAVNGVAFCGTLAGQLFFGWLGDKLGRKKVYGMTLMIMVICSIASGLSFGHTPKSVMATLCFFRFWLGFGIGGDYPLSATIMSEYANKKTRGAFIAAVFAMQGFGILAGGMVAIIVSAAFKGAFPAPAYQDAPLASTVPQADFVWRIILMFGALPAALTYYWRMKMPETARYTALVAKNLKQAANDMTKVMQVEIEAEPEKIESVSEERGGANEFGLFTKQFLHRHGLHLLGTTSTWFLLDIAFYSQNLFQKDIFSAIGWIPSAQTMNALDEVYRIARAQTLIALCSTVPGYWFTVAFIDRIGRFAIQLMGFFFMTVFMFALAIPYNHWTHKDHRIGFVVMYSLTFFFANFGPNATTFVVPAEIFPARLRSTCHGISAAAGKAGAIVGAFGFLYAAQPTDPKKAEAGYPAGIGVKNSLIVLGVVNFLGMLFTFCVPESNGKSLEDLSRENEGEEENGAEMRATSGRTVPV

SEQ ID NO: 1410 - DNA, 1623 bp, Solanum melongena
  CDS (1)..(1623)
atggctaatgatttgcaggtgctaaatgcactggatgtggcaaagacacaactttatcacttcacagcaattgtgattgctggcatgggcttctttactgatgcttatgaccttttctgcatttctatggttactaagttgcttggccgcatttactaccaccacgataatgctgcgaaacctggctctctgccccctaatgtttcagcagctgttaacggagccgccttctgtggcacccttgctggacagttgtttttcgggtggcttggagataagcttggaaggaagaaagtctatggaatgacccttatgattatggtcatttgttcaattgcctcagggctttcatttggtcatacaccaaaaagtgttatgacgacactttgtttcttcaggttctggctaggatttggcattggtggtgattatcccctttctgccaccatcatgtctgagtatgctaacaaaaagactcgtggagcattcattgctgctgtgtttgctatgcaaggatttggaattttggctggtggaatggtggcaatcattgtttctgcagcattcaagggtgcattccctgcaccagcatatgaggataatcctcttgcttcaacagtctctcaggctgatttcgtgtggcgtgttattctcatgtttggtgcactcccagctgcacttacttattactggcgtatgaagatgcctgaaacagcccgttacactgccttggtagccaagaacttgaaacaggcagctaacgacatgtccaaggtgttgcaagtcgaaattgaagcagaaccagagaaaattgtgactgtttctgaaggaagagaaggcatcaatggctttggtttgttcactaaggagttcctccgtcgccatgggcttcatttgcttggaactactagcacatggttcttgttggacattgctttctacagtcaaaaccttttccagaaggacattttcagtgcgattggatggattccgccagcacaaaccatgaacgcgttggaggaagtttacaagattgcaagggcacaaactcttattgctctttgcagtactgttcctggctactggttcacagttgcattcatcgatagactgggacgatttaaaattcagttgatggggttcttcttcatgacagtcttcatgtttgccttagccattccataccatcactggactctcaaggatcacagaatcggcttcgtggtcatgtactcactcacctttttcttcgcgaactttggtccaaatgccacaacattcgtcgtccctgcagagattttcccagctaggcttaggtccacatgccatggaatatcagcagcagcaggaaaagcaggagccatggttggtgcattcggattcttgtacgctgctcagtccacggatcccaaaaagactgatgccggttaccctcctggcattggtgtgaggaactcactgatcgtccttggtgttgtcaacttccttggtatgatgttcacattcttggttccagaatccaaagggaagtcattggaagatttgtcgagggaaaatgaaggggaagaggaggaaaatggagctgaaatgagggcagctagtggaaggacagttccagtttaa

SEQ ID NO: 1411 - protein, 540 aa, Solanum melongena
MANDLQVLNALDVAKTQLYHFTAIVIAGMGFFTDAYDLFCISMVTKLLGRIYYHHDNAAKPGSLPPNVSAAVNGAAFCGTLAGQLFFGWLGDKLGRKKVYGMTLMIMVICSIASGLSFGHTPKSVMTTLCFFRFWLGFGIGGDYPLSATIMSEYANKKTRGAFIAAVFAMQGFGILAGGMVAIIVSAAFKGAFPAPAYEDNPLASTVSQADFVWRVILMFGALPAALTYYWRMKMPETARYTALVAKNLKQAANDMSKVLQVEIEAEPEKIVTVSEGREGINGFGLFTKEFLRRHGLHLLGTTSTWFLLDIAFYSQNLFQKDIFSAIGWIPPAQTMNALEEVYKIARAQTLIALCSTVPGYWFTVAFIDRLGRFKIQLMGFFFMTVFMFALAIPYHHWTLKDHRIGFVVMYSLTFFFANFGPNATTFVVPAEIFPARLRSTCHGISAAAGKAGAMVGAFGFLYAAQSTDPKKTDAGYPPGIGVRNSLIVLGVVNFLGMMFTFLVPESKGKSLEDLSRENEGEEEENGAEMRAASGRTVPV

SEQ ID NO: 1412 - DNA, 1581 bp, Capsicum frutescens
  CDS (1)..(1581)
atggctggtgaggctaataacaatctacaagttcttaatgcacttgatttggctaaaactcaactttatcatttcacagcaattattattgctggcatgggatttttcactgatgcttatgatctctttagcatttcacttgtcacaaagttacttggacgtttatactacacgaaaccggatttgttgaagcccgggacactccctccgggtgtgtcttcatcggtcacgggtgttgccttagttgggaccctcgcgggccagctattcttcggctggctcggagacaaaatggggcgaaaaaaggtgtatggtataactttggtactcatggttgtgagttcacttgcttccggactctcctttggtaatactcctaagggtgttatggctacactttgtttctttaggttttggcttggatttggcattggtggcgattaccctttatcggccacgattatgtctgaatacgctaacaagaagacgcgtggtgcattcatagccgcggtcttcgctatgcaagggttcggaatcttgttcagtgggataattgcactgattgtttcggcaggttttgatcatgcttataaggcccctactttcgcggaaaatgcagctctgtctactgtgccacaagccgactacatttggcgtgtaatcctcatgttcggggcgttgcctgcaggactcacttactactggcgcatgaagatgcctgaaactgctcgttacacggctctagtggcgaaagatgctaaaagagccgcgcaggacatggggaaagtactgcaggttgacattgatcctgaggcagcgaaaatcgagcaattgtcaagagatgaagccaataaattcggcctgttttcgtgggaatttgtgcgtcgccatggagtgcacctattcggaacatgttctacatggtttttactagacattgctttctacagccagaatcttttccaaagagatgtgttctcagcaattggatggattcctccggccgcaacaatgaatgctgttcaggaagtttacaaaatctccagagcgcaaaccttgattgcgctctgtagtacggtgccagggtattgggtcaccgtggcattgattgatatcatcggaaggttcagtatccaattgataggatttttcttcatgaccgtgttcatgttcgcgatcgctatcccctaccatcattggacattgaaggacaaccgtattggattcgtcataatgtactcccttacatttttcttcgcgaattttggacctaacgcgactacatttgtggtaccggctgagattttcccagccaggcttaggtcaacatgtcatggtatttccgcggctgctggtaaggctggagctatagtgggagcatacggattcctatacgctgcgcaaaacaaagatccaaagaaaaccgatgcaggataccccacgggtatcggaataaagaactcgctcattgttctagggtgcatcaatgcactaggaatgatttgcacattttgtgtgccagagccaaaaggaaaatctcttgaagaagcatcacaagaaactatctctggagaaacatga

SEQ ID NO: 1413 - protein, 526 aa, Capsicum frutescens
MAGEANNNLQVLNALDLAKTQLYHFTAIIIAGMGFFTDAYDLFSISLVTKLLGRLYYTKPDLLKPGTLPPGVSSSVTGVALVGTLAGQLFFGWLGDKMGRKKVYGITLVLMVVSSLASGLSFGNTPKGVMATLCFFRFWLGFGIGGDYPLSATIMSEYANKKTRGAFIAAVFAMQGFGILFSGIIALIVSAGFDHAYKAPTFAENAALSTVPQADYIWRVILMFGALPAGLTYYWRMKMPETARYTALVAKDAKRAAQDMGKVLQVDIDPEAAKIEQLSRDEANKFGLFSWEFVRRHGVHLFGTCSTWFLLDIAFYSQNLFQRDVFSAIGWIPPAATMNAVQEVYKISRAQTLIALCSTVPGYWVTVALIDIIGRFSIQLIGFFFMTVFMFAIAIPYHHWTLKDNRIGFVIMYSLTFFFANFGPNATTFVVPAEIFPARLRSTCHGISAAAGKAGAIVGAYGFLYAAQNKDPKKTDAGYPTGIGIKNSLIVLGCINALGMICTFCVPEPKGKSLEEASQETISGET

SEQ ID NO: 1414 - DNA, 1578 bp, Solanum melongena
  CDS (1)..(1578)
atggctgttgaggataataatttacaagtgcttaatgctcttgatttagccaaaacacaactttaccatttcacagcaattattattgctggaatgggatttttcactgatgcctatgatctctttagtatttcccttgtaactaaattactgggacgtatatactacaccaaaccggatctattgaaacccgggaccctccctccggtcgtctcggcttcggtgacaggtgtcgccctagtcggcaccctcgcgggccagcttttcttcggttggctcggagacaaaatgggacgtaaaaaggtctatggtatgactttggttctcatggttgtgtgttctgttgcttctgggctctccttcggtcatacccctaagggtgttatggcctcgctatgtttcttcaggttttggcttggatttggtattggaggcgattaccctttatccgccacgatcatgtccgaatatgctaacaagaagacacgtggtgcgttcatagccgcggttttcgctatgcaagggttcggaattttgttcagtgggataattgcactcatcacttcagctggattcgatcacgcgtacaaggcccccactttcgcggaaaatcctgctctgtccaccgtgccacaagccgactacatttggcgtataattctcatgttcggagcgttgccagcaggcctcacttactactggcgcatgaagatgcccgaaacagctcgttacacggctctcgtggcaaaagatgccaagagagccgcgcaggacatgggaagggtgctacaagttgaaattgaccccgaggatgcaaaaatcgaacaaatttccagggatgaaactaataaatttggtctgttttcgtgggaattcgttagacgccatggattgcacctattcggaacgtgttccacttggtttctattagacattgctttctacagccaaaatctattccagaaagatgttttctccgccgttggatggatcccgaaagccccaactatgaatgctgttcaggaagtttacaaaattgcgagagcgcaaaccttgattgcgctctgcagtacggtgccagggtactggttcaccgtggcgttcattgacatcattggaagattcgcgatccaattgatgggattcttcttcatgacggtgttcatgttcgcgatcgcaatcccttaccatcattggacattggaggaaaaccgtattgggttcgtggtaatgtactccctcacgtttttcttcgcgaattttgggcctaatgcaacaacatttgtggtcccggctgagatattcccagccaggcttcgatcaacatgtcatgggatttccgcagctgcgggtaaggctggggctatagtgggagcgtacggattcctgtacgctgcccaaagcaaagatcccacgaaaaccgatgcaggataccccgcggggattggaataaagaactcacttatcgttctaggatgcatcaatgctcttggattgctttgtacattttgtgtacccgagccaaaaggcaaatccctggaggaagcatcgcaggaaactatatctggagaaacatga

SEQ ID NO: 1415 - protein, 525 aa, Solanum melongena
MAVEDNNLQVLNALDLAKTQLYHFTAIIIAGMGFFTDAYDLFSISLVTKLLGRIYYTKPDLLKPGTLPPVVSASVTGVALVGTLAGQLFFGWLGDKMGRKKVYGMTLVLMVVCSVASGLSFGHTPKGVMASLCFFRFWLGFGIGGDYPLSATIMSEYANKKTRGAFIAAVFAMQGFGILFSGIIALITSAGFDHAYKAPTFAENPALSTVPQADYIWRIILMFGALPAGLTYYWRMKMPETARYTALVAKDAKRAAQDMGRVLQVEIDPEDAKIEQISRDETNKFGLFSWEFVRRHGLHLFGTCSTWFLLDIAFYSQNLFQKDVFSAVGWIPKAPTMNAVQEVYKIARAQTLIALCSTVPGYWFTVAFIDIIGRFAIQLMGFFFMTVFMFAIAIPYHHWTLEENRIGFVVMYSLTFFFANFGPNATTFVVPAEIFPARLRSTCHGISAAAGKAGAIVGAYGFLYAAQSKDPTKTDAGYPAGIGIKNSLIVLGCINALGLLCTFCVPEPKGKSLEEASQETISGET

SEQ ID NO: 1416 - DNA, 1611 bp, Capsicum frutescens
  CDS (1)..(1611)
atggctaaagatcaattacaagtgctaaatgcacttgatgtagccaaaacacaattgtaccatttcacagcaattgtaattgctggaatgggatttttcactgatgcatatgatcttttctgcgtttcacttgtcactaagttgctcggtcgaatttactatcatcatgatggtgaacctaagccaggaatcctccctcctgctgtcgcggctgcagtgaatggtgtcgcgttctgtgggaccctctcggggcagttgtttttcgggtggctaggtgataagatggggaggaagaaagtttatggaatgacacttatgcttatggtcattcgctcgattggctcagaactctcgtttggtaagacagctaatggtgttgttgcaacactatgtttttttcgattttggcttggttttggtattggtggcgattaccctttatctgctacgattatgtctgagtacgcgaataaaaagacccgcggtgcttttattgctgctgtttacgctatgcaagggtttggaatattggctggtggaattgtcgcacttattgttgctggtgcatttaaaaacgcgtatcctgcaccaatttattctgtaaatggtaacgattcaacccctcctgaagctgattatgtatggagaataattctcatgtttggcgctataccggctttgctaacatattattggcgtatgaagatgcctgagacagcgcgttacacggccttagttgccaagaatgctaccaaggcagcttccgatatgtccaaagtgttgaatgttgaaattgaagcagaagaggagaagattgttgatgtgaaggggaacaattttggtttgtttactaagcaatttcttcgtcgtcatggacttcatttgctaggcacaactagtacatggtttttactagacattgctttctatagtcaaaatctttttcaaaaggacatttttagtaaaattggatggatccctcatcctgagacgatgagcgcgttggatgaggttttcaagattgctagagctcaaactcttattgccctttgtagtactgttcctggttactggtttacagttgcattcatcgataaaatgggtcgatttgtaatacaactcatgggattcttcttcatgacagtgttcatgttcgcgttagccattccatacaatcactggactaaaaaggagaacaggataggttttgtgatcatgtactcgcttacctttttcttcgcgaattttggtccaaatgccactacatttgttgtgcccgcggagatctttccagctaggttgagatcaacatgccacgggatatcagccgcggctggaaaagcaggagcaattgttggtgcatttggatttttgtatgctgctcaatcaactgattcatcaaaagttgatgctggttatcctactggtataggtgtgaaaaatgcacttattgtactaggttgtgttaaccttcttggaatgttgttcacatttttggttccagaatccaaagggaagtcattggaagaaatgtcaaaggaaaacaaaggagaagaagaaagttatgggagagaaactaagggagaaaatgcacaaacaatttcagtttga

SEQ ID NO: 1417 - protein, 536 aa, Capsicum frutescens
MAKDQLQVLNALDVAKTQLYHFTAIVIAGMGFFTDAYDLFCVSLVTKLLGRIYYHHDGEPKPGILPPAVAAAVNGVAFCGTLSGQLFFGWLGDKMGRKKVYGMTLMLMVIRSIGSELSFGKTANGVVATLCFFRFWLGFGIGGDYPLSATIMSEYANKKTRGAFIAAVYAMQGFGILAGGIVALIVAGAFKNAYPAPIYSVNGNDSTPPEADYVWRIILMFGAIPALLTYYWRMKMPETARYTALVAKNATKAASDMSKVLNVEIEAEEEKIVDVKGNNFGLFTKQFLRRHGLHLLGTTSTWFLLDIAFYSQNLFQKDIFSKIGWIPHPETMSALDEVFKIARAQTLIALCSTVPGYWFTVAFIDKMGRFVIQLMGFFFMTVFMFALAIPYNHWTKKENRIGFVIMYSLTFFFANFGPNATTFVVPAEIFPARLRSTCHGISAAAGKAGAIVGAFGFLYAAQSTDSSKVDAGYPTGIGVKNALIVLGCVNLLGMLFTFLVPESKGKSLEEMSKENKGEEESYGRETKGENAQTISV

SEQ ID NO: 1418 - DNA, 1599 bp, Solanum melongena
  CDS (1)..(1599)
atggctaaagatcaatttcaagtactaaatgcccttgatgttgccaaaacacaattgtaccatttcacagcaattgtgattgctggaatgggatttttcactgatgcatatgaccttttctgcatttcacttgtgacgaaattactcggtcgaatatactatcatcatgaaggtgaccctaagccaggaatactccctcctggtgtctcagctgcagtgaatggtgtggcgtttgtagggaccctctcggggcagttgtttttcgggtggctaggtgataaaatggggaggaagagagtttatggaatgactcttatgattatggtcatttgctcgattgcgtcggggctttcttttggtaagacacctagaggtgttgtggctacactttgtttttttcgattttggcttggttttggtattggtggcgattaccctttatctgctacgatcatgtctgaatacgcgaataaaaagacacgtggggcttttattgctgcggttttcgctatgcaaggttttgggattttgactggtggaattgttgcacttattgttgctggtgcatttaaaaatgcttaccctgcaccaatatattcagtgaatggtaaagattcaacccctcctgaagctgattatgtatggagaattgtcgtcatgtttggggctatcccggctttgcttacttattattggcgtatgaagatgcctgagacagcgcgttacacagccttagtagccaagaatgctaccaaggctgccaccgatatgtccaaagtgttgaatgttgagattgaagcagaggaagacaaaattgttgaagaaaaagggaacaattttggtttgctttctaaggaatttcttcgtcggcatggtctacacttgctaggaacaactagtacatggtttttattagacattgctttctacagtcagaatcttttccagaaggatatttttagtaaaattggatggatacctcatccagagacgatgaacgcgttggatgaggtattcaaaattgcaagggcacaaactcttattgccctttgcagtactgtacctggttactggtttacagttgcattcatcgataaaatgggtcgatttgcaattcaattgatggggtttttctttatgacagtattcatgttcgcgttagccattccatataaccactggactaaaaaggaaaacagaattggttttgtgatcatgtactcactcacctttttcttcgcaaattttggtccaaatgccacaacatttgttgtccccgcggagatttttccagctaggctgagatcaacgtgccacgggatatcagctgcagctggaaaagctggtgcaattgttggtgcatttggatttttgtatgctgctcaatctactgatccatcaaaagttgacgcgggttatcgacctggaattggtgtgaaaaatgcacttattgtcttaggttgtgtcaatttacttggaatgttgttcacattgttggtaccagaatcaaaagggaagtcattggaagaactgtcaaaggaaaatcaaggagaagaagaaataactaggggggaaaatggacacacaattccagtttga

SEQ ID NO: 1419 - protein, 532 aa, Solanum melongena
MAKDQFQVLNALDVAKTQLYHFTAIVIAGMGFFTDAYDLFCISLVTKLLGRIYYHHEGDPKPGILPPGVSAAVNGVAFVGTLSGQLFFGWLGDKMGRKRVYGMTLMIMVICSIASGLSFGKTPRGVVATLCFFRFWLGFGIGGDYPLSATIMSEYANKKTRGAFIAAVFAMQGFGILTGGIVALIVAGAFKNAYPAPIYSVNGKDSTPPEADYVWRIVVMFGAIPALLTYYWRMKMPETARYTALVAKNATKAATDMSKVLNVEIEAEEDKIVEEKGNNFGLLSKEFLRRHGLHLLGTTSTWFLLDIAFYSQNLFQKDIFSKIGWIPHPETMNALDEVFKIARAQTLIALCSTVPGYWFTVAFIDKMGRFAIQLMGFFFMTVFMFALAIPYNHWTKKENRIGFVIMYSLTFFFANFGPNATTFVVPAEIFPARLRSTCHGISAAAGKAGAIVGAFGFLYAAQSTDPSKVDAGYRPGIGVKNALIVLGCVNLLGMLFTLLVPESKGKSLEELSKENQGEEEITRGENGHTIPV

SEQ ID NO: 1420 - DNA, 1608 bp, Nicotiana tabacum
  CDS (1)..(1608)
atggcctcaaacaatcttacagttctcaatgcacttgacactgcacgaacccaatggtaccatgtcacagccgttatcattgctggaatgggttttttcacagatgcctacgatctcttctgtatcaccactgtctccaaactcttaggccgtctctactactacgatcctgctaagcacgcccctggaaaactgcctcatcctgttaataattgggtagttggagtcgctttggttggtactttaactggacagctcgtgtttggttggctcggagacaaacttggccgaaagaaagtgtatggactcactttaatcctcatggtcatttgtgcactttgctctggtttgtccttcgggtatagcaaaaaagttgttatggggacactctgtttcttcagattctggcttggatttggcattggaggagattatcctctttctgccacaatcatgtccgaatatgcaaataaaaagactcgtggggcttttattgctgctgtttttgcaatgcaaggttttggtattttaacaggcggaatagttgctcttattgttgctggtgcatttaaaaatgcttacccttcaccaatttattcagtaaaccctaaagattcaacaccacctgaagctgattatgtttggagaattattgttatgtttggtgcaattccagctttacttacttattattggcgtatgaagatgcctgaaactgcccgttacacggccttagtcgcgaaaaatgctgaaaaagctgctgctgatatgtccaaagtattgaacgttgaaattgaagtagagacaaataaagttgaagaaaaacgacatgattttggtttgtttactaaggaatttcttcgtcgtcatggacttcacttgctaggaacaacgagtacatggtttttattagacattgctttttacagtcaaaatctttttcagaaagatatatttagtaaaattggatggattcctcatccagaaacgatgaacgcgttagatgaagttttcaagattgcaaaggcacagactcttattgcactttgtagtactgttccaggttactggtttacagtagcatttattgataaaatgggtcgatttgctatacaattaatgggattctttttcatgacagtgttcatgtttgctttagccattccatataatcactggacacaaaaggaaaacagaatagggtttgttattatgtattcacttacctttttcttcgctaattttggtccaaatgcaacaacatttgttgtacccgctgagatttttccagctaggttaagatcaacgtgccacggaatatcagcagcagctggaaaagcaggagcaattgttggggcatttggatttttatatgcagctcaatctacagatccattaaaggttgatgctggttatccaactggtataggtgtgaaaaatgcacttattgttcttggttgtgttaatttacttggaatgttgtttacattcttggtgccagaatccaaaggaaaatcattggaagaaatgtctaaggaaaatgaaggagaagaagaaaattatgaaaaagacactaaggcagagaatgcacaaacaattccactttaa

SEQ ID NO: 1421 - protein, 535 aa, Nicotiana tabacum
MASNNLTVLNALDTARTQWYHVTAVIIAGMGFFTDAYDLFCITTVSKLLGRLYYYDPAKHAPGKLPHPVNNWVVGVALVGTLTGQLVFGWLGDKLGRKKVYGLTLILMVICALCSGLSFGYSKKVVMGTLCFFRFWLGFGIGGDYPLSATIMSEYANKKTRGAFIAAVFAMQGFGILTGGIVALIVAGAFKNAYPSPIYSVNPKDSTPPEADYVWRIIVMFGAIPALLTYYWRMKMPETARYTALVAKNAEKAAADMSKVLNVEIEVETNKVEEKRHDFGLFTKEFLRRHGLHLLGTTSTWFLLDIAFYSQNLFQKDIFSKIGWIPHPETMNALDEVFKIAKAQTLIALCSTVPGYWFTVAFIDKMGRFAIQLMGFFFMTVFMFALAIPYNHWTQKENRIGFVIMYSLTFFFANFGPNATTFVVPAEIFPARLRSTCHGISAAAGKAGAIVGAFGFLYAAQSTDPLKVDAGYPTGIGVKNALIVLGCVNLLGMLFTFLVPESKGKSLEEMSKENEGEEENYEKDTKAENAQTIPL

SEQ ID NO: 1422 - DNA, 1596 bp, Capsicum frutescens
  CDS (1)..(1596)
atgacctcagacaatcttgtagtgctcaatgcacttgacacagcacgtacccaatggtaccatgtcaccgccgttatcattgctggaatgggatttttcacagatgcatatgatcttttctgtatcagcactatctccaaacttttaggccgtttgtattactacgatccgactgccaatgcccctggaaaattgcctcacgtagctaacaattgggtgattggagttgctctagttggtactctatctggtcagcttgtttttggctggctgggagataaacttggtaggaaaaaagtctatggactcactctaatcctcatggtcatttgtgcactttgctctggcttgtcctttgggtatagcgcgaaagctgtaattgggacactttgtttcttcagattctggctgggatttggaattggaggagattatcctctttctgctacaatcatgtctgaatatgctaataagtcaactcgcggggcgtttattgctgcagtgtttgctatgcaaggagttgggatcatctttgcagggctcgtttcaatgattatctccaaactgttcctgatgagttatgaaggtaaaccattcaataaggatgaagttttgtccacggagcccgaggcagattatgtttggcggatcgtgttgatgctcggggctcttccggctcttcttacctattattggcgaatgaagatgcccgaaacagggcgatacactgctattattgagggcaatgctaaacaagcagcgattaacatggggaaggttcttgacattgaaattcaagcagaaggtgacaaattggcccaattcaaggctgctaatgaataccctttactctccaatgagtttttccaacgccacgggtttcatttaataggtacaatgagtacttggttcttgttagacatagccttctacagtcaaaacctcacacaaaaggacatatttccagtcatgggactcactagcaacgccaagagcatttctgctctgagagaaatgtttgagacatcgcgtgccatgttcgtgattgccttgctaggtactttccctggttactggttcacagtgttcttcattgaaaaaatcggcaggtttagaatacaattgatgggattcttcatgatgtccgttttcatggcgatcattggaatcaaatatgattacctaaagactaacgaacacaaatggacattcgcaactctctatggtttaactttcttctttgccaactttggccccaattcaaccacgttcgtgctccctgcggaactgtttcctacaagggtgagatccacctgccatgcattgagcgcggcttctggaaaggcgggggcaatgatcagtgcatttgggatacaacaatatacacaagacgggaatgttcaaaaaatcgagaaagccatgatactgttggccgtcacaaatatggttggattttgctgcacattcttggtgacagagacgaaaggaagatcactggaagaaatttcaggggaggatggaaggcagcacgagacgcaactgaggactagcaagcctgtctccagccatccggacgatcacatgatattacattga

SEQ ID NO: 1423 - protein, 531 aa, Capsicum frutescens
MTSDNLVVLNALDTARTQWYHVTAVIIAGMGFFTDAYDLFCISTISKLLGRLYYYDPTANAPGKLPHVANNWVIGVALVGTLSGQLVFGWLGDKLGRKKVYGLTLILMVICALCSGLSFGYSAKAVIGTLCFFRFWLGFGIGGDYPLSATIMSEYANKSTRGAFIAAVFAMQGVGIIFAGLVSMIISKLFLMSYEGKPFNKDEVLSTEPEADYVWRIVLMLGALPALLTYYWRMKMPETGRYTAIIEGNAKQAAINMGKVLDIEIQAEGDKLAQFKAANEYPLLSNEFFQRHGFHLIGTMSTWFLLDIAFYSQNLTQKDIFPVMGLTSNAKSISALREMFETSRAMFVIALLGTFPGYWFTVFFIEKIGRFRIQLMGFFMMSVFMAIIGIKYDYLKTNEHKWTFATLYGLTFFFANFGPNSTTFVLPAELFPTRVRSTCHALSAASGKAGAMISAFGIQQYTQDGNVQKIEKAMILLAVTNMVGFCCTFLVTETKGRSLEEISGEDGRQHETQLRTSKPVSSHPDDHMILH

SEQ ID NO: 1424 - DNA, 1590 bp, Solanum melongena
  CDS (1)..(1590)
atgtcctcagaaaatcttgttgtgctcaatgcactcgacacagcacgtacccaatggtatcatgtcaccgccgttatcattgctggaatgggatttttcactgatgcctatgatcttttctgcatcactaccgtctccaagcttttaggccgtctgtattactacgatccaactactggtggcccgggcaaattgcctcacgtagccaacaattgggtgattggagttgctctagtaggtactctatctggccagcttgtttttggctggctgggagacaaacttggtaggaaaaaagtctatggactaactctaatcctcatggtcctttgtgcactgtgctgtgggctgtcctttgggtatagcgcgaaatctgtaatagggacactttgtttcttcagattctggcttggatttggaattgggggagattaccctctttctgctacgatcatgtctgagtatgctaacaaggcaactcgtggggcgttcattgctgctgttttcgctatgcaaggagttgggatcatctttgcggggctcgtttccatgattctctccaaagtgttcttgatgaattatgaaggtaaaccatttgaggtggatgagattttgtccacggagcctggggcagattatgtttggcgacttgtgttgatgcttggggctcttccggctcttcttacctattattggcgaatgaagatgcctgaaacagggcgttacactgctatcattgagggcaatgctaaacaagccgcgattaatatgggcaaggtccttgacattgaaattcaagcagaaggtgataaattagctcaatttaaggcagctaacgagtactctttactctctaatgagttcttccaacgccacgggcatcatttaataggtacaatgagtacttggttcctgttagacatagctttctacagccagaacctcacacaaaaagacatatttccagtcatgggactcactagcaacgccaaagcggtttccgctctgagggagatgtttgagacatcgcgtgccatgttcgtgattgccctgttcggtactttccctggttactggttcacagtattcttcattgaaaaaatgggtaggtttagaatacaattgatgggtttcttcatgatgtccgttttcatggcgatcattggattcaaatacgattacctaaaaactaaagagcacaaatggacattcgcagctctttatggtttaactttcttctttgcaaattttggccccaattcaaccacattcgtgctccctgcagagctattccctacaagggtgagatccacttgccacgcgttaagtgctgcttctggaaaggcgggggcaatgatcagtgcttttggaattcaacaatacacgcaagacggaaatgttcataaaatcaagaaagctatgatactgttggccgtcacaaatatggttggattttgctgcacattcttggtgacagagacgaagggacgatcactcgaagaaatttcaggggaggatcgcaggcagagtgagacacaaatgaagactagcaaacctgtctctggccaccaggatgacggatgggaatga

SEQ ID NO: 1425 - protein, 529 aa, Solanum melongena
MSSENLVVLNALDTARTQWYHVTAVIIAGMGFFTDAYDLFCITTVSKLLGRLYYYDPTTGGPGKLPHVANNWVIGVALVGTLSGQLVFGWLGDKLGRKKVYGLTLILMVLCALCCGLSFGYSAKSVIGTLCFFRFWLGFGIGGDYPLSATIMSEYANKATRGAFIAAVFAMQGVGIIFAGLVSMILSKVFLMNYEGKPFEVDEILSTEPGADYVWRLVLMLGALPALLTYYWRMKMPETGRYTAIIEGNAKQAAINMGKVLDIEIQAEGDKLAQFKAANEYSLLSNEFFQRHGHHLIGTMSTWFLLDIAFYSQNLTQKDIFPVMGLTSNAKAVSALREMFETSRAMFVIALFGTFPGYWFTVFFIEKMGRFRIQLMGFFMMSVFMAIIGFKYDYLKTKEHKWTFAALYGLTFFFANFGPNSTTFVLPAELFPTRVRSTCHALSAASGKAGAMISAFGIQQYTQDGNVHKIKKAMILLAVTNMVGFCCTFLVTETKGRSLEEISGEDRRQSETQMKTSKPVSGHQDDGWE

SEQ ID NO: 1426 - DNA, 1590 bp, Nicotiana tabacum
  CDS (1)..(1590)
atggcctcagacaatcttgtagtgctcaatgctcttgacacagcacgtacccaatggtaccatgtcactgccgttatcattgctggaatgggatttttcactgatgcgtacgatctcttctgcatctctactgtctctaagctcttaggccgcctctattactatgatcctgccacgaaagcccctggcaaattgcctcacatggctaacaattgggtgattggagttgctttagttggtactctatctggccaactcgtattcggctggttaggagacaaacttggtaggaaaaaagtctatggactcactttaattctcatggtggtttgtgcactttgttctggcttgtcctttgggtacagtgcaaaatctgtaatagggacgctctgtttcttcagattctggcttggatttggtattggaggagattatcctctttctgctacaatcatgtctgaatatgctaacaagtcaactcgtggggcgtttattgctgcggtgtttgctatgcaaggagttgggatcatcttcgcggggcccgtttcaatgattatctccaatgtgtttttaatcatgtacggaggtaaaccatttgatcaggatgaaattttgtccacggagcctgaggccgattatgtttggcggatcgtgtcgatggtgggggctcttcctgcacttgttacctattattggagaatgaagatgcctgaaacagggcgttacactgctattattgagggaaatgctaaacaagcagcgattaacatggggaaggtacttgatatagaaatccaagcagaaggtgacaaattggcccaattcaaggcagctaatgaatatcctttgctctccagtgagttcttccagcgccacgggcttcacttaataggtacaatgacaacttggttcttgttggacatagctttctatagccaaaacctcactcagaaggacatatttccagtcatgggactcgctagcaaagcccaacacatttccgctttgagggagatgtttgagacatcgcgtgccatgttcgtgattgccttgcttggtactttccctggttactggttcacagtgttcttcatcgaaaaaattggcaggtttaggatacaattgatggggttcttcatgatgacagttttcatggcgatcattggagtcaaatatgattacttaaagactaaggagcacaaatgggcattcgcaactctttatggcttaactttcttctttgccaactttggacccaattcgacaacatttgtgctccccgcggagctcttcccgacaagagtgagatccacttgccacgcactgagcgccgcatctggaaaggctggggcgatgattagtgcatttgggatacaacaatacacgcaagatggaaatgttcataaaatcaagaaagccatgatgctgttggctgtcacaaatatgcttggattcgctttcactttcttggtgactgagacaaaaggcaggtcactggaagaaatttcaggggaggacggcaggcggaatgagacacaaatgaagactagtaagcctgtctctgcccaccaggatgatggatgggaatga

SEQ ID NO: 1427 - protein, 529 aa, Nicotiana tabacum
MASDNLVVLNALDTARTQWYHVTAVIIAGMGFFTDAYDLFCISTVSKLLGRLYYYDPATKAPGKLPHMANNWVIGVALVGTLSGQLVFGWLGDKLGRKKVYGLTLILMVVCALCSGLSFGYSAKSVIGTLCFFRFWLGFGIGGDYPLSATIMSEYANKSTRGAFIAAVFAMQGVGIIFAGPVSMIISNVFLIMYGGKPFDQDEILSTEPEADYVWRIVSMVGALPALVTYYWRMKMPETGRYTAIIEGNAKQAAINMGKVLDIEIQAEGDKLAQFKAANEYPLLSSEFFQRHGLHLIGTMTTWFLLDIAFYSQNLTQKDIFPVMGLASKAQHISALREMFETSRAMFVIALLGTFPGYWFTVFFIEKIGRFRIQLMGFFMMTVFMAIIGVKYDYLKTKEHKWAFATLYGLTFFFANFGPNSTTFVLPAELFPTRVRSTCHALSAASGKAGAMISAFGIQQYTQDGNVHKIKKAMMLLAVTNMLGFAFTFLVTETKGRSLEEISGEDGRRNETQMKTSKPVSAHQDDGWE

SEQ ID NO: 1428 - DNA, 1587 bp, Capsicum frutescens
  CDS (1)..(1587)
atgtcagataatcttacagtgctcaatgcacttgacacagcacgcacccaatggtaccatgtcacagccgttatcattgctggaatgggatttttcacagatgcatatgatctcttctgcatcaccactatcaccaaacttttaggccgtttgtattactacgatccagctctccatgcccctggcaagttgcctcatagcgtaaataattgggtcactggagtggccctggttggtactttgactggacaacttgtgttcggctggcttggagacaaacttggtcgaaagaaagtctatggactcactttgattctcatggtcatttgcgcactctgctctggcttgtcatttgggtatagccgacgagttgtaatagggacgctatgtttctttaggttctggctgggatttggaattggaggagattatcctctttctgctacgatcatgtctgagtatgcaaataagagaagtcgtggggcgtttattgctgctgtttttgctatgcaaggagttgggatcatctttgccgggctcgtttcgatgattatctctaaactgttcttggtgagttttgggggtaaggcgttcagtactgatgaagttttctccacggagcctgaggcggattatgtttggcgaattgtactgatgcttggagctcttccggctcttctcacctattattggcgaatgaagatgcctgaaacaggacgttacactgctattattgaaggaaatgctaaacaagccgcgattgacatggggaaggttcttgatattgaaattcaagcagaaggcgaaaaattggccaaatttaaagcagccaacgagtaccctttactctccaatgagttctttgcgcgccatggacttcacttaatcggtacaatgacaacttggttcttgttggacattgctttctacagccaaaatctcacacagaaggacatatttccaactatgggtctcgttagcaacgccaagagcatttccgctttgagggagatgtttgagacatcacgtgctatgtttgtgattgcgttgcttggtaccttccctggttactggtttgcagtattcttcatcgagaaaattgggaggtttaagatacaattgatggggttcctcatgatgtcagtgttcatggcgatcattggagccaaatacgattacctaaagactaaagaacacaaatggacattcgcagctctttatggtttaactttcttctttgccaactttggccccaactcgacaacgtttgtgctccctgcggagctctttccaacaagggtaagatccacttgccatgctctgggtgcggcgtctggaaaggcaggggcaatggttagtgcatttggggtgcagcaatacacgcaagacggaaatgttcataaaatcaagaaagccatgttgttgctcgccttcacaaatatgattggattttgctgcactttcttagtgacggagacaaaaggcaggtcactagaggaaatttcaggggaggatgagaggaaaaatgagacgcagatgaagagtactaggcctcacttcggttaccaggatgatggatgggattga

SEQ ID NO: 1429 - protein, 528 aa, Capsicum frutescens
MSDNLTVLNALDTARTQWYHVTAVIIAGMGFFTDAYDLFCITTITKLLGRLYYYDPALHAPGKLPHSVNNWVTGVALVGTLTGQLVFGWLGDKLGRKKVYGLTLILMVICALCSGLSFGYSRRVVIGTLCFFRFWLGFGIGGDYPLSATIMSEYANKRSRGAFIAAVFAMQGVGIIFAGLVSMIISKLFLVSFGGKAFSTDEVFSTEPEADYVWRIVLMLGALPALLTYYWRMKMPETGRYTAIIEGNAKQAAIDMGKVLDIEIQAEGEKLAKFKAANEYPLLSNEFFARHGLHLIGTMTTWFLLDIAFYSQNLTQKDIFPTMGLVSNAKSISALREMFETSRAMFVIALLGTFPGYWFAVFFIEKIGRFKIQLMGFLMMSVFMAIIGAKYDYLKTKEHKWTFAALYGLTFFFANFGPNSTTFVLPAELFPTRVRSTCHALGAASGKAGAMVSAFGVQQYTQDGNVHKIKKAMLLLAFTNMIGFCCTFLVTETKGRSLEEISGEDERKNETQMKSTRPHFGYQDDGWD

SEQ ID NO: 1430 - DNA, 1590 bp, Solanum melongena
  CDS (1)..(1590)
atggcctcagataatcttgtagtgctaaatgcacttgacacagcacgcactcaatggtatcatttcacagccgttgtcatcgctggaatgggatttttcacagacgcatatgatctattctgcatcaccactgtctccaaacttttaggccgtttgtattactatgacccgacaagccatgcccctggcaaattgcctcatagtgttaacaattgggtcactggagtagccctggttggtactctgactggccaactcgtgttcggatggctaggggacagacttggtcgaaagaaggtgtatggacttacattaattcttatgatcatttgtgcactttgctctggattgtccattggttatagccgaaaagttgtcatagggacactttgtttcttcaggttctggcttggatttggaattggaggagattatcctctttccgctaccatcatgtctgagtatgcgaataagagaactcgtggggcgtttattgctgctgttttcgccatgcaaggtgttgggatcatctttgccgggcttgtttcaatgattgtttccaaggtcttcctgatgaattttgggggtccagccttcactaaggatgcagttttctccacggagcctgaggcagattatgtttggcggatcgtgttgatgcttggggctcttccggctcttctcacctattattggcgaatgaagatgcctgaaacagggcgctacactgctattattgaaggaaatgccaaacaagcagcgattgacatggggaaggttcttgatattgaaattcaagcagagggagaaaaattggcaaaatttaaagcagtcaatgagtactctttactctccaatgagttcttcatgcgccatggacatcatttaataggtacaatgactacttggttcttgttggacattgctttctacagccaaaatctcacgcagaaggacatatttccgaccatgggtctcgttagtgaagccaaaagcatttccgctttgagggaaatgtttgagacatcgcgggctatgtttgtgattgcgttgcttgggaccttccctggttactggttcacagtattcttcatcgagaaaatcgggaggtttaagatacaattgatggggttcttcatgatgtcagtgttcatggctatcattggagtcaaatatgattacctaaagactgaagaacacaagtggacattcgcagctctatatggtttaactttcttctttgccaacttcggccccaattcaacaacatttgtgctccctgcagagctctttccaacaagggtaagatccacttgccacgccctgagtgccgcgtctggaaaggcaggggcaatggttagtgcatttggggtgcagcagtacacgcaagatggaaatgttcataaaatcaagaaagccatgttgcttttggcattcacaaatatggctggattttgctgtactttcttagtgtcggagacaaaaggcaggtcactagaagaaatttcaggggaggatgagaagcagaacgagatgcagatgaagagttctaggcctgtctctggccaccaagacgatggatgggactga

SEQ ID NO: 1431 - protein, 529 aa, Solanum melongena
MASDNLVVLNALDTARTQWYHFTAVVIAGMGFFTDAYDLFCITTVSKLLGRLYYYDPTSHAPGKLPHSVNNWVTGVALVGTLTGQLVFGWLGDRLGRKKVYGLTLILMIICALCSGLSIGYSRKVVIGTLCFFRFWLGFGIGGDYPLSATIMSEYANKRTRGAFIAAVFAMQGVGIIFAGLVSMIVSKVFLMNFGGPAFTKDAVFSTEPEADYVWRIVLMLGALPALLTYYWRMKMPETGRYTAIIEGNAKQAAIDMGKVLDIEIQAEGEKLAKFKAVNEYSLLSNEFFMRHGHHLIGTMTTWFLLDIAFYSQNLTQKDIFPTMGLVSEAKSISALREMFETSRAMFVIALLGTFPGYWFTVFFIEKIGRFKIQLMGFFMMSVFMAIIGVKYDYLKTEEHKWTFAALYGLTFFFANFGPNSTTFVLPAELFPTRVRSTCHALSAASGKAGAMVSAFGVQQYTQDGNVHKIKKAMLLLAFTNMAGFCCTFLVSETKGRSLEEISGEDEKQNEMQMKSSRPVSGHQDDGWD

SEQ ID NO: 1432 - DNA, 1590 bp, Nicotiana tabacum
  CDS (1)..(1590)
atggcctcaaacaatcttacagtgctcaatgcacttgacactgcacgaacccaatggtaccatgtcacagccgttatcattgctggaatgggttttttcacagatgcctacgatctcttctgtatcaccactgtctccaaactcttaggccgtctttattactacgatcctgctacgcacgcccctggaaaactgcctcatcctgttaataattgggtagttggagtcgctttggttggtactttaactggccagctcgtgtttggttggctcggggacaaacttggccgaaagaaagtgtacggactcactttaatcctcatggtcatttgtgcactttgctctggtttgtccttcgggtatagcaaaaaagttgttatggggacactctgtttcttcagattctggcttggatttggcattggaggagattatcctctttctgccacaatcatgtccgaatatgcaaataagagaactcgtggggcgtttattgctgcagtttttgccatgcaaggcgttgggatcgtatttgccggccttgtttcaatgactgtttcgaaaatctttcttatgaattacgcgggtaaagcgtttaatgtggatgaagttttctccacggaacctgaggcagattatgtttggcgaatagtattgatgcttggagctcttccagctcttctcacctattattggcgaatgaagatgccggaaacagggcgttacactgctattattgagggaaatgctaaacaagcagcgcttgacatgggaaaggttcttgacattgaaattcaagcagaaggtgaaaaattggccaaatttaaagcagccaatgagtaccctttactctccaatgagttcttcatgcgccacggacttcacttaataggtacaatgagtacttggttcttgttggacatagctttctacagccaaaatctcacacagaaggacatattcccaaccatgggactagttagtgacgccaagagcatttcagctttgagggagatgtttgagacatcacgtgcaatgtttgtgattgcgttgctcggtaccttccctggttactggttcacagtattcttcattgagaaaatcggcaggtttaagatacaactgatggggttcttcatgatgtcagttttcatggcaatcattggagtcaaatatgattacctaaagactaaagatcacaaatggacattcgcagctctttatggtttaactttcttctttgccaactttggacccaattcgacaacatttgtgctccccgcggagctctttccgacaagagtgagatccacttgccatgccctgagcgcggcatctggaaaggcaggggcaatggttagtgcatttggggtgcagcagtacacgcaagacggaaatattcataaaattaagaaagccatgatatttttggccttcacaaatatgattggattttgctgcacctttttagtgactgagacaaaaggaaggtcactggaggaaatttcaggggaggatgaacagaaggatgagacgcagatgaagagtactaggcctgtctctggacaccaggacgatggatgggattga

SEQ ID NO: 1433 - protein, 529 aa, Nicotiana tabacum
MASNNLTVLNALDTARTQWYHVTAVIIAGMGFFTDAYDLFCITTVSKLLGRLYYYDPATHAPGKLPHPVNNWVVGVALVGTLTGQLVFGWLGDKLGRKKVYGLTLILMVICALCSGLSFGYSKKVVMGTLCFFRFWLGFGIGGDYPLSATIMSEYANKRTRGAFIAAVFAMQGVGIVFAGLVSMTVSKIFLMNYAGKAFNVDEVFSTEPEADYVWRIVLMLGALPALLTYYWRMKMPETGRYTAIIEGNAKQAALDMGKVLDIEIQAEGEKLAKFKAANEYPLLSNEFFMRHGLHLIGTMSTWFLLDIAFYSQNLTQKDIFPTMGLVSDAKSISALREMFETSRAMFVIALLGTFPGYWFTVFFIEKIGRFKIQLMGFFMMSVFMAIIGVKYDYLKTKDHKWTFAALYGLTFFFANFGPNSTTFVLPAELFPTRVRSTCHALSAASGKAGAMVSAFGVQQYTQDGNIHKIKKAMIFLAFTNMIGFCCTFLVTETKGRSLEEISGEDEQKDETQMKSTRPVSGHQDDGWD

SEQ ID NO: 1434 - DNA, 1919 bp, Phaseolus vulgaris
  CDS (85)..(1680)
gcacgaggctgcaaaatacctctcactgcttcaggaaacttgtactcatctcttgtaaagtaagactgggaagaagttttagtaatggcaggtcaactaggagtgttgaatgcacttgatgtggcaaagacacaatggtaccacttcacagcaattgtgatagcaggaatgggtttcttcactgatgcctatgacctcttctgcatttccctggttaccaagctgttagggagactctactacacagaaccaggtgcaccaaagccaggaagtcttcctccaagagttcaagcctctgtcactggtgttgcactctgtggcaccttagctggccaactcttctttgggtggcttggtgacaaattggggagaaaaagggtctatggtctcactcttgtgctcatggtagtgtgctcccttgcctcaggcttctcctttggctcaactccaaagggtgtcttgaccacactctgcttcttcaggttctggcttggatttgggattggtggtgactaccctctctctgccacaatcatgtctgaatacgccaacaaaaagactcgtggagcattcattgcagcagtgtttgccatgcaggggtttggaattttggctggtggagtagtggccttgattgttgcatatgcatatgaccaaaagtacaagcttcccacttatgaacaggatccacaaggatccattgtgccttcatttgactatgtttggaggatagttttgatgtttggtgctcttccagctgcaatcacctactactggcgcatgaaaatgcctgagactgcacgttacacagcccttgtggccaaggatgcaaaacaagctgcttcagacatgtctaaggtattgcaagtggagcttgaagctgaagtggagaaggtgaagaaactggcagaggaagagagccacaggtatggtttgttcagcaaggaatttctcaggcgtcatggcctgcatttggttggaaccaccaccacttggttcttgttggacaaagccttctacagccagaatcttttccaaaaggacatcttcagtgcaattgggtggatccctccagcacaagaaatgaatgcaattcatgaggtatacaagattgcaagagcacaaacactgatagcattgtgcagtacggtgccaggttactggttcacagtgtttttgattgatcacatgggccgttttgctatccaattgatggggttcttcttcatgacagtgttcatgtttgctttggctataccatatgatcattggactaagaaagcaaacagaattgggtttgtggtgatatactctctcacctttttctttgccaactctggtccaaattccaccacacttgttgtgccagcagagatcttcccagcaaggctaaggtcaacttgtcatggaatctctgctgctgcaggaaaggctggtgcaattgtgggagcatttgggttcctgtatgctgcacaaagcaaggacccttccaagactgatgcagggtactctacagggattgggatcaagaactcactcattatgcttggggtaatcaacctctttggaatggtattcaccttgctggttccagaatcaaagggaaagtcacttgaagagttgagtggggagaatgatggaagtgaggatcctaagcctgctactacagttcctgtttgattcaagttttaagtttgtgttcaacaaagtggttcaaattagtgttgtatttgtacattttaatactttgttatggttgtgagatatgtttgcacaaattaattatgtagtagctacatgatttaggggtgctagtttgtatgttttgtgtttgttcaagattgaaggttggtaaccctctttttttttttggataaataaataagaagaaacaacataaagtgtaaaaaaaaaaaaaa

SEQ ID NO: 1435 - protein, 531 aa, Phaseolus vulgaris
MAGQLGVLNALDVAKTQWYHFTAIVIAGMGFFTDAYDLFCISLVTKLLGRLYYTEPGAPKPGSLPPRVQASVTGVALCGTLAGQLFFGWLGDKLGRKRVYGLTLVLMVVCSLASGFSFGSTPKGVLTTLCFFRFWLGFGIGGDYPLSATIMSEYANKKTRGAFIAAVFAMQGFGILAGGVVALIVAYAYDQKYKLPTYEQDPQGSIVPSFDYVWRIVLMFGALPAAITYYWRMKMPETARYTALVAKDAKQAASDMSKVLQVELEAEVEKVKKLAEEESHRYGLFSKEFLRRHGLHLVGTTTTWFLLDKAFYSQNLFQKDIFSAIGWIPPAQEMNAIHEVYKIARAQTLIALCSTVPGYWFTVFLIDHMGRFAIQLMGFFFMTVFMFALAIPYDHWTKKANRIGFVVIYSLTFFFANSGPNSTTLVVPAEIFPARLRSTCHGISAAAGKAGAIVGAFGFLYAAQSKDPSKTDAGYSTGIGIKNSLIMLGVINLFGMVFTLLVPESKGKSLEELSGENDGSEDPKPATTVPV

SEQ ID NO: 1436 - DNA, 1611 bp, Vitis vinifera
  CDS (1)..(1611)
  misc_feature (592)..(592): w is a or t
  misc_feature (1224)..(1224): s is g or c
  misc_feature (1323)..(1323): y is t or c
atggccaagaatcaattgcaagtgcttaacgcacttgatgtagccaaaacacaatggtatcatttcacggcgattgtcattgctggaatgggcttcttcactgatgcatatgatctcttttgtatatcattggtcacaaaattgttgggccgcatatactaccattctcctggggatgctaagcccggcactttgcctccaaatgtgtcggctgcagttaacggtgttgcgttctgcggtactcttgctggacagctcttttttggatggctcggtgacaaaatgggcagaaaacgtgtgtatggcatgaccctcatgctcatggtcatatgctcagttgcctctggcctttcctttggccatgaagcaaaaggtgttatggccactctgtgcttcttcaggttctggctgggctttggcataggtggagactacccgctttctgccactattatgtctgagtatgctaataaaaagactcgtggagccttcattgctgcagtttttgccatgcaaggttttgggattttaactggtggaatctttgcaattataatttctgcctcgtttaaggctgcatttccttctccawcttatgaaattgatccagttgggtctactgttccacaagctgattttgtttggcggataattctcatgtttggcgccttgccggctgctcttacttattactggcgtatgaagatgccagagactgctcgttacacagccttggttgccaagaatgcgaagaaggctgcagcagatatgtctaaagttctccaggttgatctagaagcagaacaagagaaagttgagtcgatccaacggcaaggtaaagattttgggttgttcaccaagcagtttcttcgtcgccatggacttcacttgcttgggaccactagcacatggttcttgttggacatcgccttctacagtcagaatctgtttcaaaaggacatcttcagtgccattgggtggattcctgcggccaaaaccatgagtgcccttgaagaggtttacaaaattgcaagggcccaaactctcatagccctctgcagcactgttcctgggtactggttcacagtagcgttaatcgacaagatgggaagatttgccatccaattgatgggcttcttctttatgaccgtcttcatgtttgccctggctataccttacaatcactggacccataaagaaaaccgaattgggttcgtggtgatstactctctcacattcttcttcgcaaattttggtccaaatgccaccacatttgttgtgccagccgagattttccctgcaaggctacgctccacatgccayggaatatcagcagcggctgggaaggcaggggccattgttggtgcctttggcttcttgtatgctgctcagagccaggacaagtctaaggtagataaagggtacccaaccggtattggtgtaaaaaattcactcatagttctgggtgtcgtcaactttctgggaatgttatttaccttcttggtgcccgagtccaagggaaagtcactagaggaaatgtctggtgagaacgaagaagaagagagtccgtcggaggagtcaagacagcaggctaggactgttccagtttaa

SEQ ID NO: 1437 - protein, 536 aa, Vitis vinifera
  misc_feature (198)..(198): The Xaa at location 198 stands for Ser, or Thr.
  misc_feature (408)..(408): The Xaa at location 408 stands for Ile, or Met.
MAKNQLQVLNALDVAKTQWYHFTAIVIAGMGFFTDAYDLFCISLVTKLLGRIYYHSPGDAKPGTLPPNVSAAVNGVAFCGTLAGQLFFGWLGDKMGRKRVYGMTLMLMVICSVASGLSFGHEAKGVMATLCFFRFWLGFGIGGDYPLSATIMSEYANKKTRGAFIAAVFAMQGFGILTGGIFAIIISASFKAAFPSPXYEIDPVGSTVPQADFVWRIILMFGALPAALTYYWRMKMPETARYTALVAKNAKKAAADMSKVLQVDLEAEQEKVESIQRQGKDFGLFTKQFLRRHGLHLLGTTSTWFLLDIAFYSQNLFQKDIFSAIGWIPAAKTMSALEEVYKIARAQTLIALCSTVPGYWFTVALIDKMGRFAIQLMGFFFMTVFMFALAIPYNHWTHKENRIGFVVXYSLTFFFANFGPNATTFVVPAEIFPARLRSTCHGISAAAGKAGAIVGAFGFLYAAQSQDKSKVDKGYPTGIGVKNSLIVLGVVNFLGMLFTFLVPESKGKSLEEMSGENEEEESPSEESRQQARTVPV

SEQ ID NO: 1438 - DNA, 1933 bp, Catharanthus roseus
  CDS (70)..(1698)
tgtgaagaaagtatttttctttcaaggatataaagaggttggatttgtgattatcggcaaaaaacagtcatggctaaggaacaattgcaggtgcttaatgcacttgatgtcgctaaaacacaatggtaccatttcactgctattgtgattgctggaatgggtttctttactgatgcatatgatctcttttgcatctctttggttacaaaattgctcgggcggatttactatcacgtggatggggcagtaaagcctggaactttgcctcctaatgtgtcagctgcagttaatggtgttgcattttgtggaacccttgctggtcagttattctttgggtggcttggagataagatgggaagaaaaagagtttacggtatgactctaatgctgatggtcattgcatcaatagcatcaggtctttcctttggtgataaaccgaaggctgttatggctactctttgcttcttccggttctggcttggtttcggtattggtggtgattatcctttatctgccacgatcatgtccgagtatgctaacaaaaagactcgtggagctttcattgctgcagtctttgctatgcaaggttttggaattctagccggtggaatggttgctatcattgtatctgcatcgttcaaggctggttttcctgcacctgcatatcaagatggtgctgttgcatcaactgtccctgaagctgattatgtttggcgtataattttgatgttcggtgctattcctgctgcgctgacctattattggcgaatgaagatgcccgagacagctcgttacactgctctagttgccaagaatgctaaacaggcggcaaatgatatgtctaaggtattgcaagttgaactagaagcagaacaagaaaaagtcgagaaatttgctcaagaaccagcaaatacttttggtttattcactaaagagttccttaaacgtcatggacttcacttgctaggaactgctactacatggttcttgttagacattgcgttttatagtcaaaatcttttccaaaaggatatcttcagcgcaattggatggattcctccggcacaaacaatgaatgcaattgaagaggttttcagaattgcaagggctcaaactcttattgctctctgtagtactgtccccggatattggttcacagtgttcttaatcgacagaataggaagattcataatccagtggatgggatttttcttcatgacagtatttatgtttgccttagcaattccatacaatcactggactcacaaggataacaggattggctttgtgatcatgtattcattaactttcttctttgcaaatttcggtccaaatgccacaacctttgttgtcccggctgaaattttcccggctaggttaaggtctacatgccatggtatatcggctgctgctggaaaggctggtgcaatcattggagcatttggatttctatatgctgctcaaccttccgatccatccaagacggacaaaggctatccacctggcattggtgtaaagaatgccctcattgttctaggctgcgtcaacttccttggcatggttttcactttcctagtcccagaagctaaaggtaaatcattggaagaagtatctaaagaaaatgaggaagaagtggaaaatggaacagaattgagacaacaaagtggtcatgacacaaggactgttccagtactataaatcacgacctttatccacaacctttaagacatcttcttaaggtgaaaaaagaatgaagaaacaggatcctaagtgcatagcttttgctcttttcatgtaccatgcttgtggtaattagtctacccttgtatgtaataatgcaagataattctatgtttaagtttgcagagtcaaagagattagtgtgaaaggaattaggtctactactgcctaattgcatcttaattatgttttg

SEQ ID NO: 1439 - protein, 542 aa, Catharanthus roseus
MAKEQLQVLNALDVAKTQWYHFTAIVIAGMGFFTDAYDLFCISLVTKLLGRIYYHVDGAVKPGTLPPNVSAAVNGVAFCGTLAGQLFFGWLGDKMGRKRVYGMTLMLMVIASIASGLSFGDKPKAVMATLCFFRFWLGFGIGGDYPLSATIMSEYANKKTRGAFIAAVFAMQGFGILAGGMVAIIVSASFKAGFPAPAYQDGAVASTVPEADYVWRIILMFGAIPAALTYYWRMKMPETARYTALVAKNAKQAANDMSKVLQVELEAEQEKVEKFAQEPANTFGLFTKEFLKRHGLHLLGTATTWFLLDIAFYSQNLFQKDIFSAIGWIPPAQTMNAIEEVFRIARAQTLIALCSTVPGYWFTVFLIDRIGRFIIQWMGFFFMTVFMFALAIPYNHWTHKDNRIGFVIMYSLTFFFANFGPNATTFVVPAEIFPARLRSTCHGISAAAGKAGAIIGAFGFLYAAQPSDPSKTDKGYPPGIGVKNALIVLGCVNFLGMVFTFLVPEAKGKSLEEVSKENEEEVENGTELRQQSGHDTRTVPVL

SEQ ID NO: 1440 - DNA, 1920 bp, Medicago truncatula
  CDS (42)..(1655)
ggcttcttgcaagagggaaaaactaggtaacaaattcagtcatgtctggagaattaggagtgcttaatgcactcgatgtcgcaaagacgcaattgtaccatttcactacaattgtgatagctggaatgggattcttcactgatgcatatgatcttttctgcatttcccttgtcacaaagttgttagggagaatatattacactgaaccaaatccaacaagaccaggaacacttccaccaagtgctcaatcagctgtaactggtgttgcacttgttggaacactagcaggccaattattctttggttggcttggcgacaaacttggtaggaaaaaagtctatggtttaacacttattctcatggtggtttgttcagttggttcaggactctcttttggatcaagtccaaagagtgttatggcaacactttgtttctttaggttttggcttggttttggtattggtggtgattaccctctttcagctacaatcatgtctgaatatgctaacaaaaaaactagaggtgcatttattgctgctgtttttgccatgcaaggttttggtatcttaggtggtggaattgttgctttgattgtggcttctatatttgatcacaaatataaggttcctacctttgaagaaaatccagctacatcactgttagtgcctcaatttgattatgtttggagacttattcttatgttcggcgctcttcctgctgcattgacgtactactggcgaatgaaaatgccagaaacagcccgttacaccgctcttgttgctaagaacgcgaaacaagctgccgcggatatgtctaaggtattgcaagttgaacttgaagttgaagaggagaaggtacaaaaaatgactagtgataaaaggaatagttatggcttgttcagcaagcaattcgcagcacgacacggtttggctttgtttggaacatgtagtacatggtttttgttggatattgctttctatagtcagaatcttttccaaaaggacatttttagcgcaattggatggatacctccggcaaaagaaatgaatgcaattcatgaggtttacaagattgcaagagcacaaacacttattgcgttgtgcagtactgttccgggttactggttcacggtagcatttatcgatcacatgggtcgtttcgctattcaaatgatgggattcttcttcatgactgttttcatgtttggacttgccataccatatgatcattggagcaaggaagagaatagaattgggtttgttgtaatgtactcactcacattcttcttttctaattttggtccaaatgctgcgacatttgttgtaccggcagagatttttccggctaggctaaggtctacctgtcatggaatctcagctgctgcaggaaaggcaggagcaattgttggtgcatttggattcttgtatgctgcacaaagtaaagatcctaccaagaccgataaagggtatccaaccggtattgggattaagaactctcttatcatgcttggtgtgatcaactttgttgggatgttatgcacattacttgttccggaatcaaagggaaaatcgttggaagagttgagtggagagaacgagggagaaggtgccgaggccactgaacaagaaggaccgcggtttgaaaatgtagcttgagcaagaaggatcatgaacatcaccaagtgaatttattttatgtttgcaccatatattattatttgtgacacattttagaactcttaaaccatttttctgtttgcatttagctactggttgttgttttcacaataatgatgcagtcctatgcttcttggttgtaagaatcaatactatgtaaagtgtatgtctttggttgtaaactatttaaaatctattcttgtattgtattgtataatttattttatcctttgtttgagattgg

SEQ ID NO: 1441 - protein, 537 aa, Medicago truncatula
MSGELGVLNALDVAKTQLYHFTTIVIAGMGFFTDAYDLFCISLVTKLLGRIYYTEPNPTRPGTLPPSAQSAVTGVALVGTLAGQLFFGWLGDKLGRKKVYGLTLILMVVCSVGSGLSFGSSPKSVMATLCFFRFWLGFGIGGDYPLSATIMSEYANKKTRGAFIAAVFAMQGFGILGGGIVALIVASIFDHKYKVPTFEENPATSLLVPQFDYVWRLILMFGALPAALTYYWRMKMPETARYTALVAKNAKQAAADMSKVLQVELEVEEEKVQKMTSDKRNSYGLFSKQFAARHGLALFGTCSTWFLLDIAFYSQNLFQKDIFSAIGWIPPAKEMNAIHEVYKIARAQTLIALCSTVPGYWFTVAFIDHMGRFAIQMMGFFFMTVFMFGLAIPYDHWSKEENRIGFVVMYSLTFFFSNFGPNAATFVVPAEIFPARLRSTCHGISAAAGKAGAIVGAFGFLYAAQSKDPTKTDKGYPTGIGIKNSLIMLGVINFVGMLCTLLVPESKGKSLEELSGENEGEGAEATEQEGPRFENVA

SEQ ID NO: 1442 - DNA, 1867 bp, Medicago truncatula
  CDS (106)..(1707)
attcggcacgagcctagctagctcctcatacaaacttgacttctcacaaggaggtcttctctctctctatctctctagcttggggactaggtaacaaattcagccatgtcaggagagctaggagtgctaaatgcacttgatgtggccaagacacaattgtatcacttcactacaattgtgattgctggaatgggattcttcactgatgcatatgatcttttctgcatttcccttgtcacaaagttgttagggagaatatattacactgaaccaaatccaacaagaccaggaacacttccaccaagtgctcaatcagctgtaactggtgttgcacttgttggaacactagcaggccaattattctttggttggcttggcgacaaacttggtaggaaaaaagtctatggtttaacacttattctcatggtggtttgttcagttgcttcaggactctcttttggatcaagtccaaagagtgttatggcaacactttgtttctttaggttttggcttggttttggtattggtggtgattaccctctttcagctacaatcatgtctgaatatgctaacaaaaaaactagaggtgcatttattgctgctgtttttgccatgcaaggttttggtatcttaggtggtggaattgttgctttgactgtggcttctatatttgatcacaaatataaggttcctacctttgaagaaaatccagctgcatcattgttagtgcctcaatttgattatgtttggagacttattcttatgttcggtgctcttccagctgcattgacgtactactggcgaatgaaaatgccagaaacagctcgttacacggctcttgttgctaagaacgcgaaacaagctgctgcggatatgtctaaggtgttgcaagttgaacttgaagttgaagaggagaaggtagaaaaaatgactagtgataaaaggaatagttatggcttgttcagcaagcaattcgcagcacgacatggtttggctttgtttggaacatgtagtacatggtttttgttggatattgctttctatagtcagaatcttttccaaaaggacatttttagcgcaatcggatggatccctccggcaaaagaaatgaatgcaattcatgaggtttacaagattgcaagagcacaaacacttattgcgttgtgcagtactgttccgggttactggttcacagtagcgtttatcgatcacatgggtcgtttcgctattcaaatgatgggattcttcttcatgactgttttcatgtttgcacttgccataccatatgatcattggagcaaggaagagaatagaattgggtttgttgtaatatactcactcacattcttctttgctaattttggtccaaatgctacgacatttgttgtaccggcagagatttttccggctaggttaaggtctacctgtcatggaatctcagctgctgcaggaaaggcaggagcaattgttggtgcatttggattcttgtatgctgcacaaagtaaagatcctaccaagaccgataaagggtacccaaccggtattgggattaagaactctcttatcatgcttggtgtgatcaactttgttgggatgttatgcacattacttgttccggaatcaaagggaaaatcgttggaagagttaagtggagagaatgagggagaaggtgccgaggccactgagcaagaaggatcaagggtttaaactgcagtcacagtcataaataccggtgcataacatgaattaattttatatttgcaacatgtttttaaaatcttaaaccttctatttttccactccataggttatcaattaagtattattattttgtgtgattctactactttggaatataagaagattg

SEQ ID NO: 1443 - protein, 533 aa, Medicago truncatula
MSGELGVLNALDVAKTQLYHFTTIVIAGMGFFTDAYDLFCISLVTKLLGRIYYTEPNPTRPGTLPPSAQSAVTGVALVGTLAGQLFFGWLGDKLGRKKVYGLTLILMVVCSVASGLSFGSSPKSVMATLCFFRFWLGFGIGGDYPLSATIMSEYANKKTRGAFIAAVFAMQGFGILGGGIVALTVASIFDHKYKVPTFEENPAASLLVPQFDYVWRLILMFGALPAALTYYWRMKMPETARYTALVAKNAKQAAADMSKVLQVELEVEEEKVEKMTSDKRNSYGLFSKQFAARHGLALFGTCSTWFLLDIAFYSQNLFQKDIFSAIGWIPPAKEMNAIHEVYKIARAQTLIALCSTVPGYWFTVAFIDHMGRFAIQMMGFFFMTVFMFALAIPYDHWSKEENRIGFVVIYSLTFFFANFGPNATTFVVPAEIFPARLRSTCHGISAAAGKAGAIVGAFGFLYAAQSKDPTKTDKGYPTGIGIKNSLIMLGVINFVGMLCTLLVPESKGKSLEELSGENEGEGAEATEQEGSRV

SEQ ID NO: 1444 - DNA, 2023 bp, Solanum lycopersicum
  CDS (152)..(1768)
taaaaataaaaatgcaaaataatccaaagttttgatttttaattttgggtatttttgttggagttcttgaacgtaaaaaaaagaccaaatcttgaaatttggttttttttttggtggaaattgaagatttactctttaaggaagtttagtcatggcgaacgatttgcaagtgctaaatgcactagatgtcgcgaagacacaactgtatcacttcacagcgattgtgattgctggcatgggtttttttactgatgcttatgaccttttctgcatttctatggtcactaaattgcttggtcgtctttactaccatcatgacggtgcattgaaacctggctctctgccccctaatgtttcagcagctgttaatggagtcgccttctgtggcacccttgctggacagttgttcttcgggtggcttggagataaaatgggaaggaagaaagtctatggaatgacccttatgattatggtcatttgttcaattgcctcggggctttcatttggccatacaccaaaaggtgttatgactacgctttgtttcttcagattctggctaggatttggcattggtggtgattatcccctttctgccaccatcatgtctgagtatgctaacaaaaagacccgtggagcgttcattgctgctgtgtttgctatgcaaggtttcggaattctggctggtggaatggtggcaatcattgtttctgcagcattcaagggcgcattccctgcaccagcatatgaggttgatgctattggttcaacagtccctcaggctgatttcgtgtggcgtataattctcatgtttggtgcaatccctgctggacttacttattactggcgtatgaagatgcctgaaactgcccgttacactgccttggtcgccaagaacttgaaacaggcagctaacgacatgtccaaggtgttgcaagtcgaaattgaagcagagccagagaaagttacagctatttctgaagcaaaaggagccaatgactttggtttgttcactaaggagttcctccgtcgccatggacttcacttgcttggaactgctagcacatggttcttgttggacattgctttctacagtcaaaaccttttccagaaggacattttcagtgcaattggatggattccaccagcacaaaccatgaacgcgttggaagaagtttacaagattgcaagggcacaaacacttattgctctttgtagtactgttcctggttactggttcacagttgcattcatcgataagattggtcgatttgcaattcagttgatgggattcttcttcatgacagtcttcatgtttgccttagccattccataccatcactggactctcaaggatcacagaattggcttcgtggtcatgtactcattcacctttttcttcgccaattttggtccaaacgccacaacattcgtcgtccctgctgagattttcccagccaggcttaggtccacatgccatggaatatcagcagcagcaggtaaagcaggagctatggttggtgcatttggattcttatacgctgctcagcccacggatccaacaaagactgacgccggttaccctcctggcattggtgtgaggaactcgttgatcgtccttggttgtgttaacttcctcggtatgctgttcacattcttggttccagaatccaatgggaagtcattggaagatttgtcgagggaaaacgaaggggaagaggaaactgtagctgaaataagagcaacaagtggaaggacagttcctgtgtgagttttagacaagttatcagttagtatacactacaatgcagtttgagttaatttgtggtatttgggattagaaagagattgtttgttggtttgttataagaagatggaataagctcttatctttttgtttgtttgtttgggtaattaaacattattaccttacttctgcaaatctcagaaattctgagattatataaagtaaccaaaggaggttctttggttgtctatctcttttataaaaaaaaaaaaaaaaaaa

SEQ ID NO: 1445 - protein, 538 aa, Solanum lycopersicum
MANDLQVLNALDVAKTQLYHFTAIVIAGMGFFTDAYDLFCISMVTKLLGRLYYHHDGALKPGSLPPNVSAAVNGVAFCGTLAGQLFFGWLGDKMGRKKVYGMTLMIMVICSIASGLSFGHTPKGVMTTLCFFRFWLGFGIGGDYPLSATIMSEYANKKTRGAFIAAVFAMQGFGILAGGMVAIIVSAAFKGAFPAPAYEVDAIGSTVPQADFVWRIILMFGAIPAGLTYYWRMKMPETARYTALVAKNLKQAANDMSKVLQVEIEAEPEKVTAISEAKGANDFGLFTKEFLRRHGLHLLGTASTWFLLDIAFYSQNLFQKDIFSAIGWIPPAQTMNALEEVYKIARAQTLIALCSTVPGYWFTVAFIDKIGRFAIQLMGFFFMTVFMFALAIPYHHWTLKDHRIGFVVMYSFTFFFANFGPNATTFVVPAEIFPARLRSTCHGISAAAGKAGAMVGAFGFLYAAQPTDPTKTDAGYPPGIGVRNSLIVLGCVNFLGMLFTFLVPESNGKSLEDLSRENEGEEETVAEIRATSGRTVPV

SEQ ID NO: 1446 - DNA, 1826 bp, Solanum lycopersicum
  CDS (38)..(1624)
agaaagtgcacaattttttgaaccaattttaggcattatggctgtgggggataatgataataataatttacaagtgcttaatgcacttgatttggctaaaactcaactttaccattttacagctattgttattgctggaatgggattttttactgatgcttatgatctgtttagtatttctcttgtcactaaattgcttgggcgtttatactataccaaaccggatcttttgaaacccggaacactccctccggccgtatcagcctcggtcacgggtgttgcccttgttggcaccctagccggccagctattctttggctggctaggtgacaaaatgggacgaaaaaaggtgtatggtatgactttagttctcatggttgtgtgttctgttgcttcagggctctcctttggtagtacacctaagggtgttatgactacattgtgtttttttaggttttggcttggatttggtattggtggtgattaccctttgtccgctaccatcatgtctgaatacgctaacaaaaagacacgtggtgcattcatagcggcggtattcgctatgcaaggttttggaattttgtttagtgggatagttgcacttatcacagcagctggattcgatcacgcgtatagatccccaactttcgaggaaaatgctgctctatctactgtaccacaatcggactacatttggcgtatcattctcatgtttggatcattgccagctgccctcacttactactggcgcatgaaaatgcccgaaacagcacgttacacggctctagtcgcgaaagacgcgaagagagccgcgcaggacatgggtaaggtactacaggtggaaattgaaagcgaggaagccaaaatcgaacaaatttcaaggaatgaaactaatcaattcggtctgttttcgtgggaatttgttcgacggcacggattgcatttattcggaacgtgttccacgtggtttttattagatattgctttctacagtcagaatttgtttcagaaggatgtgttctccgccgtcggatggatccctaaagctccaacaatgaacgctgttcaggaagtttacaaaattgcgagagcgcaaacattaattgcgctctgtagcacggtgccagggtactggttcaccgtggcgtttattgacattattggaaggttcgctatccaattgatgggattcttcttcatgacagtgtttatgtttgcgattgccatcccttaccatcattggacactggaggctaaccgcattggattcattgtaatgtattcgcttacatttttctttgcgaattttgggcctaacgctactacatttgtggtcccggcggagattttcccagcgaggcttcgatcaacatgtcatggaatttcagcggctgcaggtaaggctggagctatagtgggagcgtatgggttcttatacgctgcacaaagtaaagatccaaacaaaacagatgcaggatacccagcgggaattggaataaaaaactcgctaattgttctaggctgtatcaatgcacttggaatgttatgtacattttgtgtgccagagccaaaaggaaaatctctagaggaagcatcacaagaaactataactggagaagcatgagatcattaaatgattggaaaatcacttttttttttaatgtttttgttggtttaatttcagttttctttgtattgtgtaagcttgtttgttgcaagtttttattgtattatttttttgtggccaagtgtgttattgtaaaatggttttgctatttatttatattataaataaaaaaattgtttgtaaaaaaaaaaaaaaaaaa

SEQ ID NO: 1447 - protein, 528 aa, Solanum lycopersicum
MAVGDNDNNNLQVLNALDLAKTQLYHFTAIVIAGMGFFTDAYDLFSISLVTKLLGRLYYTKPDLLKPGTLPPAVSASVTGVALVGTLAGQLFFGWLGDKMGRKKVYGMTLVLMVVCSVASGLSFGSTPKGVMTTLCFFRFWLGFGIGGDYPLSATIMSEYANKKTRGAFIAAVFAMQGFGILFSGIVALITAAGFDHAYRSPTFEENAALSTVPQSDYIWRIILMFGSLPAALTYYWRMKMPETARYTALVAKDAKRAAQDMGKVLQVEIESEEAKIEQISRNETNQFGLFSWEFVRRHGLHLFGTCSTWFLLDIAFYSQNLFQKDVFSAVGWIPKAPTMNAVQEVYKIARAQTLIALCSTVPGYWFTVAFIDIIGRFAIQLMGFFFMTVFMFAIAIPYHHWTLEANRIGFIVMYSLTFFFANFGPNATTFVVPAEIFPARLRSTCHGISAAAGKAGAIVGAYGFLYAAQSKDPNKTDAGYPAGIGIKNSLIVLGCINALGMLCTFCVPEPKGKSLEEASQETITGEA

SEQ ID NO: 1448 - DNA, 1924 bp, Solanum lycopersicum
  CDS (20)..(1636)
tctttaaggaagtttagtcatggcgaacgatttgcaagtgctaaatgcactagatgtcgcgaagacacaactgtatcacttcacagcgattgtgattgctggcatgggtttttttactgatgcttatgaccttttctgcatttctatggtcactaaattgcttggtcgtctttactaccatcatgacggtgcattgaaacctggctctctgccccctaatgtttcagcagctgttaatggagtcgccttctgtggcacccttgctggacagttgttcttcgggtggcttggagataaaatgggaaggaagaaagtctatggaatgacccttatgattatggtcatttgttcaattgcctcggggctttcatttggccatacaccaaaaggtgttatgactacgctttgtttcttcagattctggctaggatttggcattggtggtgattatcccctttctgccaccatcatgtctgagtatgctaacaaaaagacccgtggagcgttcattgctgctgtgtttgctatgcaaggtttcggaattctggctggtggaatggtggcaatcattgtttctgcagcattcaagggcgcattccctgcaccagcatatgaggttgatgctattggttcaacagtccctcaggctgatttcgtgtggcgtataattctcatgtttggtgcaatccctgctggacttacttattactggcgtatgaagatgcctgaaactgcccgttacactgccttggtcgccaagaacttgaaacaggcagctaacgacatgtccaaggtgttgcaagtcgaaattgaagcagagccagagaaagttacagctatttctgaagcaaaaggagccaatgactttggtttgttcactaaggagttcctccgtcgccatggacttcacttgcttggaactgctagcacatggttcttgttggacattgctttctacagtcaaaaccttttccagaaggacattttcagtgcaattggatggattccaccagcacaaaccatgaacgcgttggaagaagtttacaagattgcaagggcacaaacacttattgctctttgtagtactgttcctggttactggttcacagttgcattcatcgataagattggtcgatttgcaattcagttgatgggattcttcttcatgacagtcttcatgtttgccttagccattccataccatcactggactctcaaggatcacagaattggcttcgtggtcatgtactcattcacctttttcttcgccaattttggtccaaacgccacaacattcgtcgtccctgctgagattttcccagccaggcttaggtccacatgccatggaatatcagcagcagcaggtaaagcaggagctatggttggtgcatttggattcttatacgctgctcagcccacggatccaacaaagactgacgccggttaccctcctggccattggtgtgaggaactcgttgatcgtccttggttgtgtaacttcctcggtatgctgttcacattcttggttccagaatccaatgggaagtcattggaagatttgtcgagggaaaacgaaggggaagaggaaactgtagctgaaataagagcaacaagtggaaggacagttcctgtgtgagttttagacaagttatcagttagtatacactacaatgcagtttgagttaatttgtggtatttgggattagaaagagattgtttgttggtttgttataagaagatggaataagctcttatctttttgtttgtttgtttgggtaattaaacattattaccttacttctgcaaatctcagaaattctgagattatataaagtaaccaaaggaggttctttggttgtctatctctttttataaaacatttcttgactctaaaaaaaaaaaaaaaaaactcgagactagttca

SEQ ID NO: 1449 - protein, 538 aa, Solanum lycopersicum
MANDLQVLNALDVAKTQLYHFTAIVIAGMGFFTDAYDLFCISMVTKLLGRLYYHHDGALKPGSLPPNVSAAVNGVAFCGTLAGQLFFGWLGDKMGRKKVYGMTLMIMVICSIASGLSFGHTPKGVMTTLCFFRFWLGFGIGGDYPLSATIMSEYANKKTRGAFIAAVFAMQGFGILAGGMVAIIVSAAFKGAFPAPAYEVDAIGSTVPQADFVWRIILMFGAIPAGLTYYWRMKMPETARYTALVAKNLKQAANDMSKVLQVEIEAEPEKVTAISEAKGANDFGLFTKEFLRRHGLHLLGTASTWFLLDIAFYSQNLFQKDIFSAIGWIPPAQTMNALEEVYKIARAQTLIALCSTVPGYWFTVAFIDKIGRFAIQLMGFFFMTVFMFALAIPYHHWTLKDHRIGFVVMYSFTFFFANFGPNATTFVVPAEIFPARLRSTCHGISAAAGKAGAMVGAFGFLYAAQPTDPTKTDAGYPPGHWCEELVDRPWLCNFLGMLFTFLVPESNGKSLEDLSRENEGEEETVAEIRATSGRTVPV

SEQ ID NO: 1450 - DNA, 1707 bp, Gibberella zeae
  CDS (1)..(1707)
atggcccaagaagcgcgtcccgtcgcaaagacgagtggcggaaataatgcctttcacaacttccacaacgactttgcccacatcgccgaccccaatgagcgtcgccgtctcgcccttgcagagattgacaaggctccctttggatggtatcatgttcgagcatgcatcgtcgcaggtgtcggtttcttcactgactcgtacgatatcttctgtgtctccatgttgaccatcatgctcggcatcgtctactatcccgggaagggcaagttgcccaccagctctgacaatgccatcaagctgtctacttctgccggtacggtgataggacagtttggctttggtatgctggccgatattgtcggtcgaaagcgcatgtatggtctggagttgatcgtcaccatctttgctacgcttgctcaggccctgactgctggatcgccttccacctcccttgttggacttatcatcttctggcgtgttatcatgggcgtgggtatcggtggcgactatccattgtcttccatcattacttcagagttcgctactaccaagtggcgaggtgccatgatggctgccgtctttgccatgcaaggtatcggccaacttgtcgcagctcttgtcatgatgttcctcactctcggcttcaagtcttctcttgagcaagctgccgatacaaagagctgcactggagattgccaaattgctgttgacaagatgtggcgaacacttgttggcttcggagctgtccccgcttgcattgccctctactaccgtcttactatccctgagactcctcgttacacctttgacgtcgcccgtgacgtcgagcaggccgatgaggacgtcaaggcttatatcaacggcaagagcgaaggcaacaccgacgaagtcacccgtgcccagaaccttcaatccgctaagactaacctcgaagtccccaaggccagctggagagacttcttccagcactacagcaagtggaagaacgcctctctgcttcttggaactgctggttcatggttctgtctcgatgtggctttctatggtctctctttgaataacggaaccatcctcaaggttattggatattctaccaaggatgctactaatgtctacgagtttctccacaacacagctgtcggaaatatcattattgtcttggcaggagctgttccaggttactgggtttctgtggcgactattgatactcttggacgaaagacgattcaacttggtggtttcattatcctgactatccttttcattgtcatgggctttgcttacaaccacatcccttccaacggacttttggctatttacgttcttgcccaattctttttcaactttggccccaacaccactactttcatcgtccctggtgaagtattccctactcgataccgttcaacctcccacggtatctctgctgccagcggtaaaatcggttccatcatcggccaaggtgccatttccatcctccgaacccacggagccacagataagaacgaggcaccttggatggaccacgttcttgagatttacgctcttttcatgcttcttggtatcttcactactctgttgattcccgagactgctcgcaagactcttgaggagctttcgggtgaagatgactacgccaaccatgatcatgcgttggagtcagagactcaggctagtcacgacaaggctagacgaaccagcgtttag

SEQ ID NO: 1451 - protein, 568 aa, Gibberella zeae
MAQEARPVAKTSGGNNAFHNFHNDFAHIADPNERRRLALAEIDKAPFGWYHVRACIVAGVGFFTDSYDIFCVSMLTIMLGIVYYPGKGKLPTSSDNAIKLSTSAGTVIGQFGFGMLADIVGRKRMYGLELIVTIFATLAQALTAGSPSTSLVGLIIFWRVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGKSEGNTDEVTRAQNLQSAKTNLEVPKASWRDFFQHYSKWKNASLLLGTAGSWFCLDVAFYGLSLNNGTILKVIGYSTKDATNVYEFLHNTAVGNIIIVLAGAVPGYWVSVATIDTLGRKTIQLGGFIILTILFIVMGFAYNHIPSNGLLAIYVLAQFFFNFGPNTTTFIVPGEVFPTRYRSTSHGISAASGKIGSIIGQGAISILRTHGATDKNEAPWMDHVLEIYALFMLLGIFTTLLIPETARKTLEELSGEDDYANHDHALESETQASHDKARRTSV

SEQ ID NO: 1452 - DNA, 2043 bp, Solanum lycopersicum
  CDS (164)..(1780)
ctcgtgccgattaaaaataaaaatgcaaaataatccaaagttttgatttttaattttgggtatttttgttggagttcttgaacgtaaaaaaaagaccaaatcttgaaatttggtttttttttttggtggaaattgaagatttactctttaaggaagtttagtcatggcgaacgatttgcaagtgctaaatgcactatatgtcgcgaagacacaactgtatcacttcacagcgattgtgattgctggcatgggtttttttactgatgcttatgaccttttctgcatttctatggtcactaaattgcttggtcgtctttactaccatcatgacggtgcattgaaacctggctctctgccccctaatgtttcagcagctgttaatggagtcgccttctgtggcacccttgctggacagttgttcttcgggtggcttggagataaaatgggaaggaagaaagtctatggaatgacccttatgattatggtcatttgttcaattgcctcggggctttcatttggccatacaccaaaaggtgttatgactacgctttgtttcttcagattctggctaggatttggcattggtggtgattatcccctttctgccaccatcatgtctgagtatgctaacaaaaagacccgtggagcgttcattgctgctgtgtttgctatgcaaggtttcggaattctggctggtggaatggtggcaatcattgtttctgcagcattcaagggcgcattccctgcaccagcatatgaggttgatgctattggttcaacagtccctcaggctgatttcgtgtggcgtataattctcatgtttggtgcaatccctgctggacttacttattactggcgtatgaagatgcctgaaactgcccgttacactgccttggtcgccaagaacttgaaacaggcagctaacgacatgtccaaggtgttgcaagtcgaaattgaagcagagccagagaaagttacagctattttgaagcaaaagggagccaatgactttggtttgttcactaaggagttcctccgtcgccatggacttcacttgcttggaactgctagcacatggttcttgttggacattgctttctacagtcaaaaccttttccagaaggacattttcagtgcaattggatggattccaccagcacaaaccatgaacgcgttggaagaagtttacaagattgcaagggcacaaacacttattgctctttgtagtactgttcctggttactggttcacagttgcattcatcgataagattggtcgatttgcaattcagttgatgggattcttcttcatgacagtcttcatgtttgccttagccattccataccatcactggactctcaaggatcacagaattggcttcgtggtcatgtactcattcacctttttcttcgccaattttggtccaaacgccacaacattcgtcgtccctgctgagattttcccagccaggcttaggtccacatgccatggaatatcagcagcagcaggtaaagcaggagctatggttggtgcatttggattcttatacgctgctcagcccacggatccaacaaagactgacgccggttaccctcctggcattggtgtgaggaactcgttgatcgtccttggttgtgttaacttcctcggtatgctgttcacattcttggttccagaatccaatgggaagtcattggaagatttgtcgagggaaaacgaaggggaagaggaaactgtagctgaaataagagcaacaagtggaaggacagttcctgtgtgagttttagacaagttatcagttagtatacactacaatgcagtttgagttaatttgtggtatttgggattagaaagagattgtttgttggtttgttataagaagatggaataagctcttatctttttgtttgtttgtttgggtaattaaacattattaccttacttctgcaaatctcagaaattttgagattatataaagtaaccaaaggaggttctttggttgtttatttttttttaaaaaaaaaaaaaaaaaaaaaaaaaaaa

SEQ ID NO: 1453 - protein, 538 aa, Solanum lycopersicum
MANDLQVLNALYVAKTQLYHFTAIVIAGMGFFTDAYDLFCISMVTKLLGRLYYHHDGALKPGSLPPNVSAAVNGVAFCGTLAGQLFFGWLGDKMGRKKVYGMTLMIMVICSIASGLSFGHTPKGVMTTLCFFRFWLGFGIGGDYPLSATIMSEYANKKTRGAFIAAVFAMQGFGILAGGMVAIIVSAAFKGAFPAPAYEVDAIGSTVPQADFVWRIILMFGAIPAGLTYYWRMKMPETARYTALVAKNLKQAANDMSKVLQVEIEAEPEKVTAILKQKGANDFGLFTKEFLRRHGLHLLGTASTWFLLDIAFYSQNLFQKDIFSAIGWIPPAQTMNALEEVYKIARAQTLIALCSTVPGYWFTVAFIDKIGRFAIQLMGFFFMTVFMFALAIPYHHWTLKDHRIGFVVMYSFTFFFANFGPNATTFVVPAEIFPARLRSTCHGISAAAGKAGAMVGAFGFLYAAQPTDPTKTDAGYPPGIGVRNSLIVLGCVNFLGMLFTFLVPESNGKSLEDLSRENEGEEETVAEIRATSGRTVPV

SEQ ID NO: 1454 - DNA, 1932 bp, Glomus versiforme
  CDS (113)..(1678)
aatcgacctttctattaactataaatataatatataatcagataattattttcaaaaaaaaaaaagaagaaaataaaagacctttaaacctttaattcctttatcatacataatgtctacatccgatagagtaacaattgatgtcgataaacgtagagcggctctcaaagagattgatgatgcgaaattcggttggcaacatattcgtgcgtgtttagtagctggtactggcttttttatggacgcatacgatctttttgccgtcaattttgcttccactatgattgggtacgtctattatggcggtaaaacaccagcaaatattgacttgggtctgaaggtgacaggttctattggcactttacttggtcaattattttttggatatttggctgatcgccttgggagaaagaggatgtatggtgttgaattaatgatcattattgttgcgacagttgcttctgcgttgtccggtgaaagtcgtgctgttacagtagtcggtaccatcatgttttggcgtgtaataatgggtgtcggtattggaggagattatcccctttccgcaattattacttctgaattcgccacaaaaaaaagaagaggtgctatgatggcgtcagtatttgctatgcaaggatttggaattttgggctctgctattgtagcacttgccgtattggcaggttttaggaatgaaattatcaaagacgtttctgcagttgattactgttggcgtatagttctcggctgtggtgctgtgcccgggttagcggctctctacttccgtctcacaattccagaaactccacgatatactatggacgtagaacatgatgttaacaaagccactagtgatattacctcttatttgcaaaaaaatgacgtaaatgaagatgatacaaatacaggcaatcatgtcggtgtaccaaaagcaagctggtcggatttcgtaagttatttcggaaaatggagcaatggaaaagttttgttaggaacttctatgtcatggttcgcattggatattgctttttatggaattggtcttaataacggaatcattttgagcgccattggctactctgagacccacgaggctgaccttaatttaagagcttataattcactcaaaaatatggctgtcggtaatattataattaccatcatgggtaccgctcctggttattgggttaccgcagcacttgtagatagttggggtagaaaacctattcaattaatgggtttcggtgttctcactgcattatttattgtcatgggagctgcctttaatccactcaaagaacattcaattccggcttttatcatcttattcacattgttacagttcttccaaaatttcggcccaaacacaacaacattcattgtaccaggagaagtttttccaacacgttacagatcaactggtcatggtatatcagctgcatcaggaaaacttggagctattgttgcccaagttggtttctcaaaacttaaagatattggtggatcaaacgcatttgtaggaccattacttttaatcttttccgcatggatgtttattggcggtttattctcaatacttattcctgaaacaaaaggtttatcacttgaagaattagccaacgaagaacatacttatgacgttgaagaaaggaaagaaaggataaaggctgacgcataatatctgatatataaagtctcatgcataataatatattataaacacacattcaacatttaaattttttcttttacaatacgataaattgggagttatggaaatccctcccaaattcttttaatgtataaaaacatatttattactatgtatttatgggcaaatatatatatatatataaatttcaatcatataaatatggaaataattccaaccaattttctttttttttttctttaaaaaaaaaaaaaaaaaaa

SEQ ID NO: 1455 - protein, 521 aa, Glomus versiforme
MSTSDRVTIDVDKRRAALKEIDDAKFGWQHIRACLVAGTGFFMDAYDLFAVNFASTMIGYVYYGGKTPANIDLGLKVTGSIGTLLGQLFFGYLADRLGRKRMYGVELMIIIVATVASALSGESRAVTVVGTIMFWRVIMGVGIGGDYPLSAIITSEFATKKRRGAMMASVFAMQGFGILGSAIVALAVLAGFRNEIIKDVSAVDYCWRIVLGCGAVPGLAALYFRLTIPETPRYTMDVEHDVNKATSDITSYLQKNDVNEDDTNTGNHVGVPKASWSDFVSYFGKWSNGKVLLGTSMSWFALDIAFYGIGLNNGIILSAIGYSETHEADLNLRAYNSLKNMAVGNIIITIMGTAPGYWVTAALVDSWGRKPIQLMGFGVLTALFIVMGAAFNPLKEHSIPAFIILFTLLQFFQNFGPNTTTFIVPGEVFPTRYRSTGHGISAASGKLGAIVAQVGFSKLKDIGGSNAFVGPLLLIFSAWMFIGGLFSILIPETKGLSLEELANEEHTYDVEERKERIKADA

SEQ ID NO: 1456 - DNA, 1527 bp, Oryza sativa
  CDS (1)..(1527)
atggccggcaaccagcagctgcgggtgctgcacgccctggacattgcaaggacacagctgtaccatttcatcgcgatcgtgatcgccggcatgggcttcttcaccgacgcctacgacctcttctccatctccctcgtcgccgacctcctcggccacgtctactaccacggcgagctcccccggaacatccacgccgccgtcaccggcatcgcgctttgtggcaccgtccccggacagctcgtcttcggctggctcggtgacaagatgggccggaagcgtgtctatggaatcaccctcctcctcatggtcgcctcctctctcgcctccggactctccttcagtaagcgcgaggggaagaacgttatcgctgtgctttgcttcttccggttttggcttggtgttagcatcggtggcgattacccgctctccgccaccatcatgtcagagtacgccaacaagaggactcgtggtgccttcattgctgctgtttttgctatgcaaggtttcggcaaccttgctgctgggatcattgggatgatagtatctgcagctttcaagcattcatcgccatcaaagattgactatgcctggcggataatcctcatgttcggcgccattcctgctgctctcacttaccactggcgcatgaagatgccagaaacagcacggtacactgccctcatctccaagaatgcaaagaaggctgccaaggacatgtctgccgtgctcaatgtcaacataaccccagacgacgaagctatcaatgagcttgcaaggcaggacgagtatggcctcttctcgttcgagtttctccaccgccatggcctccacctccttggcaccaccgtctgttggttcgtcctcgacgtcaccttctactcgctcaacattttcatgaagaatatcttcaccgaggtccgtcttcttcctcgtctagatagcgaataccaccataccctccagcggatgatcaccatgacagcagttcacacatttatcgcgctttgtggtgcacttcccgggtacttcttcactgtcgccttcgttgatcgcatcggccgtgtcaagatccagctgatcggattcaccatgatgactcttttcatgctttgtcttgcaattccttatgatcagtggctgagccacaagaacaagtatggatttgcagtcatgtatggcctgaccttcttcttcgccaactttgggccaaatactacaaccttcataattccggctgagattttccctgcaaggctacggtccacatgccatgggatatctggtgcagttgggaagatcggtgccattgtcggtgtgtttggtttcttgtatacggaataccatatcaggatctttctgtttgtccttattgggtgcaatcttgttggattcatcttcacccttctcttgccagagtcgaaagggaagtcccttgaggatctcactggggagattgaagagttgcaggaggaagatgaaggaagtgaagttgctttgtctagacccatacataatgtgcccttatag

SEQ ID NO: 1457 - protein, 508 aa, Oryza sativa
MAGNQQLRVLHALDIARTQLYHFIAIVIAGMGFFTDAYDLFSISLVADLLGHVYYHGELPRNIHAAVTGIALCGTVPGQLVFGWLGDKMGRKRVYGITLLLMVASSLASGLSFSKREGKNVIAVLCFFRFWLGVSIGGDYPLSATIMSEYANKRTRGAFIAAVFAMQGFGNLAAGIIGMIVSAAFKHSSPSKIDYAWRIILMFGAIPAALTYHWRMKMPETARYTALISKNAKKAAKDMSAVLNVNITPDDEAINELARQDEYGLFSFEFLHRHGLHLLGTTVCWFVLDVTFYSLNIFMKNIFTEVRLLPRLDSEYHHTLQRMITMTAVHTFIALCGALPGYFFTVAFVDRIGRVKIQLIGFTMMTLFMLCLAIPYDQWLSHKNKYGFAVMYGLTFFFANFGPNTTTFIIPAEIFPARLRSTCHGISGAVGKIGAIVGVFGFLYTEYHIRIFLFVLIGCNLVGFIFTLLLPESKGKSLEDLTGEIEELQEEDEGSEVALSRPIHNVPL

SEQ ID NO: 1458 - DNA, 1881 bp, Oryza sativa
  CDS (70)..(1683)
acagtgctaacggcctgcagcagagtgcagcgactcccctgaagaaacagagtagctgagattggcgccatggccggcgagctcaaggtgctgaacgcgctcgactcggcgaagacgcagtggtaccatttcacggcgatcgtgatcgccggcatggggttcttcaccgacgcctacgatctcttctccatctccctcgtcaccaagctgctcggccgcatctactacttcaacccggcgtccaagagccccggctctctcccgcccaacgtctccgccgccgtcaatggcgtcgccttctgcggcaccctcgccggtcagctcttcttcggctggctcggcgacaagatggggcgcaagaaggtgtacgggatgacgctcatgctcatggtcatctgctgcctcgcctccggcctctcgttcgggtcgtcggcgaaaggcgtcatggccacgctctgcttcttccgcttctggctcggcttcggcatcggcggcgactacccgctctcggcgaccatcatgtcggagtatgctaacaagcgtacccgtggcgcgttcatcgccgccgtgttcgccatgcaggggttcggcaacctcaccggcggcatcgtggccatcatcgtgtcggcgttcaaggcgaggttcgacgcgccggcgtacagggacgaccgggccggctccaccgtgccgcaggccgactacgcgtggcgcatcgtgctcatgttcggcgccatcccggcgctgctcacctactactggcggatgaagatgccggagacggcgcgctacaccgcgctggtggccaagaacgcgaagcaggccgccgccgacatgacgcaggtgctcaacgtcgagatcgtggaggagcaggagaaggccgacgaggtcgcgcggcgcgagcagttcgggctcttctcccgccagttcttgagacgccatgggcgccacctgctgggcacgacggtgtgctggttcgtgctggacatcgccttctactcgtcgaacctgttccagaaggacatctacacggcggtgcagtggctgcccaaggcggacaccatgagcgccctggaggagatgttcaagatctcccgggcacagacgctcgtggcgctgtgcggcaccatcccgggctactggttcaccgtcttcttcatcgacatcatcggccgcttcgtcatccaactcggcggcttcttcttcatgacggcgttcatgctcggcctcgccgtgccgtaccaccactggacgacgccggggaaccacatcggcttcgtggtcatgtacgccttcaccttcttcttcgccaacttcgggcccaactccacgaccttcatcgtgccggcggagatcttcccggcgaggctgcgttccacctgccacggcatctcggcggcggcggggaaggccggcgccatcgtcgggtcgttcgggttcctgtacgcggcgcagagcacggacgcgagcaagacggatgccggctacccgccgggcatcggcgtgcgcaactcgctcttcttcctcgccggatgcaacgtcatcggcttcttcttcacgttcctggtgccggagtcgaaggggaagtcgctggaggagctctccggcgagaacgaggacgatgacgatgtgccggaggcgccctcgacggccgatcaccggactgcgccggcgccgccagcttgataccccgcggcaaaacccaaatggtcaatcatcagcgttttgttgtaatatatgtgcaatggatgattattctggttctggtagtgtaccgaacaaaattacaaatactagtcgtcaacccgtgcgagtgatattataaatgacacttagattatgtattaaatatattttttaaaattattgtggcttaaattttgt

SEQ ID NO: 1459 - protein, 537 aa, Oryza sativa
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAFKARFDAPAYRDDRAGSTVPQADYAWRIVLMFGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPSTADHRTAPAPPA

SEQ ID NO: 1460 - DNA, 1698 bp, Phaeosphaeria nodorum
  CDS (1)..(1698)
atgagtgcgagtttgttttgcgtaggtaacagtgccttccacaacttcaacaatgattttgcccacatccaagacccaaatgagcgccgtcgtcttgcgctcgcggaaatcgacaaggcgcccttcggctggtaccacattcgcgccattctagtcgccggcacaggtttcttcacagactcgtacgacatcttctgcgtgtcgctcttgacgatcatgttgggtatcgtataccacaagggcgccctcacaacaccacaagatactgcaatcaagctctccacctcggccggtactgtcattggccaggtcggattcggtgcgcttgctgatatcgttggccgtaagaagatgtacggtcttgagttgatccttatcatcgttgccactcttgctcaatctctggttggccctggtcccggtacttcggtcgttggactgatcatcttctggcgtgttctcatgggtatcggaatcggtggtgattaccctctttcatccatcatcacctctgagttcgcgaccactaagtggcgtggtgctatgatgggtgccgtgttcgccatgcagggtttcggacagctcggtggagccgtcgtcatggtctgcctcgttactggcttcaagggcaaactcaaccaggccaccgcctacggcaagtgcactggcgactgccagattgccgtcgacaagatgtggcgtgccctaatcggtatcggtatcgttcccgcgtgtatcgcactctacttccgtctcaccattcctgaaaccccgcgctacactttcgacgttgctcgtgacgtcgagaaggcgaacgaggacgttaagcactacatttccgggcagaaaggtgagggccaccctgatgaggctctccaggtggctgctcgtcgtcaatcggtccaacagctcgaggtccccgtggcttcctggtccgacttcttccgcttctacggcaagctcaagaacggcaagattctgttcggaaccgccatgtcttggttgctcctcgatgtcgctttctacggtctcggtctcaacagcaccaccgtcctccaggctatcggctacggaggtggtgccacggtttaccacaagctctacaacctcgcagctggtaactgtatcttgatttgcgctggtgctatccctggttactggctcgccgttgccaccatcgacactgtaggccgcaagcctctccagctgatcggattcgtcttcctgaccatcctcttcttgatttggggtttcgcctaccaccacatcagcggccacggcatgatggctatctatgtcttgatccagctgttcttcaactggggccccaatacgacaaccttcattgtgcccggcgagtgtttcccgacccgataccgctcaacgtcccacggtatctctgccggttctggcaagattggttccatcatcgctcagggcgctatcgctcccctccgtacccgcggcgctacaaaggacaacgccagcccatggctcaaccacgtcatgcagatcttctccgcattcatgttcgctggtatcttcaccactctcttgattcctgagaccaagcgccgcacccttgaggacttggccatggactgggatatgggcaccgagagcataaccggagcgcccaagcacaacggccaccgaagcagcgacgaagctgctgcggagaacgagctcaaggcttaa

SEQ ID NO: 1461 - protein, 565 aa, Phaeosphaeria nodorum
MSASLFCVGNSAFHNFNNDFAHIQDPNERRRLALAEIDKAPFGWYHIRAILVAGTGFFTDSYDIFCVSLLTIMLGIVYHKGALTTPQDTAIKLSTSAGTVIGQVGFGALADIVGRKKMYGLELILIIVATLAQSLVGPGPGTSVVGLIIFWRVLMGIGIGGDYPLSSIITSEFATTKWRGAMMGAVFAMQGFGQLGGAVVMVCLVTGFKGKLNQATAYGKCTGDCQIAVDKMWRALIGIGIVPACIALYFRLTIPETPRYTFDVARDVEKANEDVKHYISGQKGEGHPDEALQVAARRQSVQQLEVPVASWSDFFRFYGKLKNGKILFGTAMSWLLLDVAFYGLGLNSTTVLQAIGYGGGATVYHKLYNLAAGNCILICAGAIPGYWLAVATIDTVGRKPLQLIGFVFLTILFLIWGFAYHHISGHGMMAIYVLIQLFFNWGPNTTTFIVPGECFPTRYRSTSHGISAGSGKIGSIIAQGAIAPLRTRGATKDNASPWLNHVMQIFSAFMFAGIFTTLLIPETKRRTLEDLAMDWDMGTESITGAPKHNGHRSSDEAAAENELKA

SEQ ID NO: 1462 - DNA, 1899 bp, Phaeosphaeria nodorum
  CDS (1)..(1899)
atgggtctccgaaagtgggtctcgcgaccgttgaggggccgtcagatcggagttgaaaaccttatcgcgggtggtgaaggcataccagaggcaaagcgaagaagatggactcttcagacgatcgaccaagcgccgttccagatatgggtcgtggttgtcgctgggatcggcttcctaactgacgcttttggcttgttcgccctcaatgtcgtaactccgatgctaggctatgtatactggcccagcaatgatccaaatgccgttcctgaggtgccatcgtctgtcaagacagccatgatgtgttccacgcttgctggtaccatgatagggcaagtgggattcggcttcgccgccgacatcttaggtcggcggaagatgtatggactggaactcgtcatcatcatagtagggactatgtttctgttgatgagctcgaacggtgagagaaacagcatgcatgtcgcaggctggctcataacttggcgagctataatgggagtgggaattggtgcggattaccctttgagcgctgtcataacagcagaatttgcgcctcggagatatcgagctcgcatgctttcttgggtgttctttgctcagcccgtgggacaactccttgcaaacgtgctgtctttggcagccgtcgaagcgtacaagccatggatcgaacggtcctcgcactactgcaaaccagacgacgacgaatgcttccgcgcaatcgatcgcctctggaggctagttgtcggtattggcatagtcccagcagtcatcgcattaatttttcgcttcacgataccagaatcgcctcgctacacactggatattctgcaaaacacgcgagcaacgctagaagatacagccaactacttcgatgcacctgaacttcacgccgagcatgggccagtcgagatgttccccaccagacccgagatccacgtctcgccccgcacttctatttgctcaggaattggaccagacgaaatcattgaggatgacagcgattctgacagaagaccaagcgacgcacatcttcgccagccatctccagagccggacctaccgccaggtgaccccaacttcgttccgcctcttgcttcttggacagacgcgaagaagttcttcatcgccgagggtaattggcagtacctccttggcacatcattggcatggctattccttgattttgcattctatggtcttggactctcgtcgccgcagattgtaagcaacatctggggagacccaaagattgacaaagtcgtatcaaagtttccctccgtttatgagacgctccacggtaacagcttacacacactggtcatggtatccatcggtactattaccggtgggctgctgatgatcaagattgtgaagcatgtttcaccgaagacgatccaattctggggctttcttgtcctgtttgtgttgtttatcgtcactggtagtgcgtggaacaagttgctggacagcagtcgatccgggttgatcgtgctttacgtcttaagccatatcgcattcaaccttggaccaaacgtgacgacgtttatcataccagccgagatcttcccaactcgataccgctgcacatgccacggcatcgccgctgcttccggcaagctgggctcatggctagttcaaatcttcctcgcatatgccttcaagtccgaagatgcggacgaccaaaactcatggacaaatgcgcgtttcaaagactttggtaaggtcttgcaagtcatgagcgcgttcatggtagccggtgcgattacgacatacttccatgtgccggagacgagagatcacgataataagagtaggacactggaggtgctggcgtgtggaaagaaagttattgatgagctgaataaacagaggagaagggaggatgaggatgactcttga

SEQ ID NO: 1463 - protein, 632 aa, Phaeosphaeria nodorum
MGLRKWVSRPLRGRQIGVENLIAGGEGIPEAKRRRWTLQTIDQAPFQIWVVVVAGIGFLTDAFGLFALNVVTPMLGYVYWPSNDPNAVPEVPSSVKTAMMCSTLAGTMIGQVGFGFAADILGRRKMYGLELVIIIVGTMFLLMSSNGERNSMHVAGWLITWRAIMGVGIGADYPLSAVITAEFAPRRYRARMLSWVFFAQPVGQLLANVLSLAAVEAYKPWIERSSHYCKPDDDECFRAIDRLWRLVVGIGIVPAVIALIFRFTIPESPRYTLDILQNTRATLEDTANYFDAPELHAEHGPVEMFPTRPEIHVSPRTSICSGIGPDEIIEDDSDSDRRPSDAHLRQPSPEPDLPPGDPNFVPPLASWTDAKKFFIAEGNWQYLLGTSLAWLFLDFAFYGLGLSSPQIVSNIWGDPKIDKVVSKFPSVYETLHGNSLHTLVMVSIGTITGGLLMIKIVKHVSPKTIQFWGFLVLFVLFIVTGSAWNKLLDSSRSGLIVLYVLSHIAFNLGPNVTTFIIPAEIFPTRYRCTCHGIAAASGKLGSWLVQIFLAYAFKSEDADDQNSWTNARFKDFGKVLQVMSAFMVAGAITTYFHVPETRDHDNKSRTLEVLACGKKVIDELNKQRRREDEDDS

SEQ ID NO: 1464 - DNA, 1812 bp, Phaeosphaeria nodorum
  CDS (1)..(1812)
atgctgtcgttcgggcgagttggaaatgctgcatatcgcgatgttcctggagtatatactcatatagccgacccaaatgagcgtcggcgcatggccctcgcagaggtcgataaggcaccctttggatggtatcacgttcgactagcagttgttactggcatcggtttcttcacagatgcgtattctctgtttgccatcaatctcgcagtcatcttgcttggtattgtctactggcaagatgaacaacatcgtggtgtcatgccgcacaatgcggatacttccttgaaggtcgccacatccgccggagcaatttttggcatggtcatcttcggatacctgggagactatctagggcggaagaagatgtatggggttgaattgatgataatcatttcgacgacacttgctcagtcactctgcggagagtctacgactctgtcggtggtcggcgtactgatcttctaccgggcggtgatgggaataggtgtaggcggagattacccgttgagcgccgtcatcacagctgaattctccagcaccagatatcgaggaggaatcattgcagccgtctttgccatgcaaggactcgggcagcttgccgccagcctggtgactttgatcgtcgtcgttgcatacaaagaccacctgctgccggttgcctcagtggcggattgcagcggccaatgtgccttgacagtcgacaagatgtggaggattatcatcgcctttggaggcattcccggctggtttgcgctatactatcgactcacgatcccagaaacacctcgatacaccttcgacgtcctttacgatgtcgagaaagcttcagtcgatgcacgaaagtaccgttatggcaagcaaggcaatgtcgttaacccagtcactcaggcccaagcacgtagagatatggcaaagtacaggacaccacgaccgtccattctcgaagtcctgcgcttctactcgcaaaggcgtcaagcgatccgactgttcggcacatcaatgagctggttcttcctcgaccttgcgttctacggcctcggcttttcctccgcctctctcctctccaccatgggcttcgaccaacgcgccaacctctacgaaaacctgcgcaacaccgccaccggccaaatcgtcctcatctgcgccggcgcactacccggctactggctcaccgtcttcaccgtcgacaaaatcgggcggcgcccaattcaaatcggcggcttcgctgtcctgaccatcatcttctgcgtcctgggcttcgcatggcgcagcctgaccaagacgcatctcctcgccttatacgtcctcgcgcagttcttcttcaacttcggccccaatgccacgacgttcatcacgcctgcggaaatcttcccgacgagagtgcgcagcacagggcatgggttcagcgcgggcatgggcaaacttggtgcggtgtttgcgcagattttcttcgcgccgatgatcaagaagggcgcgacgcatgacaatccgacgccctggattcacggcgtcatgcagattttcgcgctgttcatgttcctcgggatgctgacgagcttgctggtgccggaaagtaagcaggcgaggctcgaggcgctggcgggcgagaaggaggatgtgtatgagttgcaggcgagttcgtggaggaatagaaggggtggaggtgggagtgtgagtgtaaggggagatggggatgaggagaggaggagccagagggtgagtgggagcacgagtacggagggcgcagggtacgaaggagagaagaagtggtggcgcttccgacagatggagatgcacgggcaggctgtctaa

SEQ ID NO: 1465 - protein, 603 aa, Phaeosphaeria nodorum
MLSFGRVGNAAYRDVPGVYTHIADPNERRRMALAEVDKAPFGWYHVRLAVVTGIGFFTDAYSLFAINLAVILLGIVYWQDEQHRGVMPHNADTSLKVATSAGAIFGMVIFGYLGDYLGRKKMYGVELMIIISTTLAQSLCGESTTLSVVGVLIFYRAVMGIGVGGDYPLSAVITAEFSSTRYRGGIIAAVFAMQGLGQLAASLVTLIVVVAYKDHLLPVASVADCSGQCALTVDKMWRIIIAFGGIPGWFALYYRLTIPETPRYTFDVLYDVEKASVDARKYRYGKQGNVVNPVTQAQARRDMAKYRTPRPSILEVLRFYSQRRQAIRLFGTSMSWFFLDLAFYGLGFSSASLLSTMGFDQRANLYENLRNTATGQIVLICAGALPGYWLTVFTVDKIGRRPIQIGGFAVLTIIFCVLGFAWRSLTKTHLLALYVLAQFFFNFGPNATTFITPAEIFPTRVRSTGHGFSAGMGKLGAVFAQIFFAPMIKKGATHDNPTPWIHGVMQIFALFMFLGMLTSLLVPESKQARLEALAGEKEDVYELQASSWRNRRGGGGSVSVRGDGDEERRSQRVSGSTSTEGAGYEGEKKWWRFRQMEMHGQAV

SEQ ID NO: 1466 - DNA, 1608 bp, Eucalyptus camaldulensis
  CDS (1)..(1608)
atggctaaagaaaatcttggggtgctaaatgcactcgatgtggccaagacacaatggtaccatttcaccgccatcatcattgccggcatggggttcttcaccgacgcgtatgatctcttttgcgtttccctcgtcacgaagctcctcggtcgcatatactactatgagggtaaggataagcctggctcgctccctccgaacgtggctgccgctgtcaacggcgtcgccttctgcggtactctagccggccagctcttcttcggctggcttggggacaaattaggtcggaagcgtgtctatggtttaaccctccttattatgatcatctgctccgtcggctccggcttgtcctttggggattcaccgaatagtgttatagcaaccctatgcttcttccgattctggctcgggtttgggatcggaggggattacccactctccgccaccatcatgtcggagtacgcgaacaagaagactcgtggggcattcatcgctgcagtgtttgcgatgcaagggtttgggattttggggggtgggatcgtcgctttgattgtctcctcagcattcgatcataagtttaaggccccgccttacgaagtcaatccagtgggctcgaccgttcctcaagccgattacgtgtggcgtatcattgtaatgctcggtgcattacccgcggcccttacttattattatagaatgaaaatgcctgaaactgctcgttacaccgccctcgtcgcaagaaacggaaagcaggcagctgcagacatgtctaaggtgttgcaagtggatattgaatcagaacaagagaaggtggagaaatttacgcaagatccccgcaacagctatggccttttctcgaaggaattcgcccgccgccacggcctccacctcgtggggacagccaccacgtggttcttgctcgacatcgctttctatagccaaaacctcttccaaaaggatattttcaccgcgatcgggtggctcccagcggcgaagaagatgaacgccattcacgaggtatacaaaattgctagggcacaaaccctgatcgctctttgcagtactgtgcctgggtattggttcactgtcgcgacgatcgattacatcggaagattcttcatccaaatgatgggtttcgccatgatgtcaatcttcatgtttgccatcgccatcccatacaaccactggaaacatcaccatataggattcgtcgtgatgtactcactcaccttcttcttcgccaacttcgggccaaacgcaacaacattcattgttcccgctgagatcttcccggcgcggttgagatccacatgccatggcatatcggcggctgcagggaaagctggagccattgttggggcttttgggttcttgtatgcggcgcaggataaaacaagccccgatgcaggttataagccgggtatcggcgtgaagaatgcattgcttgtgcttggggggattaatcttgcgggaatgttgttcactttgctcgtgccggagccaaagggcaggtcactggaggaaattggaggagagaacatggatgataatgagatgggtgaaggtagggagatgcagcctccttcattgggaccatttggtggttag

SEQ ID NO: 1467 - protein, 535 aa, Eucalyptus camaldulensis
MAKENLGVLNALDVAKTQWYHFTAIIIAGMGFFTDAYDLFCVSLVTKLLGRIYYYEGKDKPGSLPPNVAAAVNGVAFCGTLAGQLFFGWLGDKLGRKRVYGLTLLIMIICSVGSGLSFGDSPNSVIATLCFFRFWLGFGIGGDYPLSATIMSEYANKKTRGAFIAAVFAMQGFGILGGGIVALIVSSAFDHKFKAPPYEVNPVGSTVPQADYVWRIIVMLGALPAALTYYYRMKMPETARYTALVARNGKQAAADMSKVLQVDIESEQEKVEKFTQDPRNSYGLFSKEFARRHGLHLVGTATTWFLLDIAFYSQNLFQKDIFTAIGWLPAAKKMNAIHEVYKIARAQTLIALCSTVPGYWFTVATIDYIGRFFIQMMGFAMMSIFMFAIAIPYNHWKHHHIGFVVMYSLTFFFANFGPNATTFIVPAEIFPARLRSTCHGISAAAGKAGAIVGAFGFLYAAQDKTSPDAGYKPGIGVKNALLVLGGINLAGMLFTLLVPEPKGRSLEEIGGENMDDNEMGEGREMQPPSLGPFGG

SEQ ID NO: 1468 - DNA, 1602 bp, Sorghum bicolor
  CDS (1)..(1602)
atggaggtgctctcggcgctagacggcgccaggacgcagtggtaccacttcacggcgatcatcgtggcggggatgggcttcttcaccgacgcgtacgacctcttctgcatctccctcgtcaccaagctcatcggccgaatctactacaccgtcgacggctcgcccaagccgggcagcctgccgccgcacgtgtcctcgcccgtcaacggcgtggcgttcgtgggcacgctgtcggggcagctcttcttcggctggctcggcgaccgggtgggccggaagagcgtctacgggatgacgctcgtgacgatgatcgtctgctccgtcgcgtcgggcctctcgttcggctactcgccggcctgcgtcatggccacgctctgcttcttccgcttctggcttggcttcgggatcggcggcgactacccgctgtcggcgaccatcatgtcggagtacgccaacaagaagacgcgcggcgcgttcgtcgctgccgtcttcgccatgcaggggttcggcatcctggccgccggcgccgtcgccatcggcgtcagcgcgctgttccggagcccgttccccgcgccgccctacgacgtcgaccccgcggcgtccacgccggcggaggcggacctggtgtggcgcatcatcctcatgttcggcgccgtgcccgcggcgctcacattctactcgcgtatgaacatgcccgagacggcgcggtacacggcgttggtggcccggaacgcggagcgcgccgcggcggacatgtccagggtgctccaggtcgacatcggcaataaggaggaagggccggagacacagccccggtgccgcggcgagccgcaagaagaagcgacaacggtgccgccgccgccgccgccgttcgggctcttctcccgcgagttctttcaccggcacgggctccacctgctgggcacgacgtcgacgtggctcctcctggacatcgcctactactcgcagaacctgttccagaaggacctgttcagcgcggtggggtggatcccggcggcggagacgatgagcgcgctggacgagctgttccacatcgcgcgcgcgcagacgctgatcgcgctgtgcggcacggtgcccgggtactggttcacggtggcgttcatcgacgtggtggggcggttcgcgatccaggcggtgggattcctcatgatggcggccttcatgctggggctggccgtcccgtacgaccggtggacgcgccccggcaaccagacggggttcgtggtgatgtacgcgctcaccttcttcttcgccaacttcgggcccaacgccaccaccttcatcgtgcccgcggagatctacccggcgcggttccgcgcgacgtgccacggcatctcggcagcgtcgggcaaggtgggcgccatcatcggctccttcgggttcctgtacctggcgcagagccaggacccggccaagacggcgcacgggtacccgccgggcatcggcgtgcgcaactcgctgctgctgctcgccgggtgcagcttcctggggttcctgctcacgttcctggtgccggagcccaagggcaagtcgctcgaggagttgtcgcgcgagaccgagccgggggccgccgagccgtaa

SEQ ID NO: 1469 - protein, 533 aa, Sorghum bicolor
MEVLSALDGARTQWYHFTAIIVAGMGFFTDAYDLFCISLVTKLIGRIYYTVDGSPKPGSLPPHVSSPVNGVAFVGTLSGQLFFGWLGDRVGRKSVYGMTLVTMIVCSVASGLSFGYSPACVMATLCFFRFWLGFGIGGDYPLSATIMSEYANKKTRGAFVAAVFAMQGFGILAAGAVAIGVSALFRSPFPAPPYDVDPAASTPAEADLVWRIILMFGAVPAALTFYSRMNMPETARYTALVARNAERAAADMSRVLQVDIGNKEEGPETQPRCRGEPQEEATTVPPPPPPFGLFSREFFHRHGLHLLGTTSTWLLLDIAYYSQNLFQKDLFSAVGWIPAAETMSALDELFHIARAQTLIALCGTVPGYWFTVAFIDVVGRFAIQAVGFLMMAAFMLGLAVPYDRWTRPGNQTGFVVMYALTFFFANFGPNATTFIVPAEIYPARFRATCHGISAASGKVGAIIGSFGFLYLAQSQDPAKTAHGYPPGIGVRNSLLLLAGCSFLGFLLTFLVPEPKGKSLEELSRETEPGAAEP

SEQ ID NO: 1470 - DNA, 2148 bp, Medicago truncatula
  CDS (73)..(1674)
actccttataccactttacttctttatcaacttggtttcttgcaaggagggaactaggtaacaaattcagtcatgtctggagaattaggagttctaaatgcactagatgtggcaaagacacaattgtaccatttcactacaattgtgatagctggaatgggtttcttcactgatgcttatgatcttttctgcatttctcttgttacaaagttgttagggagaatatattacactgaaccaaatccaacaagaccaggaacacttccaccaagtgttcaatcagctgtaactggtgttgcacttgttggaacactagcaggccaattattctttggttggcttggggacaaaatgggaagaaaaaaagtatatggtttgactcttattctcatggttgtttgttctgttgcttcaggactctcttttggctcaagtccaaagagtgttatggcaacactttgtttctttaggttttggcttggttttggtattggtggtgattaccctctttcagctacaatcatgtctgaatatgctaacaaaaaaactagaggtgcatttattgctgctgtttttgccatgcaaggttttggtatcttaggtggtggaattgttgctttgattgtggtttctatatttgatcacaaatataaggttcctacctttgaagaaaatccagctgcatcattgttagtgcctcaatttgattatgtttggagacttattcttatgttcggtgctcttccagctgcattgacgtactactggcgaatgaaaatgccagaaacagctcgttacacggctcttgttgctaagaacgcgaaacaagctgctgcggatatgtctaaggtattgcaagttgaacttgaagttgaagaagagaaggtacaaaaaatgactagtgataaaaggaatagttatggcttgttcagcaagcaattcgcaaaacgacatggttgggctttgtttggaacatgtagtacttggtttttgttggatattgctttctatagtcagaatcttttccaaaaggacatttttagcgcaatcggatggatccctccggcaaaagaaatgaatgcaattcatgaggtttacaagattgcaagagcacaaacacttattgcgttgtgcagtactgttccgggctactggttcacagtcgcatttatcgatcacatgggtcgtttcgctattcaaatgatgggattcttcttcatgactgttttcatgtttgctcttgccataccatatgatcattggagcaaggaagagaatagaattgggtttgttgtaatgtactcactaacattcttctttgctaattttggtccaaatgctacaacatttgttgtaccggcagagatttttccggctaggttaaggtctacctgtcatggaatatcagctgctgcaggaaaggcaggagcaattgttggtgcatttggattcttgtatgctgcacaaagtaaagatcctaccaagaccgataaagggtacccaaccggtattgggattaagaactctcttatcatgcttggtgtgatcaactttgttgggatgttatgcactttacttgtcccggaatcaaagggaaaatcattggaagagttgagtggagagaatgaaggagaaagtgttgaggacactcggcaagaaggatcgggggtttaaactgtgctcacagtcatgaatacagttccaggcgttgccggtgggactgtgggcattgcaacgtgatttaagtttatattttctccagatattaataatgtccgtgacatatttaaaaaccttgttccttttatttttccatccacatttcgtctcttcctgttgctgccccatgcgatcatcgttgtgtgatgtggcctgcaattggaaaccatgaacaagatatgctaggatagtttatgtttgattcaacaaagggatgtgtattatattgtttgaagatttcaaaactagttattggttgtttgtattgtattcacaataatgatatagttctttgcttcttggtgtaagaacaaatcctatgtaaagtgtttgcctttggttgtatctaatctactcttgtataattgattttagcctttgtttaagattgtggtaacatgtcttaaacacaagtcttaattttttatg

SEQ ID NO: 1471 - protein, 533 aa, Medicago truncatula
MSGELGVLNALDVAKTQLYHFTTIVIAGMGFFTDAYDLFCISLVTKLLGRIYYTEPNPTRPGTLPPSVQSAVTGVALVGTLAGQLFFGWLGDKMGRKKVYGLTLILMVVCSVASGLSFGSSPKSVMATLCFFRFWLGFGIGGDYPLSATIMSEYANKKTRGAFIAAVFAMQGFGILGGGIVALIVVSIFDHKYKVPTFEENPAASLLVPQFDYVWRLILMFGALPAALTYYWRMKMPETARYTALVAKNAKQAAADMSKVLQVELEVEEEKVQKMTSDKRNSYGLFSKQFAKRHGWALFGTCSTWFLLDIAFYSQNLFQKDIFSAIGWIPPAKEMNAIHEVYKIARAQTLIALCSTVPGYWFTVAFIDHMGRFAIQMMGFFFMTVFMFALAIPYDHWSKEENRIGFVVMYSLTFFFANFGPNATTFVVPAEIFPARLRSTCHGISAAAGKAGAIVGAFGFLYAAQSKDPTKTDKGYPTGIGIKNSLIMLGVINFVGMLCTLLVPESKGKSLEELSGENEGESVEDTRQEGSGV

SEQ ID NO: 1472 - DNA, 1614 bp, Medicago truncatula
  CDS (1)..(1614)
atgtctggagaattaggagtgcttaatgcactcgatgtcgcaaagacgcaattgtaccatttcactacaattgtgatagctggaatgggattcttcactgatgcatatgatcttttctgcatttcccttgtcacaaagttgttagggagaatatattacactgaaccaaatccaacaagaccaggaacacttccaccaagtgctcaatcagctgtaactggtgttgcacttgttggaacactagcaggccaattattctttggttggcttggcgacaaacttggtaggaaaaaagtctatggtttaacacttattctcatggtggtttgttcagttgcttcaggactctcttttggatcaagtccaaagagtgttatggcaacactttgtttctttaggttttggcttggttttggtattggtggtgattaccctctttcagctacaatcatgtctgaatatgctaacaaaaaaactagaggtgcatttattgctgctgtttttgccatgcaaggttttggtatcttaggtggtggaattgttgctttgattgtggcttctatatttgatcacaaatataaggttcctacctttgaagaaaatccagctgcatcactgttagtgcctcaatttgattatgtttggagacttattcttatgttcggcgctcttcctgctgcattgacgtactactggcgaatgaaaatgccagaaacagcccgttacaccgctcttgttgctaagaacgcgaaacaagctgccgcggatatgtctaaggtattgcaagttgaacttgaagttgaagaggagaaggtacaaaaaatgactagtgataaaaggaatagttatggcttgttcagcaagcaattcgcagcacgacacggtttggctttgtttggaacatgtagtacatggtttttgttggatattgctttctatagtcagaatcttttccaaaaggacatttttagcgcaattggatggatacctccggcaaaagaaatgaatgcaattcatgaggtttacaagattgcaagagcacaaacacttattgcgttgtgcagtactgttccgggttactggttcacggtagcatttatcgatcacatgggtcgtttcgctattcaaatgatgggattcttcttcatgactgttttcatgtttgcacttgccataccatatgatcattggagcaaggaagagaatagaattgggtttgttgtaatgtactcactcacattcttctttgctaattttggtccaaatgctacgacatttgttgtaccggcagagatttttccggctaggctaaggtctacctgtcatggaatctcagctgctgcaggaaaggcaggagcaattgttggtgcatttggattcttgtatgctgcacaaagtaaagatcctaccaagaccgataaagggtatccaaccggtattgggattaagaactctcttatcatgcttggtgtgatcaactttgttgggatgttatgcacattacttgttccggaatcaaagggaaaatcgttggaagagttgagtggagagaacgagggagaaggtgccgaggccactgaacaagaaggaccgcggtttgaaaatgtagcttga

SEQ ID NO: 1473 - protein, 537 aa, Medicago truncatula
MSGELGVLNALDVAKTQLYHFTTIVIAGMGFFTDAYDLFCISLVTKLLGRIYYTEPNPTRPGTLPPSAQSAVTGVALVGTLAGQLFFGWLGDKLGRKKVYGLTLILMVVCSVASGLSFGSSPKSVMATLCFFRFWLGFGIGGDYPLSATIMSEYANKKTRGAFIAAVFAMQGFGILGGGIVALIVASIFDHKYKVPTFEENPAASLLVPQFDYVWRLILMFGALPAALTYYWRMKMPETARYTALVAKNAKQAAADMSKVLQVELEVEEEKVQKMTSDKRNSYGLFSKQFAARHGLALFGTCSTWFLLDIAFYSQNLFQKDIFSAIGWIPPAKEMNAIHEVYKIARAQTLIALCSTVPGYWFTVAFIDHMGRFAIQMMGFFFMTVFMFALAIPYDHWSKEENRIGFVVMYSLTFFFANFGPNATTFVVPAEIFPARLRSTCHGISAAAGKAGAIVGAFGFLYAAQSKDPTKTDKGYPTGIGIKNSLIMLGVINFVGMLCTLLVPESKGKSLEELSGENEGEGAEATEQEGPRFENVA

SEQ ID NO: 1474 - DNA, 1907 bp, Lotus japonicus
  CDS (93)..(1712)
tcttcccgtttttctctgcaccctacatttctgcacaaaattgtagggaattcaagcagatagaaacagaaggaaatttgtaatttggcatcatggccaaggaacaaattcaggtgctaaatgcgcttgatgtggcgaaaacacaatggtaccatttcactgcaattgtaattgctggaatgggcttcttcactgatgcatatgatctattctgcatatcccttgtcaccaagttgctcggtcgcatttactaccacgttgatggcgctgcgaagcccggaacattgcctccaaatgtatcagctgctgtaaatggagtagctttctgcggtacactttcaggacagcttttctttggctggcttggtgacaaattgggcagaaaaaaagtctatggcatgaccctcatgatgatggtcatatgctctattggttccggcctttcgttcggacatagtccaaaatctgtgatggcaacactttgcttcttcaggttctggcttggttttggaattggtggagactaccccctttctgctaccattatgtctgagtattcgaataagaagactcgcggcgccttcatcgctgcggtctttgctatgcagggttttggaattcttggaggtggtatatttgcaatcataatttctgctgcattcaaggccaagtttgatgctccgccttatgaggttgatccggttggttcaactgttcctcaagctgactatatttggaggataattgtgatggttggagcactcccagctgcattgacttactactggaggatgaagatgccggaaaccgctcgctatactgctctagttgccaagaacacagaacaggctgcaaaggatatgtctaaggttctgcaggttgagattcaagctgagccaaaaggtgaccaagcacaggccaatacatttgccttgttctcaaaggagttcatgcgccgccacggattgcatcttctcggcacagcaagcacatggttcttgcttgatattgcattttacagccaaaatctcttccaaaaagacatcttcagtgcaattggttggattcctcctgcaaaaaccatgaatgctcttgaggaagtttacagaattgcaagagctcagacgcttatcgctctctgcagtactgtccctggctactggtttacagtggctctcatagacaggattggaagatttgctattcaattgatggggttcttcttcatgactgtttttatgttcgctcttgccattccttatgaccactggactcataaggagaacagaataggattcgtggtgatatattccttgactttcttcttcgcgaatttcgggcctaatgccaccacattcgtcgtgccggccgagattttcccggctagattccggtccacttgccacggaatttcatcagcggccgggaagctcggggctatagtcggagcattcgggttcttgtacctggcacagaacaaggacaagagcaaagcagatgcagggtaccctgcaggtattggtgtgaagaactcactgcttttgttaggtgtggtcaacattttaggcttcttttgtactttcttggtgcctgaggcaaagggaaaatctttggaggaaatgtcaggtgagaatgaagaggaaggtgaaaatggaaccaaagaagagtcagagccacattcttacagcaccagaacagttccatatgtttaggttatgtttaactaactgtagtattgttattgcaataaagcactacctcaagggaaaagcacaaaagctttctcttcccctctccactagttctgttaatttttttacccggataatatcatgttagagtaactgaggagctgtttgttgaactacgagtgttgggaattattaatgttatgtaaccattattcc

SEQ ID NO: 1475 - protein, 539 aa, Lotus japonicus
MAKEQIQVLNALDVAKTQWYHFTAIVIAGMGFFTDAYDLFCISLVTKLLGRIYYHVDGAAKPGTLPPNVSAAVNGVAFCGTLSGQLFFGWLGDKLGRKKVYGMTLMMMVICSIGSGLSFGHSPKSVMATLCFFRFWLGFGIGGDYPLSATIMSEYSNKKTRGAFIAAVFAMQGFGILGGGIFAIIISAAFKAKFDAPPYEVDPVGSTVPQADYIWRIIVMVGALPAALTYYWRMKMPETARYTALVAKNTEQAAKDMSKVLQVEIQAEPKGDQAQANTFALFSKEFMRRHGLHLLGTASTWFLLDIAFYSQNLFQKDIFSAIGWIPPAKTMNALEEVYRIARAQTLIALCSTVPGYWFTVALIDRIGRFAIQLMGFFFMTVFMFALAIPYDHWTHKENRIGFVVIYSLTFFFANFGPNATTFVVPAEIFPARFRSTCHGISSAAGKLGAIVGAFGFLYLAQNKDKSKADAGYPAGIGVKNSLLLLGVVNILGFFCTFLVPEAKGKSLEEMSGENEEEGENGTKEESEPHSYSTRTVPYV

SEQ ID NO: 1476 - DNA, 1966 bp, Lotus japonicus
  CDS (134)..(1750)
ttcagcttctctctcctccatggtcctgacagggtgctggcaacttctccctttctctctctagaagagccagtgagcaggaaggtaaacttgtaataactgatttgaggcaatttagatagcagagttagtgatggcgagagagggaacaataggagtgcttaatgcacttgatgtggccaagacacaatggtaccacttcactgcaattgtgattgctggaatgggatttttcactgatgcatatgatctcttttgcatttcccttgtcaccaagttactggggaggatatactacactgacataaccaaatcaaggcctggtgttcttccagctaatgtgcaagccgctgtgactggtgtcgcgctttgcggtaccttagccggccagcttttcttcggttggctcggtgacaagatgggaaggaaaagggtttatggcttaactctcatgatcatggtagtgagctccattgcttcagggctctcctttggtaatagcccaaaaagcgtcatggccacgctttgtttcttcaggttctggcttggtttcgggattggtggcgactaccctctttcggccacaatcatgtccgaatacgcgaacaaaaagacgcgaggcgcgttcattgctgcggtgtttgctatgcaagggttcggaatcttgggtggtggaatagtggctttgatcgtctcggcctcgtttgaccacaaatacaatgttcctagttatcaagaagacccggcagcatcaatggtgttgccggcttttgactatgtttggcgtatcattctcatgtttggtgcgctcccagcggccctgacctactactggcgtatgaaaatgcctgagacagctcgttacacagccttggttgccaagaatgcgaaacaagctgcctcagacatgtccaaggtgctgcaagttgaacttgaagccgaagaggaaaaggtggagaaaattcttgagagtgaaaaccaacaatttggcttgttcagcaagcaattcgcctcgcgccacgggatgcacttgctaggaaccacaactacttggttcttgttggacattgccttctacagccagaacctcttccaaaaggacattttcagcgcgatcggatggatccctccagcaaaagaaatgaatgcaatccatgaggtttacaagattgcaagagcacaaacacttatagcactatgcagtacagttcccggttactggtttaccgtggcctttatcgattacatgggccgtttcgcgatccaattgatgggattcttcttcatgacggtcttcatgtttgctctggccttaccttatgatcactggactaagaaagataaccgatttgggttcgtcgccatgtacgccctcacgttcttcttcgcgaatttcggtccaaacgccaccacatttgtggtgccggccgagattttccctgcaaggctgaggtccacttgtcatggaatctcagctgctgcaggaaaagcaggagcaatagtaggtgcatttgggttcttgtatgcttctcagagtaaagatcctgctaagactgatccaggttacccaactggtattggggtgaggaactctctcattatgcttggtgtgatcaatttcttggggatggtattcacctttttggtgccggaatcaaaggggaagtcactggaagagttgagtggggagacagaagaagatggcgttgaggctattgaggctgcagggtctaggacagttccagtttaatcaaagtcttgtgcaacatagtaaattaaaattccaagttatgattgtttttgttatgtgaaaatttactttcagttttcctacagcaagatgcataataatgtagatatttgttttacagtgttataagtctataacttgtaatcagttacatagtgttttgtattccattgttgttctttatcaagtttggcaataaataatttatctgtagtc

SEQ ID NO: 1477 - protein, 538 aa, Lotus japonicus
MAREGTIGVLNALDVAKTQWYHFTAIVIAGMGFFTDAYDLFCISLVTKLLGRIYYTDITKSRPGVLPANVQAAVTGVALCGTLAGQLFFGWLGDKMGRKRVYGLTLMIMVVSSIASGLSFGNSPKSVMATLCFFRFWLGFGIGGDYPLSATIMSEYANKKTRGAFIAAVFAMQGFGILGGGIVALIVSASFDHKYNVPSYQEDPAASMVLPAFDYVWRIILMFGALPAALTYYWRMKMPETARYTALVAKNAKQAASDMSKVLQVELEAEEEKVEKILESENQQFGLFSKQFASRHGMHLLGTTTTWFLLDIAFYSQNLFQKDIFSAIGWIPPAKEMNAIHEVYKIARAQTLIALCSTVPGYWFTVAFIDYMGRFAIQLMGFFFMTVFMFALALPYDHWTKKDNRFGFVAMYALTFFFANFGPNATTFVVPAEIFPARLRSTCHGISAAAGKAGAIVGAFGFLYASQSKDPAKTDPGYPTGIGVRNSLIMLGVINFLGMVFTFLVPESKGKSLEELSGETEEDGVEAIEAAGSRTVPV

SEQ ID NO: 1478 - DNA, 2041 bp, Lotus japonicus
  CDS (70)..(1704)
cttgaataggctttggagcaagttaccctaagaacagtttattagcttctgcttattacaaatctagctatggctcgtggtgaattgggagtgcttactgcccttgatactgccaagacacaatggtatcacttcactgccatcatcatcactggtatgggattcttcacagatgcatacgacctgttcagcataccaaacgttaccaagttgcttggccgaatatactacacaaaagaaggttcaccaaagccgggaaccttgcctgcaaatgtttcagttgcagttaacggtgttgcgctctgtggcacactagcaggccaacttttcttcggttggctaggagataaaatgggtaggaaaaaggtttatggcctaactcttgccatcatggtcgtctcttctcttgcctctggcctctcctttgggcacaccccaaagggtgtgatttccaccctttgtttcttcaggttctggcttggttttggcattggtggtgactaccctctctcagccaccatcatgtcagaatatgcaaacaaaaagactcgcggcgcattcatagcctcagtgtttgctatgcaaggctttggaatcttggctggcgggattgtttccctcatagtttccgcagcattcgatcacgcattcaaggctccgccatacaaggatgaccctgcagcatcccttgtccccgaagccgactacgtctggcgcatcatcctcatgttcggcgccgcccctgcagctctcacctactactggcgcatgaaaatgcccgagacagcaaggtacacagcactcgtcgcgaaaaacgcgaaactcgcagcgcaggacatgtcaaaggtgctgcaaatggaggttgaagctgagcaggaaaagacggacaagatagccgagcccgaaacgcaacaaaacaacaagaacagcttcggcttgttcagcaaggaatttgctcgaacacatggcgtgcacttgctcggaaccacttcaacatggtttctcctagacattgcatactacagctcaaacctcttccaaaaagacatctacagcagcattgggtggctccctcacgcggaggaaatgaacgcgattcaggaggtttacaaggttgcaagagcatcaacactgatagcactctgtggcactgtaccagggtactggttcacagtggcattcatagaccatctgggtcgtttcatcatacagcttatggggttcttcttcatgacagtgttcatgttcgcactcgcaattccttacaatcactggacacagaaggaacacagaattgggtttcttgtgatgtacgcattcacgttcttcttcgcgaattttggtccaaactcgaccacttttgttgtgcctgcagagattttccctgcgaggttgagaactacatgccatgggatatcctctgctgcagggaaagctggagcgattgtgggtgcgtttgggttcttgtatgcttcacaggacaaggatgaagcaaagagagatgcagggtaccctgctggtattggcatgaagaacactcttattgtgcttgctgtgacgaattgtcttggcatggtttgcacgttcatggtgccagaatctacagggaaatcgttggaggagttgagtggtgagaatgaagaagatgaaggtgatgagagtgttgagacacaaggttcctctagtaggactgttccggtgtgaaaggtgatcttgtaagacaggtgtcctctttcggagaccatcttgttcgagtcgggaacatctacattatggtggagctaactctcatagtggagtttttttccatccacaagactcgaactcgagatcttgcttaaggggaatcaagtagttaattatagcggttggtagatagttaagctccttaagtatttaatttaaaatttgatctctgacgtgtgtatgagaaagatttattaggagagacacacagaaatagtctcatggttgtgggctttgggataaataatttgatatgctttttaaatgaaatatctacacttagttagtgtgtgtt

SEQ ID NO: 1479 - protein, 544 aa, Lotus japonicus
MARGELGVLTALDTAKTQWYHFTAIIITGMGFFTDAYDLFSIPNVTKLLGRIYYTKEGSPKPGTLPANVSVAVNGVALCGTLAGQLFFGWLGDKMGRKKVYGLTLAIMVVSSLASGLSFGHTPKGVISTLCFFRFWLGFGIGGDYPLSATIMSEYANKKTRGAFIASVFAMQGFGILAGGIVSLIVSAAFDHAFKAPPYKDDPAASLVPEADYVWRIILMFGAAPAALTYYWRMKMPETARYTALVAKNAKLAAQDMSKVLQMEVEAEQEKTDKIAEPETQQNNKNSFGLFSKEFARTHGVHLLGTTSTWFLLDIAYYSSNLFQKDIYSSIGWLPHAEEMNAIQEVYKVARASTLIALCGTVPGYWFTVAFIDHLGRFIIQLMGFFFMTVFMFALAIPYNHWTQKEHRIGFLVMYAFTFFFANFGPNSTTFVVPAEIFPARLRTTCHGISSAAGKAGAIVGAFGFLYASQDKDEAKRDAGYPAGIGMKNTLIVLAVTNCLGMVCTFMVPESTGKSLEELSGENEEDEGDESVETQGSSSRTVPV

SEQ ID NO: 1480 - DNA, 1857 bp, Cryptomeria japonica
  CDS (66)..(1700)
aagaggagacaggtatcctctggtcaaggaaataagagctgagggagagttgtgagatctaaaccatggcgaagacgcagcttgaagttttgaatgccttggatcttgcgaaaacgcaatggtaccatttcacggcaatcattattgcaggtatgggcttctttacagatgcgtatgaccttttctgcatttccacagtgacgaagctcctgggaagaatctattattttgaagacggtaagaagcccggctctctgcctcccaatgtctcggccgccgttaatggagtggctctgtgcggaaccctagctggacaactcttcttcggctggctcggggacaaaatggggcggaagaaagtgtacggaatgacgctgatgctcatggtgatctgctccatagcttcaggcctttcctttggccacacggccaaatctgtgatgacaacgctctgcttctttcgattctggctagggttcggcattggcggcgattatcctctttcggccacgattatgtccgagtacgccaacaagagaactcgtggcgcgtttattgcagctgtgttcgccatgcaagggtttggaattcttgcaggcggtgccgtttccattatagtttcagcagggttcaagagtcattttaaggctccagcgtatcaagatgatcccaagggctcgactgtggatgaggcagactttgtgtggaggttaattctgatgttcggagccgtccccgcggccatgacctactactggcgaatgaaaatgccagagaccgcccgttacacagcgcttgtggaaagaaacgcaaagcaagccgcggcggacatgtctagggttatgcaggtagatattgaagaagatcgtcaaaagatcgatgaaattgcgaccagggaaccgagctttggcttattttctgcacagttcgcaaaacggcatggactgcatcttctgggaacaacttcaacctggttattgcttgatgtcgcctattacagtcaaaacctgtttcaaaaggatatctttacggccatcggatggatccctgcgggtaaaaaaatgaacgccattgaagaagtttatcgcatcgcaaaggcacagacgctcattgctctgtgctccaccgttccgggctactggttcacagtcttctttatcgatcgcatcggtcggttcaccattcaattgatgggattctttttcatgacagtctttatgtttgccctggccattccttacaaccattggcgaggcaccaaatgtggcgatgactattgtgacggcaaccacattgcctttgttgttctctactccttcaccttcttcttcgctaattttggtcccaacgccaccactttcatcgtcccggcggaggtttttcctgccaggctccgttccacttgccacggcatttcggccgctgcaggaaaggcaggcgccattgttggagctttcggttttctgtacgccgctcaaagcacgcaccaatctgaagtcgaccatggctaccacaagggtattggcgtcaagaattctctcattcttctcggagtaacaaatgctatgggctttctgttcacgtttctggtgcctgaaaccaacggcaaatctttggaagagctttccggtgagaatgaggaagatgaagggactgaacttccaccatctgtttcgactaccagaacggcaccagcttagtagaaggtcaaaagctgcgggtaaaatagggaataatgaaaaaaagtattatttacaggtccaaaaacaattattcttcactgttttagtaaatattatagtgtaaggcttggttaattttatattatagaggaagactcttttttttggtgattgc

SEQ ID NO: 1481 - protein, 544 aa, Cryptomeria japonica
MAKTQLEVLNALDLAKTQWYHFTAIIIAGMGFFTDAYDLFCISTVTKLLGRIYYFEDGKKPGSLPPNVSAAVNGVALCGTLAGQLFFGWLGDKMGRKKVYGMTLMLMVICSIASGLSFGHTAKSVMTTLCFFRFWLGFGIGGDYPLSATIMSEYANKRTRGAFIAAVFAMQGFGILAGGAVSIIVSAGFKSHFKAPAYQDDPKGSTVDEADFVWRLILMFGAVPAAMTYYWRMKMPETARYTALVERNAKQAAADMSRVMQVDIEEDRQKIDEIATREPSFGLFSAQFAKRHGLHLLGTTSTWLLLDVAYYSQNLFQKDIFTAIGWIPAGKKMNAIEEVYRIAKAQTLIALCSTVPGYWFTVFFIDRIGRFTIQLMGFFFMTVFMFALAIPYNHWRGTKCGDDYCDGNHIAFVVLYSFTFFFANFGPNATTFIVPAEVFPARLRSTCHGISAAAGKAGAIVGAFGFLYAAQSTHQSEVDHGYHKGIGVKNSLILLGVTNAMGFLFTFLVPETNGKSLEELSGENEEDEGTELPPSVSTTRTAPA

SEQ ID NO: 1482 - DNA, 1611 bp, Egeria densa
  CDS (1)..(1611)
atggcgagagaccagctcgaggtgctcaacgcgctcgacgtcgcgaagactcagctgtaccacttcacggcgatcgtcatcgccggcatgggcttcttcacggacgcctacgacctcttctgcatctccctggtcaccaagctgctcggccgcatctactactacgtcccggggtcccccacccccggcacgctcccacccaacgtctccgccgccgtcaacggcgtcgccttctgcggcaccctctccggccagctcttcttcggatggctgggcgacaagctcggacgcaagaaggtctacggcatgaccttgatgatgatggtgatatgctccgtcgcgtcggggctctccttcgggcactcagcgaagagcactatggcgaccctgtgcttcttccgcttctggctcgggttcggaatcggcggcgactaccccctctcggcgaccatcatgtcggagtacgcgaacaagcgcacgaggggggccttcatcgcggcggtcttcgccatgcagggcttcggcatcttgggcggcggcatcgtcacgctcatcgtctcgtcggtcttcaagaccaagtacgacgtgccggcttacgctgacgaccccctgggatccaccgtcccgcaggcggactacgtgtggcggacgatattcatgttcggggcggtgccggcggcgcttacctactactggcggacgaagatgccggagacggcgaggtacaccgcgctggtggccaagaacgcaaagcaggccgctgccgatatgtccaaggtcctccaggtggagatcgcggaggagcaggcgaaggtggaggccattactgccaaggactccaacagcttcgggctcttctcgaaggagttcgcccgccgccacggcctccacctcctgggcaccaccaccacgtggttcttgctggatatcgccttctacagccagaacctcttccagaaggacatcttcagcggcatcgggtggatcccgaagccggcgaccatgaacgcgatcgaggaggtctaccgcattgctcgcgcccagaccctgatcgcgctctgcggcacggtccccgggtactggttaacggtgggcctcatcgacatcatcggccgcttcaccatacaggtgatcggcttcttcttcatgacggtgttcatgctggggctggccatcccctaccaccactggaccatgagggagaaccgcatcggtttcgtcgtcatgtacggcctcaccttcttcttcgccaacttcggacccaactgcaccaccttcgtcgtgccggcggagatcttcccggcgcggctgcgctccacgtgccacgggatctccgccgcggcggggaaggccggggccatcatcggctccttcgggttcctctacgcggcgcagccaacggacaagaggctggcggacaggggttacccggcgggcatcgggatcaagaactcgctctacgtgctggcggcgtgcaacctgttgggcctgctcttcaccttcctggtgcctgagtccaaggggaagtcgctggaggagatgtcgggggagaacgccgacgaggcggagcagacccgcggcagcgtcgcggcggtcgagctcgaaccgtag

SEQ ID NO: 1483 - protein, 536 aa, Egeria densa
MARDQLEVLNALDVAKTQLYHFTAIVIAGMGFFTDAYDLFCISLVTKLLGRIYYYVPGSPTPGTLPPNVSAAVNGVAFCGTLSGQLFFGWLGDKLGRKKVYGMTLMMMVICSVASGLSFGHSAKSTMATLCFFRFWLGFGIGGDYPLSATIMSEYANKRTRGAFIAAVFAMQGFGILGGGIVTLIVSSVFKTKYDVPAYADDPLGSTVPQADYVWRTIFMFGAVPAALTYYWRTKMPETARYTALVAKNAKQAAADMSKVLQVEIAEEQAKVEAITAKDSNSFGLFSKEFARRHGLHLLGTTTTWFLLDIAFYSQNLFQKDIFSGIGWIPKPATMNAIEEVYRIARAQTLIALCGTVPGYWLTVGLIDIIGRFTIQVIGFFFMTVFMLGLAIPYHHWTMRENRIGFVVMYGLTFFFANFGPNCTTFVVPAEIFPARLRSTCHGISAAAGKAGAIIGSFGFLYAAQPTDKRLADRGYPAGIGIKNSLYVLAACNLLGLLFTFLVPESKGKSLEEMSGENADEAEQTRGSVAAVELEP

SEQ ID NO: 1484 - DNA, 1938 bp, Aspergillus oryzae
  CDS (1)..(1938)
atgtcagcctcagccccttatgatcatggcgctgatatattgtttggagttccccgtatccagtcagggcacctttgctatgtgcacaattcaacctttgcgaggacattattctgcgaccctcaagtatctttccaagctttcacaaccttcattaagacgatacctccagcacaacggcgaaactttatcatcagccagttagagagtgccagacgcagggaatggctctgggtggtagtggtcgccggggttggcttttttgctgacgcatactgtatcttctccgtaaacatggtcgtccctatgatcagcgaagtctattggggtagcttggatgccaagcctgaccgcgttcacaactatgaagtcggtcttagcattatcaccttagcaggtgcgctcgtaggccaggttctttttggtatcgccgcggatatctggggtcgccgaaagatgtatggattagagttggttgttctgatcttcagcactcttgggatgtccatggcctcctccggtaagtttgactctatgtcaattatcggcgttcttctgttctggcggttctttatgggcttgggagttggagccgactaccctctatctgctattatttgctccgaacttgcacctactcgcataagaggtcgtatgttggcggctgtcttcctctgtcagtcactcggagaggctgcggcggctgtcgttgctctcatcgctgtggcaggctttcgacatagtctgcctaatgatccagaaattcgagagtgcacaggatcctgtgttcaaaatttagacagcatatggaggttaatagtaggtctgggtgcggtacctgcctttattgccatctggtttcgattgacgatcatcgaatcaccccgttatacaacggatgtcttgcagaacagccttcaagctgccgcagatgtgtctcagttctatcagtcagcagagatttcctcggcttcgagtctaggccatgagtcgctccatccagtcggagagacgatatcactgtctcccacccaaactcgtgaatatggctttatgccatccgtcatctctcgtcaaccaagttctgtggaattggagaatgcctcaagccctccacttcacttctggagagatttgagaagttttctgaaacagaagcgcaacctccgaacgctagtggcaacatccttatgctggttttgtctcgatctgccgttctacggattgggattgatgaatgtggatattataaataccatttggtatggtaaccatattccgtctgccggagtgtatgagtcgcttctccgggtctcttaccagagtatcgtggtcgtatcatctggcgctatcgtcggtagctgcatagcggtgctaacaatcgaccgaatcgggcgccggaatctgcagctgctcggcttctgtttacttttcattctcaacgtgattattggtgcttcattcagatatttgagcacacacggcgactcatcggctttggttgtactttatgttctgactcagatatttttcaactttggaccgaacaccacaacatacattgtccctgccgagctcttcccaacccgctttcgcgccacttgccatggcatctcagctgcctccggaaaactaggttccattcttgcacaatgcttcttgggatatgttgacttcggcaatggtgcaacctggcgaaatgtgccagattggctaggatatgcacttctatgcctatcattcttcatgctcatgggtcttattgctaccttatggatccctgagactagggataaggaggggaacaataagtccctcgagcgtatcaccgaggatatgcaggcaaaagatgtaccttctgtggatgaggaagataatggcagcattcacacccaggctactacgtctctgcctgggccggattggagatcggactga

SEQ ID NO: 1485 - protein, 645 aa, Aspergillus oryzae
MSASAPYDHGADILFGVPRIQSGHLCYVHNSTFARTLFCDPQVSFQAFTTFIKTIPPAQRRNFIISQLESARRREWLWVVVVAGVGFFADAYCIFSVNMVVPMISEVYWGSLDAKPDRVHNYEVGLSIITLAGALVGQVLFGIAADIWGRRKMYGLELVVLIFSTLGMSMASSGKFDSMSIIGVLLFWRFFMGLGVGADYPLSAIICSELAPTRIRGRMLAAVFLCQSLGEAAAAVVALIAVAGFRHSLPNDPEIRECTGSCVQNLDSIWRLIVGLGAVPAFIAIWFRLTIIESPRYTTDVLQNSLQAAADVSQFYQSAEISSASSLGHESLHPVGETISLSPTQTREYGFMPSVISRQPSSVELENASSPPLHFWRDLRSFLKQKRNLRTLVATSLCWFCLDLPFYGLGLMNVDIINTIWYGNHIPSAGVYESLLRVSYQSIVVVSSGAIVGSCIAVLTIDRIGRRNLQLLGFCLLFILNVIIGASFRYLSTHGDSSALVVLYVLTQIFFNFGPNTTTYIVPAELFPTRFRATCHGISAASGKLGSILAQCFLGYVDFGNGATWRNVPDWLGYALLCLSFFMLMGLIATLWIPETRDKEGNNKSLERITEDMQAKDVPSVDEEDNGSIHTQATTSLPGPDWRSD

SEQ ID NO: 1486 - DNA, 1856 bp, Solanum tuberosum
  CDS (139)..(1722)
aattcgccggccgcaattcggcacgagcaattcgcggccgcaattcggcacgagcaaaaattaagtgcacaatcttctaaagaaaaggaagaagaagataattttgcacttttggaacaagaagcaattttaggcattatggctgtggaggataataatctacaagtgcttaatgcacttgatttggccaaaactcaactttaccattttacagcaattattattgctggaatgggattttttactgatgcttatgatctctttagtatttctcttgtcactaaattgcttggccgtttatactacaccaaaccggatcttttgaaacccggaacactccctccggctcgcgtcggcctccgtcacgggtgtgcccttgttggcaccctagccggccagctgttcttcggctgtgctaggctagctaaaatgggacgaaaaaaggtctatggtatgactttggttctcatggttgtgtgttccgttgcttcggggctctccttaggtaatacccctaaggtggttatgaccacactatgtttttttaggttttggcttggatttggcattggtggcgattaccctttatccgccacgatcatgtctgaatacgctaacaaaaagacacgtggtgcattcatagctgcggttttcgctatgcaagggtttggaattttgttcagtgggatagttgcacttatcacagcagcaggattcgatcacgcgtataaggcccccactttcgcggaaaatgctgctgtatccactgtgccacaagctgattacatttggcgtataattctcatgtttggatcgttgccagctgccctcacttactattggcgcatgaaaatgcccgaaacagctcgttacacggctctagtcgcgaaagacgcgaaaagagcagcgcaggacatggggagggtactacaagttgaaattgaaagcgaggaagcaaaaatcgaacaaatttctagggatgaaactaatcaattcggtctgttttcatgggaattcgttagacgccatggattgcacctattcggaacgtgttccacatggtttttattagatattgctttctacagtcagaatttgttccagaaagacgtgttctccgctgttggatggatccctaaagccccaacaatgaatgctgttcaggaactatacaaaattgccagagcgcaaacattaattgcgctctgtagcacggtgccagggtactggttcaccgtggcgtttattgacattattggaaggttcgcgatccaattgatgggattcttcttcatgactgtgtttatgtttgcgattgccatcccttaccatcattggacattggaggccaaccgtattggattcatcgtaatgtactcccttacatttttcttcgcgaattttgggcctaacgcgactacatttgtggtcccagctgagattttcccagccaggcttcggtcaacatgtcatgggatttcagcagctgcaggtaaggctggggctatagtgggagcgtatgggttcctatacgctgcccaaagtaaagatccaatgaaaacagatgcaggatacccagcgggtattggaataaagaactcacttattgttctagggtttatcaatgctctaggaatggtatgtacattttgtgtgccagagtcaaaaggaaaatctctagaggaagcatcacaagaaactatatctactggagaagcatgaggtgatcaattgcttggaaaaatcacttgtatttttttttcctttctttttatcttttgttggtttaatttcatttttctttgtattgtgtaagcttgtttgttgttatttttaattatcttttttttgtgacc

SEQ ID NO: 1487 - protein, 527 aa, Solanum tuberosum
MAVEDNNLQVLNALDLAKTQLYHFTAIIIAGMGFFTDAYDLFSISLVTKLLGRLYYTKPDLLKPGTLPPARVGLRHGCALVGTLAGQLFFGCARLAKMGRKKVYGMTLVLMVVCSVASGLSLGNTPKVVMTTLCFFRFWLGFGIGGDYPLSATIMSEYANKKTRGAFIAAVFAMQGFGILFSGIVALITAAGFDHAYKAPTFAENAAVSTVPQADYIWRIILMFGSLPAALTYYWRMKMPETARYTALVAKDAKRAAQDMGRVLQVEIESEEAKIEQISRDETNQFGLFSWEFVRRHGLHLFGTCSTWFLLDIAFYSQNLFQKDVFSAVGWIPKAPTMNAVQELYKIARAQTLIALCSTVPGYWFTVAFIDIIGRFAIQLMGFFFMTVFMFAIAIPYHHWTLEANRIGFIVMYSLTFFFANFGPNATTFVVPAEIFPARLRSTCHGISAAAGKAGAIVGAYGFLYAAQSKDPMKTDAGYPAGIGIKNSLIVLGFINALGMVCTFCVPESKGKSLEEASQETISTGEA

SEQ ID NO: 1488 - DNA, 1812 bp, Solanum tuberosum
  CDS (101)..(1723)
aattcggcacgaggagagaactagtctcgagttttttttttttttttttttttcttgattttggtggaaattgaagataactctgtaaggaagtttagtgatggcgaacgatttgcaagtgctaaatgcactagatgtggcaaagacacaactgtatcacttcacagcaattgtgattgctgggatggggttttttactgatgcttatgaccttttctgcatttctatggtcactaaattgcttggtcgtatttactaccatcatgacaatgcattgaaacctggctctctgccccctaatgtttcagcagctgttaatggagtcgccttctgtggcacccttgctggacagttgttcttcgggtggcttggagataaaatgggaaggaagaaagtctatggaatgacccttatgattatggtcatttgttcaattgcctcggggctttcatttggtcatacaccaaaaagtgttatgactacgctttgtttcttcagattctggctaggatttggcattggtggtgattatcccctttctgccaccatcatgtctgagtatgctaacaaaaagactcgtggagcgttcattgctgctgtgtttgctatgcaaggtttcggaattctggctggtggaatggtggcaatcattgtttcttcagcattcaagggagcattccctgcaccagcatatgaggttgatgctcttgcttcaacagtttctcaggctgatttcgtgtggcgtataattctcatgttcggtgcaatccctgctggacttacttattactggcgtatgaagatgcctgaaactgctcgttacactgccttggtcgccaagaacttgaaacaggcagctaacgacatgtccaaggtgttgcaagtcgaaattgaagcagagccagagaaagttgcagctatttctgtagcaaatggagccaatgaatttggtttgttcagtaaggagttcctccgtcgccatggacttcacttgcttggaactgctagcacgtggttcttgttggacattgctttctacagtcaaaaccttttccagaaggacattttcagtgcaattggatggatcccaccagcacaaaccatgaacgcgttggaagaagtttacaagattgcaagggcacaaactcttattgctctttgtagtactgttcctggttactggttcacagttgcattcattgataggattggtcgattcgcaattcagttgatgggattcttcttcatgacagttttcatgtttgccttagcccttccataccatcactggactctcaaggataacagaatcggcttcgtggtcatgtactcactcacctttttcttcgccaactttggtccaaacgccacaacattcgtcgtccctgctgagattttcccagccaggcttaggtccacatgccatggaatatcagcagcagcaggaaaagcaggagctatggttggtgcattcggattcttgtacgctgctcagcccacagatccaaaaaagactgatgctggttaccctgctggcattggtgtgaggaactcgttgatcgtccttggttgcgttaacttccttggtatgttgttcacattcttggttccagaatcgaaagggaagtcattggaagaaatgtcgagggaaaacgaaggggaagaggaaactgtagctgaaatgagagcaacaagtggaaggacagtcctgtttaagttttagacaagttatcaattagtatatactatgatgcagtttgagttcaatttgtggtatttgggattagaaagagatgtttgttttgtttgttc

SEQ ID NO: 1489 - protein, 540 aa, Solanum tuberosum
MANDLQVLNALDVAKTQLYHFTAIVIAGMGFFTDAYDLFCISMVTKLLGRIYYHHDNALKPGSLPPNVSAAVNGVAFCGTLAGQLFFGWLGDKMGRKKVYGMTLMIMVICSIASGLSFGHTPKSVMTTLCFFRFWLGFGIGGDYPLSATIMSEYANKKTRGAFIAAVFAMQGFGILAGGMVAIIVSSAFKGAFPAPAYEVDALASTVSQADFVWRIILMFGAIPAGLTYYWRMKMPETARYTALVAKNLKQAANDMSKVLQVEIEAEPEKVAAISVANGANEFGLFSKEFLRRHGLHLLGTASTWFLLDIAFYSQNLFQKDIFSAIGWIPPAQTMNALEEVYKIARAQTLIALCSTVPGYWFTVAFIDRIGRFAIQLMGFFFMTVFMFALALPYHHWTLKDNRIGFVVMYSLTFFFANFGPNATTFVVPAEIFPARLRSTCHGISAAAGKAGAMVGAFGFLYAAQPTDPKKTDAGYPAGIGVRNSLIVLGCVNFLGMLFTFLVPESKGKSLEEMSRENEGEEETVAEMRATSGRTVLFKF

SEQ ID NO: 1490 - DNA, 1726 bp, Zea mays
  CDS (74)..(1603)
gtttctgacactccatttctctgcaggccggagtggcttgcagcaagagctcgcgagagggagaagaagaccaatggctcttgggcagcagctgagagtactgcacgctctggatgttgccaggacacagctctaccactttatggcaaccgcaatcgccggcatgggcttcttcacggatgcctatgatttcttcgccatctccctcgtcatggatctcataagctacctgtacaacgaggaacagattgatcgcggcgtcaaagccaccatcaacggcatcgctctgtgtggcgccgtgccggggcaactggtctttggctggctgggcgacaagatgggccgcaagcgcatctacggcgtcacgctgcttctcatggtggtcacctccctggcgtcgggcctctacttcggcaccaacgaagcgtcgaacgtggtggccgtcctctgcttcttccgcttctggcttggcttcggcatcggcggcgattacccgctctcggcaaccatcatgtccgagtacgccaacaagaggagacgcggcgccttcattgcggctgttttcgccatgcaaggtttcggcaaccttgcagctggaatcgttgccgtggtggtatcagcctcgtttctgaggaccaatccaagaaggaacgctaacttcgtctggcggatcgttctcatgctgggcgcggttccggcgatcctcacctactactggcgcatgaagatgcccgagacggcgcggtacaccgcgctggtggcaaaggatgcgaggaaggcagcgtcagacatgtcctccgtcctccacgtggaaatcatcccagaggacgaagcagtcaggcaggacaagtacggtctcttctcggcgcagttcctacgataccatggaacacacctgctcgccaccagcgcgtgctggctcgccgtcgacatcaccttctactcgctcaacctctacatgaaggacatctttgccgacgtcggtctgattgaccctccggggaataacgacttgttcacgcggatgaccgtcactaccttgctgcacacgggcatcgcgctctgtggtacactgccgggatacttcttcaccgtcgcattcgttgaccgcatcggccgtgtcaggattcagctactgggattcactatgatgtccgtcttgacagccatcctcgcagccacttatgcgtactggaaacggcaggaaacaatacagcgcaagatgggcttcgcagtcttgtatggcttgaccaacttcttcgccaattttggtcccaacaccacaacattcatagttccggcggagattttcccagcacggatgcgcgcgacgtgccatggcatagccggcgcattcgggaagataggcgccatcatcggcgtgtttggcttcatgtccaacatggaagaacacggcgtcgtcccaagaaagctgtgggcactatttgcctccaacctagtcggccttgtgttcaccttccttctaccggattccaaaggtaagtcgctggaagagatggccggtgaaacggaagaacagcagcagcaacaggacgctgcagtagttgccgcggccgaccatataaatttggtgcctatttagcacgcccaatggtcactgtttgttgcacgcaatggggtgcgtggcactacttcgtgatatgtgaatatttcatagatcttcttctaaaaaaaaaaaaaaaaaaaaaaaaaaaaaaaaaaaaaa

SEQ ID NO: 1491 - protein, 509 aa, Zea mays
MALGQQLRVLHALDVARTQLYHFMATAIAGMGFFTDAYDFFAISLVMDLISYLYNEEQIDRGVKATINGIALCGAVPGQLVFGWLGDKMGRKRIYGVTLLLMVVTSLASGLYFGTNEASNVVAVLCFFRFWLGFGIGGDYPLSATIMSEYANKRRRGAFIAAVFAMQGFGNLAAGIVAVVVSASFLRTNPRRNANFVWRIVLMLGAVPAILTYYWRMKMPETARYTALVAKDARKAASDMSSVLHVEIIPEDEAVRQDKYGLFSAQFLRYHGTHLLATSACWLAVDITFYSLNLYMKDIFADVGLIDPPGNNDLFTRMTVTTLLHTGIALCGTLPGYFFTVAFVDRIGRVRIQLLGFTMMSVLTAILAATYAYWKRQETIQRKMGFAVLYGLTNFFANFGPNTTTFIVPAEIFPARMRATCHGIAGAFGKIGAIIGVFGFMSNMEEHGVVPRKLWALFASNLVGLVFTFLLPDSKGKSLEEMAGETEEQQQQQDAAVVAAADHINLVPI

SEQ ID NO: 1492 - DNA, 1884 bp, Zea mays
  CDS (89)..(1708)
gcatcaagctaggcaggcctggtcccgaagaacacccttctctggtcgtcgcatcgcagggcagctagctaggtagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgccgccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacatcgtgtggcgggtcatcgtcatgctcggcgccgcgccggcgctgctcacctactactggctgatgaagatgcccgagacggcgcggtacacggcgctggtggccaagaacgccaagcaggccgccgccgacatgtccaaggtgctgcacacggagatcgtggacgagcaggagaagctggacgccgccgagggcgccaacagcttcggcctcttctccagggagttcgcgcgccgccacggcctccacctcgtcggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagaccctcatcgcgctctgcggcacagtcccgggctactggttcaccgtcgcgctcatcgacgtcgtcggccgcttcgccatacagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaggagcaagacggacgccggctaccccgcgggcatcggcgtgcgcaactcgctcttcgtcctcgccgccagcaacatgctcggcttcgtcctcacgttcctcgtgccggagtccaagggcaagtcgctcgaggagatgtccggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgtttttttccacgttaaagtcaaccctggctgtgttttgatgtgcaaaaaaaaaaaaaaaaaaaaaaaaaaaaaaaaaaaaaaaaaaaaaaaaaaaaaaaaaaaaaaaaaa

SEQ ID NO: 1493 - protein, 539 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADIVWRVIVMLGAAPALLTYYWLMKMPETARYTALVAKNAKQAAADMSKVLHTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMV

SEQ ID NO: 1494 - DNA, 2096 bp, Zea mays
  CDS (58)..(1701)
caagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgaccaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcatggccggcggcctcgtggccatcgtcgtgtccgcgtggttcaaggccagtttccccgccccggcctacgccgtcgaccccgccgcgtccacgccgccgcaggccgacttcgtgtggcggatcatcctgatgctgggcgcgatgcccgcggcgctcacctactactggcgcaccaagatgcccgagacggcgcggtacacggcgctggttgccaagaacgccaagcaggccgcggctgacatgtccaaggtgctgcaggtggagatctcagccggcgccgccgaggagggcgccgcggctgcgactgcgactgcgactgagcctgcgccggcgtcggcgtccgcgtcttttgggctcttctccggggagttcctccgccggcacgggctgcacctcctgggcacgtccttgacgtggttcctgctggacatcgccttctactcgcagaacttgttccagaaggacatcttcagcgcggtggggtggatccccaaggcggcaacgatgaacgcgctggaggagctgttcagcatcgcgcgggcgcagtccctgatcgcgctgtgcggcacggtgcccggctactggttcacggtggcgctgatcgacgtgttggggcggttcgcgatccaggtgacggggttcctgatgatgacggtgttcatgctgggtctggccgtgccgtacgagcactggacgacgccggggcaccacatcggcttcatcgtcatgtacggcctcaccttcttcttcgccaacttcgggcccaacgcgaccacgttcatcgtgcccgcggagatcttcccggccaggctgcggtcgacgtgccacggcatctcggcggcgtcggggaagctgggcgccatcatcggctccttcgggttcctgtacctggcgcaaaaccgggacccggccaagacggaccacgggtaccccgcgggcatcggcgtgcgcaactcgctgttcctcctcgccggctgcaacctgctgggcctggcattcacgttcctggtgccggagtccaagggcaaatccctggaggagatgtccggcgagaacgacgaggcggccgccgccgccgccacgccgaactacaacaaccgcacagtgcccgtgtaagtagccgtagtagatgcatctgcatgcatgcatgcaaatgttatataaggaacaagtacgtacgtaacgtaacgtaacgtgtcgtgtgtgtggctgttgcacggtagggtacacgcactgttctccttcgatctggtcgaggttgtttgtcgaggcacagccgtcgccttccgttacgtcattgttaatgtttccgttctgtctggtgcttgtgtgcatgttcagttgaacttgcgcgatcgatctgatgggatcagagacgtgtgtgctcctaaataatcggaggtcaccgtcgggatatagacgtgctctcctggatgttgtaccaagcgcgtcacgctgctttattagatcaatcaagtactgttgttttcgttaaaaaaaaaaaaaaaaaa

SEQ ID NO: 1495 - protein, 547 aa, Zea mays
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSEYANKKTRGAFIAAVFAMQGFGIMAGGLVAIVVSAWFKASFPAPAYAVDPAASTPPQADFVWRIILMLGAMPAALTYYWRTKMPETARYTALVAKNAKQAAADMSKVLQVEISAGAAEEGAAAATATATEPAPASASASFGLFSGEFLRRHGLHLLGTSLTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGENDEAAAAAATPNYNNRTVPV

SEQ ID NO: 1496 - DNA, 1772 bp, Zea mays
  CDS (46)..(1674)
gaagaacacccttctctggtcgtcgcagggcagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgccgccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacttcgtgtggcgggtcatcctcatgctcggcgccgcgccggcgctgctcacctactactggcggatgaagatgcccgagacggcgcggtacacggcgctggtggccaagaacgccaagcaggccgcggccgacatgtccaaggtgctgcacacggagatcctggacgagcaggagaagctggacgggatggtcgccgccgagggcgccaacagcttcggcctcttctccagggagttcgcgcgccgccacggcctccacctcgtcggcaccgccaccacctggttcctgctcgacatcgccttctacagccagaacctgttccagaaggacatcttcaccagcatcaactggatccctaaggccaacaccatgagcgcgctggaggaggtgtaccgcatctcccgcgcgcagacgctcatcgcgctctgcggcaccgtcccgggctactggttcaccgtcgcgctcatcgacgtcgtcggccgcttcgccatccagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgactgcgctccacctgtcacggcatctccgccgcctcggggaaggccggggccatcatcggcgcgttcggcttcctgtacgcggcgcagaaccaggacaagagcaagacggacgccggctaccccgcgggcatcggcgtgcgcaactcgctcttcgtcctcgccgccagcaacatgctcggcttcgtcctcacgttcctcgtgccggagtccaagggcaagtcgctcgaggagatgtctggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgtttttttccacgttaaaaaaaaaaaaaaaaaa

SEQ ID NO: 1497 - protein, 542 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLHTEILDEQEKLDGMVAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKTDAGYPAGIGVRNSLFVLAASNMLGFVLTFLVPESKGKSLEEMSGEAEDSEEEPVGARAVRPSETQMV

SEQ ID NO: 1498 - DNA, 1939 bp, Zea mays
  CDS (112)..(1737)
caacaagctaggcagctgcaagcatctcccaaatcccagcctgctgccccgcgcgaacacacttctcttgtcgttgcattgcagggcagctagccggctacagcatccgccatggcgcgcggcggggacggcctgcaggtgctcagcgcgctggacgcggcgaagacgcagtggtaccacttcacggccatcatcgtcgccggcatgggcttcttcacggacgcctacgacctcttctgcatctccctcgtcaccaagctgctggggcgcatctactacacggacaccagcaaggacaacccgggctcgctcccgcccaacgtcgccgcggcggtcaacggcgtcgccttctgcggcacgctggccggccagctcttcttcggctggctcggggacaagctcgggcgcaagagcgtgtacgggatgacgctcatgctcatggtcatctgctccgtcgcgtcgggcctctcgttcggccacacgcccacgggggtcatggccacgctctgcttcttccgcttctggctcgggttcggcatcggcggggactacccgctgtcggcgaccatcatgtccgagtacgccaacaagaagacccgcggcgccttcatcgcggccgtcttcgccatgcagggcttcggcatcctcgccggcggcattgtcacgctcgtcatctccgccgccttccgcgcggggtacccggccccggcgtacagggacgaccacttcaactccaccgtgccgcaggccgactacgtgtggcgcatcatcctcatcctgggcgccgcgccggcgatgctcacctactactggcggatgaagatgcccgagacggcgcgctacaccgcgctcgtggccaagaacgccaagcaggccgcggccgacatgtccagggtgctccagacggagatcgtcgacgagcaggagaagctggacgagatggtcaccgccgagagcaacaccttcggcctcttctccagggagttcgcgcgccgccacgggctccacctcgtcggcacctccaccacgtggttcctgctcgacatcgccttctacagccagaacctgttccagaaggacatcttcaccagcatcaactggatccccaaggccaacaccatgagcgcgctggaggaggtgttccgcatctcccgcgcccagacgctcatcgcgctctgcggcaccgtcccgggctactggttcaccgtcgcgctcatcgacgtcgtcggccgcttcgccatccagctgctcggcttcttcatgatgaccgtcttcatgctcggcctcgccatcccctaccaccactggaccacgcccggcaaccacatcggcttcgtcgtcatgtacgccttcaccttcttcttcgcaaacttcggccccaacagcaccaccttcatcgtgccggccgagatcttcccggcgcggctgcggtccacatgccacggcatctccgccgcctcggggaaggccggcgccatcatcggggcctttgggttcctgtacgcggcgcagaaccaggacaagagcaaggcggacgccgggtaccccgcgggcatcggcgtacgcaattcgctcttcgtcctcgctgcctccaacttgcttggctttatcctcaccttcctcgtgccggagtccaagggtaagtcgctcgaggagatgtccggggaggctgacgacgccgaggacgacgccgtcggcacccgcgcggtgcggccgtcggggacccagatggtgtagaatcgaacatggcgacgcgtgcacacgggtcctccatcctggggcccgactgggaagacaaggcgcgccggttcaagcctgccgatgctttgctgtgcagaagtagttcgtacaggtgcatgtgtgttataggcgggaaagtaagtgaacttacacgcttgtatttattatatccaaccttacgtacaaaaaaaaaaaaaaa

SEQ ID NO: 1499 - protein, 541 aa, Zea mays
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSVASGLSFGHTPTGVMATLCFFRFWLGFGIGGDYPLSATIMSEYANKKTRGAFIAAVFAMQGFGILAGGIVTLVISAAFRAGYPAPAYRDDHFNSTVPQADYVWRIILILGAAPAMLTYYWRMKMPETARYTALVAKNAKQAAADMSRVLQTEIVDEQEKLDEMVTAESNTFGLFSREFARRHGLHLVGTSTTWFLLDIAFYSQNLFQKDIFTSINWIPKANTMSALEEVFRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKADAGYPAGIGVRNSLFVLAASNLLGFILTFLVPESKGKSLEEMSGEADDAEDDAVGTRAVRPSGTQMV

SEQ ID NO: 1500 - DNA, 1990 bp, Solanum lycopersicum
  CDS (104)..(1741)
ggtttatcagggaatttcttgttctagatacagaaactaggcttaaatgtcaattaattaatcacataactgtctatatatacgtaaattgagcaatttagagatgatcatacatcaaccaatcccatcaaacacgagaaaatcaaataacatggcctcagacaatcttgtagtgctcaatgcacttgacacagcgcgtacccaatggtaccatgtcactgctgttatcattgctggaatgggatttttcactgatgcatatgatctgttctgtatcactactatctcaaaacttttaggccgtttgtactactacgacccaactacgcatgcccctggaaaattgcctcatgtcgcaaacaactgggtgattggagttgctctagttggtactctatctggccagcttgtttttggttggctcggagacaaacttggtcgaaagaaagtctatggacttacgttaattctcatggtcctttgtgcactttgctcggggttgtcccttgggtatagcgcgaaaggtgtaatagggacactttgtttcttcagattctggcttggatttggaattggaggtgattatcctctttctgctaccatcatgtctgaatacgctaacaaggcaactcgtggggcgttcattgctgctgtttttgctatgcaaggagttgggatcatttttgcagggctggtttcgatgatcatttcaaaattgttcttgatgaggtatgaaggggagccatttaatgtggatgaaattttgtccacggagccccaggcagattatgtttggcggatcgtgttgatgcttggagctcttccagctcttcttacctattattggcgaatgaagatgcctgaaacagggcgttacactgcgattattgaaggaaatgctaaacaagccgcgattaacatggggaaggtacttgatattgaaattcaagcagaaagtgataaattggctcaatttaaagcagctaatgagtattctttactctccaatgagtttttccaacgccacgggcttcatttgattggtacaatgagtacttggttcttgttagacatagctttctatagccaaaacctcacacaaaaggatatatttccagtcatgggactcactagcaacgctaacacaatatccgccttgagggagatgtttgagacatcgcgtgccatgtttgtgattgccttgtttggtacttttcctggttactggttcacagtattcttcattgaaaaaatcggaaggtttagaatacaattgatggggttcttcatgatgtctgttttcatggcgatcattggagtcaaatacgattacctaaagagtaaagaacacaaatggacattcgctactctgtatggtttgactttcttctttgccaattttggccccaattcaaccacatttgtgctccccgcggagctgttccctacaagggtgagatccacttgccacgcgttgagcgcagcttctggtaaggcaggggcaatgatcagtgcatttgggatacaacaatacacacaagatgggaatgttcataaaatcaagacagctatgatactgttggctgttacaaatatggctggattttgctgcacgttcttggtgaccgagacaaaagggagatcactcgaagaaattacaggggaggatggcgggcagaatgagacacagatgaagactagcaaacctgtctctggccatcaagacgacggatgggaatgatacaagttcaaaatttcattctaatacatcactacgccttgtgctttctatcttcaattacctctatgaataagagctttaacactatgaatgacctcagtacaacaagttaaattacactaatagtatcgtataaagcctgcatagacatttttatctgttcatgtttacaattttaattcaaacaaggacaaatccatcgtcaattcaatcactacttataattactatgattgtatttgttgaaat

SEQ ID NO: 1501 - protein, 545 aa, Solanum lycopersicum
MIIHQPIPSNTRKSNNMASDNLVVLNALDTARTQWYHVTAVIIAGMGFFTDAYDLFCITTISKLLGRLYYYDPTTHAPGKLPHVANNWVIGVALVGTLSGQLVFGWLGDKLGRKKVYGLTLILMVLCALCSGLSLGYSAKGVIGTLCFFRFWLGFGIGGDYPLSATIMSEYANKATRGAFIAAVFAMQGVGIIFAGLVSMIISKLFLMRYEGEPFNVDEILSTEPQADYVWRIVLMLGALPALLTYYWRMKMPETGRYTAIIEGNAKQAAINMGKVLDIEIQAESDKLAQFKAANEYSLLSNEFFQRHGLHLIGTMSTWFLLDIAFYSQNLTQKDIFPVMGLTSNANTISALREMFETSRAMFVIALFGTFPGYWFTVFFIEKIGRFRIQLMGFFMMSVFMAIIGVKYDYLKSKEHKWTFATLYGLTFFFANFGPNSTTFVLPAELFPTRVRSTCHALSAASGKAGAMISAFGIQQYTQDGNVHKIKTAMILLAVTNMAGFCCTFLVTETKGRSLEEITGEDGGQNETQMKTSKPVSGHQDDGWE

SEQ ID NO: 1502 - DNA, 1581 bp, Oryza sativa subsp
  CDS (1)..(1581)
atggcgggcgatcagatgcacgtgctctccgcgctggacagcgccaagacgcagtggtaccacttcaccgccatcgtcatcgccggcatgggcttcttcaccgacgcctacgacctcttctgcatctccctcgtcaccaagctcatcggccgcgtctactacaccgccgacggcgcgtccaagccgggcagcctgccgcccaacgtctcggcggccgtgaacggcgtcgccttcgtcggcacgctcacggggcagctcttcttcgggtggctcggcgacagggtcggccggaagagcgtctacggcatgacgctgctcttgatgatcatctgctccgtcgcgtcggggctgtcgttcggggacacgccgacgagcgtcatggccacgctctgcttcttccgcttctggctcggcttcggcatcggcggcgactacccgctcagcgccaccatcatgtcggagtacgcgaacaagcggacgcgcggggcgttcatcgccgccgtgttcgcgatgcaggggttcgggatcctcgccggcggcgcggtggcgatcgggatcaccgcgatcttcaggagccggttccccgcgccgccgttcgccgccgacccggcgggtcccaccccgccccaggccgactacgtgtggcggctcatcctcatgttcggcgcgcttcccgcggcgctcaccttctactggcggatgaggatgccggagacggcgcggtacaccgccatcgtcgccaagaacgcggagcgcgccgcggccgacatgtccaaggtgctccaggtgaagatcacggcggagcaggcggagatggcctcgccggtggacaagcccttcaccagcaagcccttcggcctcttctccggcgagttcgcgcggcgccacgggttccacctcctgggcacgacgtcgacgtggctcctcctggacatcgcctactactcccagaacctgttccagaaggacatcttcagcgccatcgggtggatcccggaggcgaagacgatgagcgcgctggacgagctgtaccacatcgcgcgcgcgcagacgctgatcgcgctgtgcgggacggtgccgggctactggttcacggtggcgctgatcgacgtggtcgggcggttcaagatccaggcggcggggttcttcgtgatgacggcgttcatgctggcgctggcggtgccgtacgaccactggacggcggcggggaaccagatcgggttcgtggtgctgtacgcgctcaccttcttcttcgccaacttcgggccgaacgcgacgacgttcatcgtgccggcggagatatacccggcgaggctgcgcgcgacgtgccacgggatatcggcggcgtcggggaaggtgggcgcgatcgtcgggtctttcgggttcctgtacctggcgcagagccccgtcccggccaaggcggcggcgcacggctacccgccgggcatcggcgtccgcaactcgctcttcgcgctcgccggctgcagcttgctcggcttcctcctcaccttccttgtgccggagcccaagggcaagtcgctcgaggagatgtcacgggagaacgaggtcggccagccgtga

SEQ ID NO: 1503 - protein, 526 aa, Oryza sativa subsp
MAGDQMHVLSALDSAKTQWYHFTAIVIAGMGFFTDAYDLFCISLVTKLIGRVYYTADGASKPGSLPPNVSAAVNGVAFVGTLTGQLFFGWLGDRVGRKSVYGMTLLLMIICSVASGLSFGDTPTSVMATLCFFRFWLGFGIGGDYPLSATIMSEYANKRTRGAFIAAVFAMQGFGILAGGAVAIGITAIFRSRFPAPPFAADPAGPTPPQADYVWRLILMFGALPAALTFYWRMRMPETARYTAIVAKNAERAAADMSKVLQVKITAEQAEMASPVDKPFTSKPFGLFSGEFARRHGFHLLGTTSTWLLLDIAYYSQNLFQKDIFSAIGWIPEAKTMSALDELYHIARAQTLIALCGTVPGYWFTVALIDVVGRFKIQAAGFFVMTAFMLALAVPYDHWTAAGNQIGFVVLYALTFFFANFGPNATTFIVPAEIYPARLRATCHGISAASGKVGAIVGSFGFLYLAQSPVPAKAAAHGYPPGIGVRNSLFALAGCSLLGFLLTFLVPEPKGKSLEEMSRENEVGQP

SEQ ID NO: 1504 - DNA, 1647 bp, Oryza sativa subsp
  CDS (1)..(1647)
atggttcaggatcgcaaggtgctcgacgcgctggacacggcgaagacgcagtggtaccacttcacggcggtggtgatcgccggcatgggcttcttcaccgacgcctacgacctcttctccatctccctcgtcaccaagctgctcggccgcatctactacttcaacccggcgtccaagagccccggctccctcccgcccaacgtctccgccgccgtcaatggcgtcgccttctgcggcacgctcgccggccagctcttcttcggctggctcggcgacaagatggggcgcaagaaggtgtacgggatgacgctcatgctcatggtcatctgctgcctcgcctccggcctctcgttcgggtcgtcggcgaaaggcgtcatggccacgctctgcttcttccgcttctggcttgggttcggcatcggtggcgactacccgctctcggcgaccatcatgtcggagtatgctaacaagcgtacccgtggcgcgttcatcgccgccgtgttcgccatgcagggcttcggcaacctcaccggcggcatcgtggccatcatcgtgtccgccgcgttcaagttgcggttcgacgcgccggcgtacaggggcgaccgggccggctccaccgtgccgcaggctgactacgcgtggcgcatcgtgctcatgttcggcgccatcccggcgctgctcacctactactggcggatgaagatgccggagacggcgcgctacaccgcgctggtcgccaagaacgacaagaaggcagccgccgacatggcgcgcgttctcaacgtcgagctcgtcgacgagcaggagaaggcagcggcggcgacggcggcggctgcggaggaggaggcagcacggcgcgagcagtacgggctcttctcccgggaattcgcacggcgccatggccaccacctgctgggcacgacggtgtgctggttcgtgctggacatcgcctactactcgcagaacctgttccagaaggacatctacacggcggtgcagtggctgcccaaggcggacaccatgagcgccctggaggagatgttcaagatctcccgggcacagacgctcgtggcgctgtgcggcaccatcccgggctactggttcaccgtcctcttcatcgacatcgtcggccgcttcgccatccagctcggcggcttcttcctcatgacggcgttcacgctcggcctcgccgtgccgtaccaccactggacgacgccggggaaccacgtcggcttcgtggtcatgtacgccttcaccttcttcttcgccaacttcgggccaaactccacgaccttcatcgtgccggccgagatcttcccggcgaggctgcgttccacctgccacggcatctcgtcggcggccgggaagatgggcgccatcgtcgggtcgttcgggttcttgtacgccgcgcagagcaccgacccgagcaagacggacgccggctacccgcggggcatcggcgtgcgcaactcgctgttcctgctcgccggatgcaacgtcgtcggcttcttgttcacgttcttggtgccagagtcgaaggggaagtcgctggaggagctctccggcgagaacgaaatggaggctgagccggcggcagcaactaactcctacaggcagaccgtccctgacagcggacagtccgagtaa

SEQ ID NO: 1505 - protein, 548 aa, Oryza sativa subsp
MVQDRKVLDALDTAKTQWYHFTAVVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKLRFDAPAYRGDRAGSTVPQADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIYTAVQWLPKADTMSALEEMFKISRAQTLVALCGTIPGYWFTVLFIDIVGRFAIQLGGFFLMTAFTLGLAVPYHHWTTPGNHVGFVVMYAFTFFFANFGPNSTTFIVPAEIFPARLRSTCHGISSAAGKMGAIVGSFGFLYAAQSTDPSKTDAGYPRGIGVRNSLFLLAGCNVVGFLFTFLVPESKGKSLEELSGENEMEAEPAAATNSYRQTVPDSGQSE

SEQ ID NO: 1506 - DNA, 1587 bp, Oryza sativa subsp
  CDS (1)..(1587)
atggcgggatcgcagctcaacgttttggtcaagctcgaccaggctaagacgcaatggtaccatttcatggcgatcgtcatcgccgggatggggttcttcacagacgcctacgacctcttttgcatcgcgctggtcaccaagctgttgggtcgcctttactacaccgacatcaccaagcccaacccagggacactcccgcccaacgtgtcgtccgccgtcaccggcgtcgcgctctgcggcacgctcgccggccagctcttcttcggatggctcggcgacaagctcggccgcaagagcgtctatggattcacgctcatcctcatggtcgtgtgctccatcgcctccggtctctcgtttggccacacgcccaagagcgtgattgccacgctctgcttcttccgcttctggctcggcttcggcatcggcggcgactacccgctcagcgccaccatcatgtcggagtacgcgagcaagaagacccgcggggccttcatcgccgccgtgttcgccatgcaggggttcgggatcctcttcggcgccatcgtcgcgctcgtcgtctcggccggcttccgtcacgcgtacccggcgccgtcgtacgcccagaaccccgccgcgtcgctcgcgccgcaggctgactacacgtggcggctcatcctcatgttcggcaccatcccggctgggctcacctactactggcgcatgaaaatgcccgagacggcgcggtacacggcgctcgtcgcccgcaacgccaagcaggcggcggctgacatgtccaaggtgctccacgccgagatcgaggagcggccggaggtggtcgagagccaggtggtcgccggggagacctggggcctcttctcacggcagttcatgaagcgacacgggatgcacctcctggcgaccaccagcacgtggttcctgctcgacatcgccttctacagccagaacctgttccagaaggacatcttcagcaaggtcgggtggataccgccggcgaagaccatgaacgcgctcgaggaactctaccgcatctcccgcgcccaggcactcatcgcactctgcggaaccatcccgggctactggttcaccgtcgccttcatcgacatcgtcggcaggttctggatccagatcatgggcttcttcatgatgaccgtgttcatgctcgcgctcggcgtgccctacgaccactggacgcacccggcgcaccacaccggcttcgtcgtgctctacgcactcaccttcttcttcgccaacttcgggcccaacagcaccaccttcatcgtgccggctgagatcttcccggcgaggctccggtcgacgtgccacggcatctccgccgcgtccggcaaggccggcgcgatcatcggcgcgttcgggttcctgtacgctgcgcaggaccagcacaatcccgacgcgggacactcccgcggcatcggcatccggaacgcgctcttcgtgctcgccggcacaaacttcctcggtatgctcatgacgctgctggtgccggagtccaagggcttgtcgctggaggagatgtccaaggacaacgtcgtcgacgagaccgcccaagaagcgatcgcccaagcgtga

SEQ ID NO: 1507 - protein, 528 aa, Oryza sativa subsp
MAGSQLNVLVKLDQAKTQWYHFMAIVIAGMGFFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIVALVVSAGFRHAYPAPSYAQNPAASLAPQADYTWRLILMFGTIPAGLTYYWRMKMPETARYTALVARNAKQAAADMSKVLHAEIEERPEVVESQVVAGETWGLFSRQFMKRHGMHLLATTSTWFLLDIAFYSQNLFQKDIFSKVGWIPPAKTMNALEELYRISRAQALIALCGTIPGYWFTVAFIDIVGRFWIQIMGFFMMTVFMLALGVPYDHWTHPAHHTGFVVLYALTFFFANFGPNSTTFIVPAEIFPARLRSTCHGISAASGKAGAIIGAFGFLYAAQDQHNPDAGHSRGIGIRNALFVLAGTNFLGMLMTLLVPESKGLSLEEMSKDNVVDETAQEAIAQA

SEQ ID NO: 1508 - DNA, 1584 bp, Oryza sativa subsp
  CDS (1)..(1584)
atggcgggagggcagctcaacgtgctgagcacgcgcgaccaggcgaagacgcaatggtaccacttcatggcgatcgtcatcgccggcatgggcttcttcaccgacgcctacgacctcttctgcatttccctcgtcaccaagctgctcggccgcatctactacaccgacgattccaaggacacccccggcgcgctcccgcccaacgtgtcggccgccgtcaccggcgtcgcgctctgcggcacgctcgccggccagcttttcttcggatggctcggcgacaagctcggacgcaagagcgtgtatggtttcacgctgattctgatggtcgtgtgctcggtcgcgtccgggctctcgttcgggagctcggccaagggcgtcgtgtctacgctctgcttcttccggttctggctcggcttcggcatcggcggcgactacccgctcagcgccaccatcatgtcggagtacgcgaacaagaggacgcgcggggccttcatcgccgccgtgttcgccatgcaggggttcgggatcctcttcggcgccatcgtcgcgctcgcggtgtcggcggggttccggcacgcgtacccggcgccgtcctactccgacaaccacgccgcgtcgctcgtcccgcaggccgactacgtgtggcgcatcatcctcatgttcggcaccgtcccggcggcgctcacctactactggcggatgaagatgcccgagacggcgcggtacacggcgctcatcgcccgcaacgcgaagcaggcggcggccgacatgtccaaggtgctgcacacccagattgaggagagcgcggaccgcgccgagacggtggccgtcggcggcgagagctggggcctcttctcgcgccagttcctgcgccgccacggcctccacctcctcgccaccaccagcacgtggttcctcctcgacatcgccttctacagccagaacctgttccagaaggacatcttcagcaaggtcgggtggatcccgccggcgaagaccatgaacgcgctcgaggagctctaccgcatcgcccgcgcccaggcgctcatcgcgctctgcggcaccatcccgggctactggttcaccgtcgcattcatcgagatcatgggcaggttctggatccagatcatgggcttcgccatgatgacggcgttcatgctcggcctcgccatcccgtaccaccactggacgacgccggggcaccacaccggcttcatcgtcatgtacggattcaccttcttcttcgcgaacttcgggccaaacagcaccaccttcatcgtgccggcggagatatacccggcgcggctccggtcgacgtgccacggcatctccgccgccgccgggaaggccggcgccatcatcggagcgttcgggttcctgtacgcggcgcaggaccagcacaagcccgagcctgggtaccccagggggatcggcatcaagaacgcgctcttcgtgctcgccggcacaaacttcctcgggacgatcatgacgctgctcgtgccggagtccaagggcacgtcgctcgaggttatctcgcaggaggtcgccgacggcgacgacgaggaggcggcctacccgaagtaa

SEQ ID NO: 1509 - protein, 527 aa, Oryza sativa subsp
MAGGQLNVLSTRDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYSQNLFQKDIFSKVGWIPPAKTMNALEELYRIARAQALIALCGTIPGYWFTVAFIEIMGRFWIQIMGFAMMTAFMLGLAIPYHHWTTPGHHTGFIVMYGFTFFFANFGPNSTTFIVPAEIYPARLRSTCHGISAAAGKAGAIIGAFGFLYAAQDQHKPEPGYPRGIGIKNALFVLAGTNFLGTIMTLLVPESKGTSLEVISQEVADGDDEEAAYPK

SEQ ID NO: 1510 - DNA, 1726 bp, Zea mays
  CDS (50)..(1714)
gacacctgccttacattgccggcgcgcttgcgtgactgggcgcggcgagatggcggcgccgggcgggtcgaacctggcggtgctggacgcgctggactcggcgcgcacccagatgtaccacatgaaggccatagtcatcgccggcatgggcttcttcaccgacgcctacgacctcttctgcatctccaccgtgtccaagctgctcggccgcatctactacccggacgacaacctgtacatagacaagcccaagcccggcactctgcccgtgtccgtcaacaacatggtgacaggcgtcgcgctcgtcggcacgctcatgggccagctcgtcttcggctacttcggcgacaagctcgggcggaagcgcgtgtacggcatcacgctcgtgctgatggccgcctgcgccatcggctcgggcctctcgttcggcagctcggcgcacgccgtcatcggcacgctctgcttcttccgcttctggctcggcttcggcatcggcggggactacccgctgtccgcgaccatcatgtccgagtactccaacaagaagacgcggggcgcgttcatcgccgcggtgttcgcgatgcagggcgtcggcatcatcttcgcggggctcgtgtccatgatcgtctcgggcatcctcctgcactaccacccggcgccggcgtggaaggagaaccacgaccggtcgtggcaggaccagatgccggcggcggactacatgtggcgcatcgtcctgatgatcggcgcgttcccggcgctggccacgttctactggcggatgaagatgcccgagacggcaaggtacaccgcgctcatcgagggcaacgccaagcaggcggccaacgacatgcagaaggtgatggacgtcgagatccaggccgagcaggacaagctcgcgaggtacaaggcggcgaacgactacccgctgctgtcgagggagttcgcccggcgccacggcctgcacctcatcggcacggccaccacgtggttccttctcgacatagccttctacagccagaacctgacccagaaagacatcttcccggcgatcaaactgacgagccccgtcgacgacataaacgccctcaaggaggtgttcgagatttccaaggccatgttcctcgtcgcactcctcggcaccttccccggctactgggtcaccgtcgcgctcatcgacaaaatgggcaggtacctgatccagctcatcggtttcttcatgatgtctgtcttcatgctactgatgggcgtcatgtacaacgacctcaagaacaaacacaccacgctcttcgccctcttctacgcgctcaccttcttcttcgccaacttcggccccaacagcaccaccttcgtgctgccggccgagctattcccgacgcgcgtgcgctccacctgccacgccatcagcgccgcgtcaggcaaggccggcgccatcgtcgcggccttcggggtgcagagcctcacgctcaagggagacgtgggccacatcaagaaggcgctcatcatcctctccgtcaccaacatcctcggcttcttcttcaccttcctcgtcccggagaccatgggccgctcgctcgaggagatctccggggaggacggcaacgtcgaaaacggtcccggtgctcccgccggcgtggccatgggcgtcgcggacgtgagcaaggatgacaagatgcctgtttccagtactgagtggcagagctccatgcatgcgtgatcgagtaagcag

SEQ ID NO: 1511 - protein, 554 aa, Zea mays
MAAPGGSNLAVLDALDSARTQMYHMKAIVIAGMGFFTDAYDLFCISTVSKLLGRIYYPDDNLYIDKPKPGTLPVSVNNMVTGVALVGTLMGQLVFGYFGDKLGRKRVYGITLVLMAACAIGSGLSFGSSAHAVIGTLCFFRFWLGFGIGGDYPLSATIMSEYSNKKTRGAFIAAVFAMQGVGIIFAGLVSMIVSGILLHYHPAPAWKENHDRSWQDQMPAADYMWRIVLMIGAFPALATFYWRMKMPETARYTALIEGNAKQAANDMQKVMDVEIQAEQDKLARYKAANDYPLLSREFARRHGLHLIGTATTWFLLDIAFYSQNLTQKDIFPAIKLTSPVDDINALKEVFEISKAMFLVALLGTFPGYWVTVALIDKMGRYLIQLIGFFMMSVFMLLMGVMYNDLKNKHTTLFALFYALTFFFANFGPNSTTFVLPAELFPTRVRSTCHAISAASGKAGAIVAAFGVQSLTLKGDVGHIKKALIILSVTNILGFFFTFLVPETMGRSLEEISGEDGNVENGPGAPAGVAMGVADVSKDDKMPVSSTEWQSSMHA

SEQ ID NO: 1512 - DNA, 1781 bp, Triticum aestivum
  CDS (1)..(1602)
atggcacggcagcagctgcaggtgcttcacgcgctggacgtggcgaggacgcagaggtaccacgcgtgggcggtggtgatcgccggcatgggcttcttcgccgacgcctacgacatcttctgcatcaccctagtcaccaagctcctcggacgcatctattaccaagtcccgggccaacgagagcccgggatgctcccccggcggatcgaggcggccatcaacggcgtcaccttctgcggcatgatcgtgggccagctcttgtttggctggctcggcgacaaggtcggccggaagatgttctacggcaagaccatcatgctcatgatcatgggctccttcctctccggcttgtcgttcgggaacacggccgacggcgtcatggccacgctatgcttcttcaggttctggctcggcgtcggcatcggcggagactatccgctctccgcgaccatcatttccgagtactccaacaagaggtcgcgcgggagcctcatcgcggccgtgtttgccatggaagggtttggcatccttgcaggttgcattgtcaccttggtcgtgtcggccacgttccaggcgcgcttcaacccgccggcgtatgacgaagaccacatggcctcggtcccgccgcaggctgactacgtgtggcgcatcatcctcatggtgggtgccatcccagccgtcttcacctatcgctggagggtgatgatgccggagacggcgcgctatacggcgctggtcgcgcgcgacgccgagaaggccgcgcgcgacatgtccaaggtgctcaaggtggaactcagcggcgagcaggacaagatcgagagcttcaccagggacagggactacggcgtcttctcccgccgtttcgcccgccgccacggctggcatctcgtcggcgccgttgcatcctggttcgtgctcgacatcgtcttctactcccagatcattctccaggaggagatcttcagggacatcaagtggatccccgaggcaaacagcatgagcgcgctcgaggaagcgtaccgcgtcgcccgtgcacaggcgattatcgcgctatgcggcacactacctggctactggttcaccatcgcctttgtggacgtcgtcgggcggaaggccatccagttcctcgggttcaccatgatgaagggactcatgctcgtcgtggccggcttctaccaccaactgacgcagcctggccggcgaatctggctggtggtcatgtacgccttcaccttcttctttgccaactttgggcccaacagcaccaccttcatcataccggccgaggtttttccggcgcacgtccggacgacctgccacgggatatcatcagcggcaggcaaggtcggtgccattgtcgggacgtttggcttcctgtacgcctcgcagagggcggacggcagcaatgagagggagaccgggtacccgtcgggcatcggcgtgcgtgcctcactgttcgtgctggccgcgtgcaatgtgttgggaataattttcacctgtctcctgcctgagccgaacgggaggtcgctggaggaggtgtccggcgagcccatcaacggggaggacgcagatctgggtgattccaaggttcttcccttgtagaacctgcctgaacgtaggctgtgcgcaccactcgatgaaaaagaagctatttgaatgtgtgttgtgctgggaacccgggattagatgcactccaaggaccctacgtacacggcgttcggcaatcatcgcggaggggaaatgtgaattaagaggaaggaattgtcgagattagacttagg

SEQ ID NO: 1513 - protein, 533 aa, Triticum aestivum
MARQQLQVLHALDVARTQRYHAWAVVIAGMGFFADAYDIFCITLVTKLLGRIYYQVPGQREPGMLPRRIEAAINGVTFCGMIVGQLLFGWLGDKVGRKMFYGKTIMLMIMGSFLSGLSFGNTADGVMATLCFFRFWLGVGIGGDYPLSATIISEYSNKRSRGSLIAAVFAMEGFGILAGCIVTLVVSATFQARFNPPAYDEDHMASVPPQADYVWRIILMVGAIPAVFTYRWRVMMPETARYTALVARDAEKAARDMSKVLKVELSGEQDKIESFTRDRDYGVFSRRFARRHGWHLVGAVASWFVLDIVFYSQIILQEEIFRDIKWIPEANSMSALEEAYRVARAQAIIALCGTLPGYWFTIAFVDVVGRKAIQFLGFTMMKGLMLVVAGFYHQLTQPGRRIWLVVMYAFTFFFANFGPNSTTFIIPAEVFPAHVRTTCHGISSAAGKVGAIVGTFGFLYASQRADGSNERETGYPSGIGVRASLFVLAACNVLGIIFTCLLPEPNGRSLEEVSGEPINGEDADLGDSKVLPL

SEQ ID NO: 1514 - DNA, 2710 bp, Solanum tuberosum
  CDS (1121)..(2710)
atcagccctttgtatgctgctaacctacataagttgataaaaaaggcataagactaatccagcaatatcgtgtgagtgaagaagggctagggcatgataatgttgaaatatgtactcaaaaaataatgggactaaacttaaaaacaaattggagcttcatgaaatccaatcaccaacctgaaactccatttctcatgtcctgctttaatctgcataatactttctcatgtcctgagttttttgtttcaaatttttgccatcaattgtctattcttaagcatcttgtgtattgatttttttctacgtacaaacggtcatattgttattttttgagaagcatcttttataagaagaatatatttcaaaagcttaagccaaagataatagcttggaatatacatcattcatacctacaagaacaaagttgcaatttctatgctgaaaatcggaattaccattaattgttcccacttttgtttggattgagtccatgcaggcaatttctcttaataaattcatttgattgataccgatagcgatcaatgaatggtttaatgatggtgttctagatttctttcccaagtattaatagaaaggaattttaaaaaaattatgtcctttttataagggatttttatttttacacataagagacttccattttacacaagagatctgaaaagactatttttcttctattcaaattgtatgagagcaagagatctcatttccgcctcttttacattgtcaagattctatactgacttattatgttgacaaatttgcctaaaagtggtcgtttaacaactattggcacatcctgtatctcaaagtgattgccaaagatgcataatctattgtaaagcataagcatcacaatcacattgttgtttcaatttcttgtgacggcattgagttggaggcatattattgatttaagcaaagaaagaagaaggatattctccaatagttatcagggaatttcttgttctagatacagaaactaggcatagacgccaattaattaatcacataactatctctctctatatatgtatatatacattgagcaatttagagatgatcagacatcaaccaatctcagagaaaataaaataacatggcctcagacaatcttgtagtgctcaatgcacctgacacagcgcgtacccaatggtaccatgtcaccgctgttatcattgctggaatgggatttttcactgatgcatatgatctgttctgtatcactactatctcgaaacttttaggccgtttgtactactacgacccaactacccatgcccctggcaaattgcctcatgtcgcgaacaattgggtgattggagttgctctagttggtactctatcaggccagcttgtttttggttggctcggagataaacttggtcgaaagaaagtctatggacttacattaattctcatggtcctttgtgcaatttgctcggggttgtcctttgggtatagcgcgaaaggtgtaatagggacactctgtttcttcagattctggcttggatttggaattggaggtgattatcctctttctgctacgatcatgtctgaatacgctaacaaggcaactcgtggggcgttcattgctgctgtttttgctatgcaaggagttgggatcatttttgcagggctcgtttcaatgatcatttcaaaattgttcttgatgaagtatgaagggaagccatttgatgtggatgaaattttgtccacggagcccgaggctgattatgtttggcggatcgtgttgatgcttggagctcttccggctcttcttacctattattggcgaatgaagatgcctgaaacagggcgttacactgcgattattgaaggaaatgctaaacaagccgcgattaacatgggaaaggtacttgatattgaaattcaagcagaaggtgataaattggctcaatttaaagcagctaatgagtattctttactctccaatgagttcttccaacgccatgggcttcatttgattggtacaatgagtacttggttcttgttagacatagctttctacagccaaaacctcacacaaaaggacatatttccagtcatgggactcactagcaaagctaacacgatatccgccttgagggagatgtttgagacatcgcgtgccatgtttgtgattgccttgtttggtactttccctggttactggttcacagtattcttcattgaaaaaatcggaaggtttagaatacaattgatggggttcttcatgatgtctgttttcatggcgatcattggaatcaaatacgattacctaaagactaaagagcacaaatggacattcgcaactctgtatggtttaactttcttctttgccaattttggtcccaattcaaccacatttgtgctccccgcggagctgttccctacaagggtgagatccacttgccacgcgttgagtgcagcttctggaaaggcaggggcaatgatcagtgcatttgggatacaacaatacacgcaagatgggaatgttcataaaatcaagacagctatgatactgatggccgttacaaatatggttggattttgctgcacgttcttggtgaccgagacaaaagggagatcactcgaagagatttcaggggaggatggcgggaagaatgagacacaaatgaagactagcaaacctgtctctggccatcaggacgacggatgggaatga

SEQ ID NO: 1515 - protein, 529 aa, Solanum tuberosum
MASDNLVVLNAPDTARTQWYHVTAVIIAGMGFFTDAYDLFCITTISKLLGRLYYYDPTTHAPGKLPHVANNWVIGVALVGTLSGQLVFGWLGDKLGRKKVYGLTLILMVLCAICSGLSFGYSAKGVIGTLCFFRFWLGFGIGGDYPLSATIMSEYANKATRGAFIAAVFAMQGVGIIFAGLVSMIISKLFLMKYEGKPFDVDEILSTEPEADYVWRIVLMLGALPALLTYYWRMKMPETGRYTAIIEGNAKQAAINMGKVLDIEIQAEGDKLAQFKAANEYSLLSNEFFQRHGLHLIGTMSTWFLLDIAFYSQNLTQKDIFPVMGLTSKANTISALREMFETSRAMFVIALFGTFPGYWFTVFFIEKIGRFRIQLMGFFMMSVFMAIIGIKYDYLKTKEHKWTFATLYGLTFFFANFGPNSTTFVLPAELFPTRVRSTCHALSAASGKAGAMISAFGIQQYTQDGNVHKIKTAMILMAVTNMVGFCCTFLVTETKGRSLEEISGEDGGKNETQMKTSKPVSGHQDDGWE

SEQ ID NO: 1516 - DNA, 2017 bp, Solanum lycopersicum
  CDS (133)..(1770)
gcaaagatggaagaaggatattcttcaatggtttatcagggaatttcttgttctagatacagaaactaggcttaaatgtcaattaattgatcccataactgtctatatatacgtaaattgagcaatttagagatgatcatacatcaaccaatctcatcaaacacgagaaaatcaaataacatggcctcagacaaccttgtagtgctcaatgcacttgacacagcgcgtacccaatggtaccatgtcactgctgttatcattgctggaatgggatttttcactgatgcatatgatctgttctgtatcactactatctcaaaacttttaggccgtttgtactactacgacccaactacgcatgcccctggaaaattgcctcatgtcgcaaacaactgggtgattggagttgctctagttggtactctatctggccagcttgtttttggttggctcggagacaaacttggtcgaaagaaagtctatggacttacgttaattctcatggtcctttgtgcactttgctcggggttgtcccttgggtatagtgcgaaaggtgtaatagggacactttgtttcttcagattctggcttggatttggaattggaggtgattatcctctttctgctaccatcatgtctgaatacgctaacaaggcaactcgtggggcgttcattgctgctgtttttgctatgcaaggagttgggatcatttttgcagggctggtttcgatgatcatttcaaaattgttcttgatgaggtatgaaggggagccatttaatgtggatgaaattttgtccacggagccccaggcagattatgtttggcggatcgtgttgatgcttggagctcttccagctcttcttacctattattggcgaatgaagatgcctgaaacagggcgttacactgcgattattgaaggaaatgctaaacaagccgcgattaacatggggaaggtacttgatattgaaattcaagcagaaagtgataaattggctcaatttaaagcagctaatgagtattctttactctccaatgagtttttccaacgccacgggcttcatttgattggtacaatgagtacttggttcttgttagacatagctttctatagccaaaacctcacacaaaaggatatatttccagtcatgggactcactagcaacgctaacacaatatccgccttgagggagatgtttgagacatcgcgtgccatgtttgtgattgccttgtttggtacttttcctggttactggttcacagtattcttcattgaaaaaatcggaaggtttagaatacaattgatggggttcttcatgatgtctgttttcatggcgatcattggagtcaaatacgattacctaaagagtaaagaacacaaatggacattcgctactctgtatggtttgactttcttctttgccaattttggccccaattcaaccacatttgtgctccccgcggagctgttccctacaagggtgagatccacttgccacgcgttgagcgcagcttctggtaaggcaggggcaatgatcagtgcatttgggatacaacaatacacacaagatgggaatgttcataaaatcaagacagctatgatactgttggctgttacaaatatggctggattttgctgcacgttcttggtgaccgagacaaaagggagatcactcgaagaaattacaggggaggatggcgggcagaatgagacacagatgaagactagcaaacctgtctctggccatcaagacgacggatgggaatgatacaagttcaaaatttcattctaatacatcactacgccttgtgctttctatcttcaattacctctatgaataagagctttaacactatgaatgacctcagtacaacaagttaaattacactaatagtatcgtataaagcctgcatagacatttttatctgttcatgtttacaattttaattcaaacaaggacaaatccatcgtcaattcaatcactacttataattactatgattgtatttgttgaa

SEQ ID NO: 1517 - protein, 545 aa, Solanum lycopersicum
MIIHQPISSNTRKSNNMASDNLVVLNALDTARTQWYHVTAVIIAGMGFFTDAYDLFCITTISKLLGRLYYYDPTTHAPGKLPHVANNWVIGVALVGTLSGQLVFGWLGDKLGRKKVYGLTLILMVLCALCSGLSLGYSAKGVIGTLCFFRFWLGFGIGGDYPLSATIMSEYANKATRGAFIAAVFAMQGVGIIFAGLVSMIISKLFLMRYEGEPFNVDEILSTEPQADYVWRIVLMLGALPALLTYYWRMKMPETGRYTAIIEGNAKQAAINMGKVLDIEIQAESDKLAQFKAANEYSLLSNEFFQRHGLHLIGTMSTWFLLDIAFYSQNLTQKDIFPVMGLTSNANTISALREMFETSRAMFVIALFGTFPGYWFTVFFIEKIGRFRIQLMGFFMMSVFMAIIGVKYDYLKSKEHKWTFATLYGLTFFFANFGPNSTTFVLPAELFPTRVRSTCHALSAASGKAGAMISAFGIQQYTQDGNVHKIKTAMILLAVTNMAGFCCTFLVTETKGRSLEEITGEDGGQNETQMKTSKPVSGHQDDGWE

SEQ ID NO: 1518 - DNA, 1668 bp, Triticum monococcum
  CDS (1)..(1668)
atgttcacgacctggcctgcgaggaggcacgcgtgcagctccctcttctgccacctccatggcgccgggagcgccatgctgtaccgcgtgctggacgcggtgacatcggtgaaatgcgagacccgtcgggcgcgcaagcagatcaaggtgctggaggccctggacgtcgccgggacgcagctgtaccacttcaccaccatcgtcatcgccggcatgggcttcttcaccgatgcctacgacctgttctcggcctccctcatcgccgacctcctgggccacatctactaccactcggcggacggcaagctccccggtcacgtcgccggcgccgtcagcggcgtggcgctctgcggcacagtcctggggcagctcttcttcggctggctcggcgacaggatggggcggaagcggatctacggcgtcacgctcaagctcatggtggtgtgctcgctcgcgtccggcctctccttccacaacaagcccaagtgcgtcgtggccacgttgtgcttcttccgcttctggctcggcttcggcatcggcggcgactacccgctctcggcgactatcatgtctgagtatgccaacaagaggactcgcggcgccttcatcgcagcggtctttgctatgcagggtcttgggaacctggctgctggggctgttgttctggtgctctctgcgagcttcaagaacacggccgcgtacgatactgaccatctcgggcaagcagactacgtatggcgcatagtactcatgctcggcgccgttcctgccctgctcacctactactggcgcatgaagatgcccgagacggcgcgctacaccgcgctcatcgccaagaacctcaagctagcggcgtctgacatggccgcagtcctcgacatcgacttcgtgtccgacatggacgcagaggccgttgttaagcaggacgagtttggcctcttctccatggagttccttcacaagcatggccgccagctcctcggaaccactgtgtgctggttcgtcctcgacgtcgtcttctactccctcaacctcttcatgaaggacatcttcaacggcatcggctggtttggagacgcggccgagatgagccctctcgagcagacctacaagatagcccgcacgcaggccatcattgtggtcggcggttccctaccagggtacttcctcactgtcctcttcgttgaccgcatcggccgcatcaagatccagctcatggggttcaccatgatgaccatcttcatgatcgggctcgccgcgccctacaagttctggtccaaacccagcatgcacgcaggcttcgccatcatgtatgcattgatcctcttcttcgcaaacttcggccccaactccaccaccttcatcctgcccaccgagatattcccgacgcggctgcggtcgacgtgcaacggcatatcggctgccgggggtaagtgtggtgccatcatcggtgttctctggttccagtattctcatacgagcatccggagctctctccttcttctggcagggtgtaacctcgttggagtcatgttcactcttgccttgccggaatccaaagggatgtcactcgaggatatcaccggggaaatggaggaagaaagcgaaccatctcaagaatctacggttgctgaagttgagttcatccacagcgtggaaattttgtaa

SEQ ID NO: 1519 - protein, 555 aa, Triticum monococcum
MFTTWPARRHACSSLFCHLHGAGSAMLYRVLDAVTSVKCETRRARKQIKVLEALDVAGTQLYHFTTIVIAGMGFFTDAYDLFSASLIADLLGHIYYHSADGKLPGHVAGAVSGVALCGTVLGQLFFGWLGDRMGRKRIYGVTLKLMVVCSLASGLSFHNKPKCVVATLCFFRFWLGFGIGGDYPLSATIMSEYANKRTRGAFIAAVFAMQGLGNLAAGAVVLVLSASFKNTAAYDTDHLGQADYVWRIVLMLGAVPALLTYYWRMKMPETARYTALIAKNLKLAASDMAAVLDIDFVSDMDAEAVVKQDEFGLFSMEFLHKHGRQLLGTTVCWFVLDVVFYSLNLFMKDIFNGIGWFGDAAEMSPLEQTYKIARTQAIIVVGGSLPGYFLTVLFVDRIGRIKIQLMGFTMMTIFMIGLAAPYKFWSKPSMHAGFAIMYALILFFANFGPNSTTFILPTEIFPTRLRSTCNGISAAGGKCGAIIGVLWFQYSHTSIRSSLLLLAGCNLVGVMFTLALPESKGMSLEDITGEMEEESEPSQESTVAEVEFIHSVEIL

SEQ ID NO: 1520 - DNA, 1659 bp, Oryza sativa subsp
  CDS (1)..(1659)
atggctccgatcggcgtgctcacggcgctggaccaggcgcggacgcagtactaccacttcaaggccatcgtcatcgccggcatgggactcttcaccgactcctacgacctcttctgcatcgcgcccgtcatgaagatcgtgggccgggtgtactactccgacggcggcgcccgtccgggggtgacgccgccggccgtcgtgtcggcgaccgtcggagtggcgctgctgggcgcggtgatcgggaacgtggtgttcggcgcgctgggcgaccgcgtggggcggcgccgcgtctacggcgcgtgcctgctgctgatggtgtgcagctccgtcgggagcggcttctccgtgtgccggacgcgccggtgcgcgctcgccagcctctgcttcttccgcttcctcctcggcgtcggcgtcggcggcgactacccgctgtcggccaccatcatgtcggagttcgccaaccggcgcacccgcggcgcgttcatcgccgccgtgttctccatgcaggggttcggcatcctcgccagctccgcggtcaccatggccgtcgccgccgccttcgaccactacaccggctaccccgcgccgctcgacacgccggagtgcgccgacctcgcctggcggatcattctcatggccggcgccgtccccgccgcgctgacgtactactggaggatgtccatgccggagacggccagatatacggctttggtggagcgcgacgtggtgaaggccaccaacgacatcggccgcgttctggccgacctcgacctgggcgccgtcgccgaggaggaggtggcggcggcgttgagccggcctccgccgccgccgcgcccttcgtacggcctcctctctcggcgcttcgtccggcagcacgggcgggacctgttcgcgtgcgcggcggcgtggttcctcctcgacatcccctactacagcagcacgctgttccagtctcagatctaccggccgctgttcccggcgccggggctcatcaacgcgttccaggaggcgttcaacgtggccaagttccaggccgtcatcgccgtcgcctccaccatcccgggctacttcgtcgccgtgctcctcatcgaccgcgtcggccggcggtgcctccagatggccgggttcctcctcatggccgtcttcctcttcgcgctcgcgggtccgtacgacggatactggcgcgaccacggcgcgcacgccggctacatcgtgctctactcgctcaccttcttctccgccaacctcgggccgaacaccaccaccttcatcctgccggcggagctcttcccggcgcgcttccggtcgacgtgccacggcctctccggcgcggcggggaagctcggcgcgctcgtcggctccatcggcttcctgtgggcgtcgcagcagaaggacggcgcggcggccgggcacctgccgggcatcggcatgatgtacgcgctgttcgttcttggcgggatctgcctgctcgggctggcactcacctacgtgttcacgccggagacgatgatgcggtcgctggaggagaacgagagcgacagggcgcagacccaggtcggcgacggcggcagcgacaccgaggcggccaagagcccggcgtccatggcgagctcgcacctcagcatgtcgcccatccttccagcccgggtctccgtgtga

SEQ ID NO: 1521 - protein, 552 aa, Oryza sativa subsp
MAPIGVLTALDQARTQYYHFKAIVIAGMGLFTDSYDLFCIAPVMKIVGRVYYSDGGARPGVTPPAVVSATVGVALLGAVIGNVVFGALGDRVGRRRVYGACLLLMVCSSVGSGFSVCRTRRCALASLCFFRFLLGVGVGGDYPLSATIMSEFANRRTRGAFIAAVFSMQGFGILASSAVTMAVAAAFDHYTGYPAPLDTPECADLAWRIILMAGAVPAALTYYWRMSMPETARYTALVERDVVKATNDIGRVLADLDLGAVAEEEVAAALSRPPPPPRPSYGLLSRRFVRQHGRDLFACAAAWFLLDIPYYSSTLFQSQIYRPLFPAPGLINAFQEAFNVAKFQAVIAVASTIPGYFVAVLLIDRVGRRCLQMAGFLLMAVFLFALAGPYDGYWRDHGAHAGYIVLYSLTFFSANLGPNTTTFILPAELFPARFRSTCHGLSGAAGKLGALVGSIGFLWASQQKDGAAAGHLPGIGMMYALFVLGGICLLGLALTYVFTPETMMRSLEENESDRAQTQVGDGGSDTEAAKSPASMASSHLSMSPILPARVSV

SEQ ID NO: 1522 - DNA, 1770 bp, Zea mays
  CDS (52)..(1671)
ttctctggtcgtcgcatcgcagggcagctagctaggtagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggccgggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgcggccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacttcgtgtggcgggtcatcctcatgctcggcgccgcgccggcgctgctcacctactactggcggatgaagatgcccgagacggcgcggtacacggcgctggtggccaagaacgccaagcaggccgcggccgacatgtccaaggtgctgcagactgagatcgtggacgagcaggagaagctggacgccgccgagggcgccaacagcttcggcctcttctccagggagttcgcgcgccgccacggcctccacctcgtgggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagaccctcatcgcgctctgcggcacagtcccgggctactggttcaccgtcgcgctcatcgacgtcgtcggccgcttcgccatacagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaggagcaagacggacgccggctaccccgcgggcatcggcgtgcgcaactcgctcttcgtcctcgccgccagcaacatgctcggcttcgtcctcacgttcctcgtgccggagtccaggggcaagtcgctcgaggagatgtccggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgtttttttccacgttaaagtcaaccctggctgtg

SEQ ID NO: 1523 - protein, 539 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLQTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESRGKSLEEMSGEAEDSEEEPVGARAVRPSETQMV

SEQ ID NO: 1524 - DNA, 1602 bp, Hordeum vulgare var
  CDS (1)..(1602)
atggcacggcagcagctgcaggtgcttcacgcgctggacgtggccaggacacagaggtaccacgcgtgggcggtggtgatcgccggcatgggcttcttcgccgacgcgtacgacatcttctgcatcaccctggtcaccaagctcctgggacgcatctattaccacgtccctggccaaccagaccccggaatgctcccccggcggatcgaggcggccatcaacggcgtcaccttctgcggcatgatcgtggggcagctcttgtttggctggctcggcgacaaggtcggccggaagatgttctacggcaagaccatcatgctcatgatcatgggctcctttctctcgggcttgtcattcgggaacacggccgacggcgttatggccacgctgtgcttcttccggttctggctcggcgtcggtatcggcggagactatccgctctccgcgaccatcatttccgagtactctaacaagagatcgcgcgggagcctcatcgcggccgtgtttgccatggaagggtttggcattcttgcaggctgcattgtcaccttggtcgtgtcggccacgttccaggcccgcttcaacccgccggcgtatgaggaagaccccatggcctcggtcccgccgcaggctgactacgtgtggcgcatcatcctcatggtgggtgccatcccagccgtcttcacctaccgctggagggtgatgatgccggagacggcgcgctatacggcgctggtggcccgcgacgccgagaaggccgcgcgcgacatgtccaaggtgctcaaggtggaattcaccggcgagcaggacaagatcgagagcttcaccagggacagggactacggcgtcttctcccgccgtttcgcccgccgccatggctggcatctcgtcggcgccgttgcgtcctggttcgtgctcgacatcgtcttctactcccagatcattctccaggaggagatattcagggacgtcaagtggatccccgaggcacgcaccatgagcgcgctcgaggaagcgtaccgcgtcgcccgtggacaggcgatcatcgcgctctgcggcacactacctggctactggttcaccgtcgcctttgtggatgtcgtcgggcggaaggccatccagttcctcgggttcaccatgatgaagggtctcatgctcgtcgtcgccgccttctaccaccacctgacgcagcctggccggcgaatatggctggtggtcatgtacgccttcaccttcttctttgccaactttgggcccaacagcaccaccttcatcataccggccgagatttttccggcacacgtccggacgacctgccatgggatatcatcggcggcaggcaaggtaggcgccattgtcgggacgtttggcttcctgtacgcctcgcagagggcggacggcagcaacgaggtgaaaagtgggtacccgtcgggcatcggcgtgcgtgcctcactgttcgtgctggccgcgtgcaatgtgttgggcataattttcacctgtctcctgcctgagccgaatgggaggtcgctggaggaggtgtccggcgagcccatcaacagggaggacgcggatttgggtgattccagggttcttcccttgtag

SEQ ID NO: 1525 - protein, 533 aa, Hordeum vulgare var
MARQQLQVLHALDVARTQRYHAWAVVIAGMGFFADAYDIFCITLVTKLLGRIYYHVPGQPDPGMLPRRIEAAINGVTFCGMIVGQLLFGWLGDKVGRKMFYGKTIMLMIMGSFLSGLSFGNTADGVMATLCFFRFWLGVGIGGDYPLSATIISEYSNKRSRGSLIAAVFAMEGFGILAGCIVTLVVSATFQARFNPPAYEEDPMASVPPQADYVWRIILMVGAIPAVFTYRWRVMMPETARYTALVARDAEKAARDMSKVLKVEFTGEQDKIESFTRDRDYGVFSRRFARRHGWHLVGAVASWFVLDIVFYSQIILQEEIFRDVKWIPEARTMSALEEAYRVARGQAIIALCGTLPGYWFTVAFVDVVGRKAIQFLGFTMMKGLMLVVAAFYHHLTQPGRRIWLVVMYAFTFFFANFGPNSTTFIIPAEIFPAHVRTTCHGISSAAGKVGAIVGTFGFLYASQRADGSNEVKSGYPSGIGVRASLFVLAACNVLGIIFTCLLPEPNGRSLEEVSGEPINREDADLGDSRVLPL

SEQ ID NO: 1526 - DNA, 1581 bp, Oryza sativa subsp
  CDS (1)..(1581)
atggcggacgggcagctcaaggtactgacgacgctggaccatgcgaggacgcagtggtaccatttcatggcgatcgtgatcgccggcatgggcttcttcaccgacgcctacgacctcttctgcatctccctcgtctccaagctgctcggccgcatctactacaccgacctcgccggggacaaccccggcagcctgccgcccaacgtgtcggcagcggtgaacggcgtcgcgctgtgcggcacgctcgcggggcagctcttcttcgggtggctcggcgacaagctcgggcggaagagcgtgtacggcttcacgctcgtgctcatggtggtgtgctccgtcgcgtcgggcctctcgttcgggcgcacggcgaagggcgtcgtcgccacgctctgcttcttccggttctggctcggcttcggcatcggcggcgactacccgctgtcggcgacgatcatgtcggagtacgccaacaagaggacgcgcggggcgttcatcgccgccgtgttcgccatgcaggggttcggcatcctgttcggcgccatcgtggcgctcgtcgtgtcggccgggttccggaacgcgtacccggcgccgtcgtacgccgacggccgcgcggcgtcgctggtgcccgaggccgactacgtgtggcggatcatcctcatgttcggcaccgtcccggcggcgctcacctactactggcgcatgaagatgccggagacggcgaggtacaccgcgctcatcgcgcgcaacgccaagcaggccgccgccgacatgtccaaggtgctcgacacggagatccaggaggacgcggaccgcgccgaggcggtcgccgccggcggcgccggcaacgagtgggggctcttctcgcggcagttcgtgcggcggcacggggtgcacctggtggcgacgacgagcacgtggttcctgctcgacatcgcgttctacagccagaacctgttccagaaggacatcttctccaaggtcgggtggatcccgccggcgaggacgatgaacgccgtcgaggaggtgttccgcatcgcgcgcgcgcaggcgctcatcgcgctgtgcggcaccatcccgggctactggttcaccgtcgcgttcatcgacgtcgccggccgcttcgccatccagctgatggggttcgccatgatgaccgtcttcatgctcggcctcgccgcgccgtaccaccactggacgacgccggggaaccacaccggcttcgtcgtcatgtacggcttcaccttcttcttcgccaacttcggccccaacgccaccaccttcatcgtgccggcggagatctacccggcgaggctgcgttccacgtgccacggcatctcggcggcggcggggaaggccggcgccatcgtcggcgcgttcgggttcctgtacgcggcgcaggacccgcacaagccggaggccgggtacaagccaggcattggcatccggaacgcgctgttcgtgctcgccggcacgaacttcctcggcatgctcatgacgctgctggtgccggagtcgaagggcatgtcgctggaggaggtgtccaaggagaacgtcgccgacgacgaggaggcgacggcgtag

SEQ ID NO: 1527 - protein, 526 aa, Oryza sativa subsp
MADGQLKVLTTLDHARTQWYHFMAIVIAGMGFFTDAYDLFCISLVSKLLGRIYYTDLAGDNPGSLPPNVSAAVNGVALCGTLAGQLFFGWLGDKLGRKSVYGFTLVLMVVCSVASGLSFGRTAKGVVATLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLDTEIQEDADRAEAVAAGGAGNEWGLFSRQFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNATTFIVPAEIYPARLRSTCHGISAAAGKAGAIVGAFGFLYAAQDPHKPEAGYKPGIGIRNALFVLAGTNFLGMLMTLLVPESKGMSLEEVSKENVADDEEATA

SEQ ID NO: 1528 - DNA, 1527 bp, Oryza sativa subsp
  CDS (1)..(1527)
atggccggcaaccagcagctgcgggtgctgcacgccctggacattgcaaggacacagctgtaccatttcatcgcgatcgtgatcgccggtatgggcttcttcaccgacgcctacgacctcttctccatctcccttgtcgccgacctcctcggccacgtctactaccacggcgagctgccccggaacatccacgccgccgtcaccggcatcgcgctttgtggcaccgtccctggacagctcgtcttcggctggctaggcgacaaaatgggccggaagcgtgtctatggaatcaccctcctcctcatggttgtctcctctctcgcctccggactctccttcagtaagcacgaggggatgaacattatcgctgtgctttgcttcttccggttctggcttggcgtcagcatcggtggggattacccactctccgccaccatcatgtcagagtacgccaacaagaggactcgtggtgccttcattgctgctgtctttgctatgcaaggtttcggcaaccttgctgctgggatcattggaatgatagtatctgcagctttcaagcattcatcggcatcaaagattgactatgcctggcggataatcctcatgtttggcgccattcctgctgctctcacttaccactggcgcatgaagatgccagaaacagcacgttacactgccctcatctctaagaatgcaaagaaggccgccaaggacatgtctgccgtgctcaatgtcaacataaccccggacgatgaagttatcaatgagcttgcaaggcaggacgagtatggcctcttctcgttcgagtttctccaccgccatggcctccacctccttggcaccaccgtctgttggttcgtcctcgacgtcaccttctactcgctcaacattttcatgaagaatatcttcaccgaggtcggtcttcttcctcgtctagatagcgaataccaccataccctccagcggatgatcaccatgacagcagttcacacatttatctcgctttgcggtgcacttcccgggtacttcttcactgtcgccttcgttgatcgcatcggccgtgtcaagatccagctgattggattcaccatgatgactgttttcatgctttgtcttgcaattccttatgatcagtggctgaggcacaagaacaagtacggatttgcagtcatgtatggcctgaccttcttcttcgccaactttgggccaaatactacaaccttcataattccagctgagattttccctgcaaggctacggtccacatgccatgggatatctggtgcggttgggaagatcggtgcgattgtcggtgtgtttggtttcttgtacacagaataccatatcaggatctttctgtttgtccttattgggtgcaatcttgttggattcatcttcacccttctcttaccagagtcgaaagggaagtccctcgaggatctcactggggagattgaagagttccaggaggaagatgaaggaagtgaagttgctttgtctagacccatacatactgtgcctttatag

SEQ ID NO: 1529 - protein, 508 aa, Oryza sativa subsp
MAGNQQLRVLHALDIARTQLYHFIAIVIAGMGFFTDAYDLFSISLVADLLGHVYYHGELPRNIHAAVTGIALCGTVPGQLVFGWLGDKMGRKRVYGITLLLMVVSSLASGLSFSKHEGMNIIAVLCFFRFWLGVSIGGDYPLSATIMSEYANKRTRGAFIAAVFAMQGFGNLAAGIIGMIVSAAFKHSSASKIDYAWRIILMFGAIPAALTYHWRMKMPETARYTALISKNAKKAAKDMSAVLNVNITPDDEVINELARQDEYGLFSFEFLHRHGLHLLGTTVCWFVLDVTFYSLNIFMKNIFTEVGLLPRLDSEYHHTLQRMITMTAVHTFISLCGALPGYFFTVAFVDRIGRVKIQLIGFTMMTVFMLCLAIPYDQWLRHKNKYGFAVMYGLTFFFANFGPNTTTFIIPAEIFPARLRSTCHGISGAVGKIGAIVGVFGFLYTEYHIRIFLFVLIGCNLVGFIFTLLLPESKGKSLEDLTGEIEEFQEEDEGSEVALSRPIHTVPL

SEQ ID NO: 1530 - DNA, 1578 bp, Triticum aestivum
  CDS (1)..(1578)
atggcgactgaacagctcaacgtgttgaaagcactggacgttgccaagacgcagctgtaccatttcaaggcggtcgtgatcgccggcatgggcttcttcacggacgcctacgacctcttctgcatcgccctcgtcaccaagctgctggggcgcatctactacaccgaccctgcccttaacgagcccggccacctcccggcaaacgtgtcggccgccgtgaacggcgtggccctatgcggcacacttgccggccagctcttcttcggctggctcggtgacaagctcggccgcaagagcgtctacggcttcacgctcatcctcatggtcctctgctccatcgcgtccgggctatcgtttggacacgaggccaagggtgtaatggggacgctatgtttcttccgtttctggctcggcttcggtgtcggcggcgactaccctctgagcgccaccatcatgtcggagtatgctaacaagaagacccgcggcacctttatcgccgccgtgtttgccatgcaggggtttggcatcctatttggtactatcgtcacgatcatcgtctcgtccgcattccgacatgcattccctgcaccgccattctacatcgacgccgcggcgtccattggcccggaggccgactatgtgtggcgcatcatcgtcatgttcggcaccatcccggctgccctgacctactactggcgcatgaagatgcccgaaactgcgcggtacacagcactcatcgccggcaacacaaagcaagccacatcagacatgtccaaggtgctcaacaaggagatctcagaggagaacgtccagggtgagcgggccaccggtgatacctggggcctcttctcccgacagttcatgaagcgccacggggtgcacttgctagcgaccacaagcacttggttcctactcgatgtggccttctacagccagaacctgttccagaaggacatcttcaccaagatcgggtggatcccgccggccaagactatgaatgcattggaggagttgtaccgcatcgcccgcgcccaagcgctcatcgcgctctgtggcaccgtgcctggctactggttcaccgtcgccttcatcgacatcattgggaggttttggatccagctcatgggattcaccatgatgaccattttcatgctagcaatcgccataccgtacgactacttggtggagccagggcatcacaccggctttgtcgtgctctacgggctcactttcttcttcgccaacttcggccccaacagcacaaccttcatcgtgccagctgagatcttccctgcgaggctccgatccacatgccacggtatctctgctgctaccggtaaggcaggcgcgatcatcggtgcattcgggttcctgtatgcgtcacaggaccagaagaagcctgagaccggctactcacggggaatcggcatgcgcaacgctctcttcgtgctcgcgggcacaaacttcctgggtctgctcttttcgctgctggtgccggagtccaagggcaagtcgctggaggagctctccaaggagaacgttggcgacgatgactccattgccccaactggtgtctag

SEQ ID NO: 1531 - protein, 525 aa, Triticum aestivum
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEENVQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVEPGHHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDSIAPTGV

SEQ ID NO: 1532 - DNA, 1617 bp, Hordeum vulgare var
  CDS (1)..(1617)
atggcgcggtcggagcagcaggggctgcaggtgctgagcgcgctggacgcggccaagacgcagtggtaccacttcacggccatcgtcgtcgccggcatgggcttcttcaccgacgcctacgacctcttctgcatctccctcgtcaccaagctcctcggccgcatctactacaccgacctctccaagcccgaccccggctccctgccccccagcgtcgccgccgccgtcaacggcgtcgccttctgcggcaccctcgccggccagctcttcttcggctggctcggcgacaagatgggccgcaagagcgtctacggcatgaccctcctcctcatggtcatctgctccatcggctcgggcctctccttcgcgcacacacccaagagcgtcatggccacgctctgcttcttccgcttctggctcggcttcggcatcggcggcgactacccgctctcggccaccatcatgtccgagtacgccaacaagaagacccgcggcgcattcatcgccgccgtcttcgccatgcagggcttcggcatcctcgccggcggcatcgtcaccctcatcatctcatccgccttccgcgccgggttccacgagccggcctaccaggacgaccgcgtcgcgtccaccggcacggaggccgacttcgtgtggcgcatcatcctcatgctcggcgccctgccggccctgctcacctactactggcggatgaagatgcccgagacggcgcgctacaccgccctcgtcgccaagaacgccaagctggccgccgccgacatgtccaaggtgctgcaggtggagctggaggacgagacggagaagatggacgagatggtgagccgcggggcgaacgacttcggcctcttctcgccgcagttcgcgcggcgccacggcctccacctcgtcggcacggcgaccacgtggttcctgctggacatcgccttctacagccagaacctgttccagaaggacatcttcacgagcatcaactggatccccaaggcgcgcaccatgagcgcgcttgacgaggtgttccgcatctcccgcgcgcagacgctcatcgcgctctgcggcacagtgccgggctactggttcacggtcttcctcatcgacgtcgtcggccgcttcgccatccagctcatgggattcttcatgatgaccgtcttcatgctcggcctcgccgtgccgtaccaccactggacaacgccgggcaaccagatcggcttcgtggtcatgtacggcttcaccttcttcttcgccaacttcgggcccaacgcaaccaccttcgtcgtgccggcggagatcttcccggcgaggctgcgatcgacgtgccacgggatatcggcggccgcggggaaggccggagccatgatcggggcgttcgggttcctgtacgcggcgcaggacccgcacaagccggacgccgggtacaggcccgggatcggggtgcgcaactccctcttcgtgctcgccggggtcaacctgctggggttcatgttcaccttcctggtgccggaggccaacgggaagtcgctggaggagatgtccggcgaggcacaggacaacgagaacgaggaccaggcacgaaccgccgccgtgcagccgtccatggcctag

SEQ ID NO: 1533 - protein, 538 aa, Hordeum vulgare var
MARSEQQGLQVLSALDAAKTQWYHFTAIVVAGMGFFTDAYDLFCISLVTKLLGRIYYTDLSKPDPGSLPPSVAAAVNGVAFCGTLAGQLFFGWLGDKMGRKSVYGMTLLLMVICSIGSGLSFAHTPKSVMATLCFFRFWLGFGIGGDYPLSATIMSEYANKKTRGAFIAAVFAMQGFGILAGGIVTLIISSAFRAGFHEPAYQDDRVASTGTEADFVWRIILMLGALPALLTYYWRMKMPETARYTALVAKNAKLAAADMSKVLQVELEDETEKMDEMVSRGANDFGLFSPQFARRHGLHLVGTATTWFLLDIAFYSQNLFQKDIFTSINWIPKARTMSALDEVFRISRAQTLIALCGTVPGYWFTVFLIDVVGRFAIQLMGFFMMTVFMLGLAVPYHHWTTPGNQIGFVVMYGFTFFFANFGPNATTFVVPAEIFPARLRSTCHGISAAAGKAGAMIGAFGFLYAAQDPHKPDAGYRPGIGVRNSLFVLAGVNLLGFMFTFLVPEANGKSLEEMSGEAQDNENEDQARTAAVQPSMA

SEQ ID NO: 1534 - DNA, 1578 bp, Hordeum vulgare var
  CDS (1)..(1578)
atggcgactgaacagctcaacgtgttgaaagcactcgatgttgccaagacgcaactgtaccatttcaaggccgtggtgatcgccggcatgggcttcttcaccgacgcctacgacctcttctgcatcgcgcttgtcaccaagctgctggggcgcatctactacaccgatcctgctctcaacgagcccggccacctcccggcaaacgtgtcggccgccgtgaacggcgtggccctatgcggcacacttgccggccagctcttcttcggctggctcggtgacaagctcggccgcaagagcgtctacggcttcacgctcatcctcatggtcctctgctccatcgcgtcggggctctcgtttggacacgaggccaagggcgtaatggggactctatgtttcttccgcttctggctcggcttcggcgtcggcggcgactaccctctgagcgccaccatcatgtccgagtatgctaacaagaagacccgcggcacctttatcgccgccgtgtttgccatgcaggggtttggcatcctatttggtactattgttaccatcatcgtctcgtccgcattccgacatgcattccctgcaccgccattctacattgacgccgcggcatccattggtccggaggccgactacgtgtggcgcatcatcgtcatgttcggcaccatcccggccgccctgacctactactggcgcatgaagatgcccgaaactgcacggtacacagcactcatcgccggcaacacgaagcaagccacatcagacatgtccaaggtgctcaacaaggagatctcagaggaggctgggcagggtgagcgggccactggtgatacctggggcctcttctccaggcagttcatgaagcgccatggggtgcacttgctagcgaccacaagcacttggttcctgctcgatgtggccttctacagccagaacctgttccagaaggacatcttcaccaagatcgggtggatcccgccggccaagaccatgaatgcattggaggaattgtaccgcatcgcccgtgcccaagcgctcatcgcgctctgcggcacggtgccgggctactggttcaccgtcgccttcatcgacatcatcgggaggttctggatccagctcatgggattcaccatgatgaccattttcatgcttgcaatcgcgataccgtatgactacttggtgaaaccagggaaccacaccggcttcgtcgtgctttatgggctcactttcttcttcgccaacttcggccccaacagcacaaccttcatcgtaccggcagagatcttcccggcgaggctccggtcaacatgccacggtatatcggccgcaaccggtaaggcgggcgcgatcatcggcgcattcgggttcttgtatgcgtcgcaggaccagaagaagcctgagacagggtattcacggggaatcggcatgcgcaacgccctcttcgtgctcgctggcacaaactttctgggcctgctcttttccctgctggtgccggagtccaagggcaagtcgctcgaggagctctccaaggagaacgttggcgacgatgacgccattgccccaactggtgtctaa

SEQ ID NO: 1535 - protein, 525 aa, Hordeum vulgare var
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEEAGQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGNHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDAIAPTGV

SEQ ID NO: 1536 - DNA, 1610 bp, Hordeum vulgare
  CDS (19)..(1596)
gagagatcgccggcggcgatggcgactgaacagctcaacgtgctcaaagcactcgatgtggccaagacgcaactttaccatttcaaggccgtggtgattgccggcatgggcttcttcaccgacgcctacgacctcttctgcatcgcgctcgtcaccaagctgctggggcgcatttactacaccgatcctgccctcaacgagcccggccacctcccggcaaacgtgtcggccgccgtgaacggcgtggccctatgcggcacactcgccggccagctcttcttcggctggctcggcgacaagctcggccgcaagagcgtctacggcttcacgctcatcctcatggtcctctgctccatcgcgtcagggctctcgtttggacacgaggccaagggcgtgatggggactctatgtttcttccgcttctggctcggcttcggcgtcggcggcgacaaccctctgagcgccaccatcatgtcggagtatgctaacaagaagacccgcggcacctttatcgccgccgtgtttgccatgcaggggtttggcatcctatttggtactatcgttaccatcatcgtctcgtccgcattccgacatgcattccctgcaccgccattttacattgacgccgcggcatccattggcccggaggccgactacgtgtggcgcatcatcgtcatgttcggcaccatcccggccgccctgacctactactggcgcatgaagatgcccgaaactgcacggtacacagcacttatcgccggcaacacgaagcaagccacatcagacatgtccaaggtgctcaacaaggagatctcagaggaggctgcgcagggtgagcgggccactggtgatacctggggcctcttctcccggcagttcatgaagcgccacggggtgcacttgctagcgaccacaagcacttggttcctgctcgatgtggccttctacagccagaacctgttccagaaggacatcttcaccaagatcgggtggatcccgccggccaagacgatgaatgcattggaggagttgtaccgcatcgcccgtgcccaagcgctcatcgcgctctgcggcaccgtgccgggctactggttcaccgtcgccttcatcgacatcatcgggagattctggatccagctcatgggattcaccatgatgaccattttcatgcttgcaatcgcgataccgtatgactacttggtgaagccagggcaccataccggcttcgtcgtgctctacgggctcactttcttcttcgccaacttcggccccaacagcacaaccttcatcgtgccggccgagatcttcccggcgaggctccggtcaacatgccacggtatatcggccgcaacaggtaaggcgggcgcgatcatcggcgcattcgggttcttgtacgcgtcacaggaccagaggaagcccgagaccgggtattcacggggaatcggcatgcgcaatgcgctcttcgtgctcgctggcacgaactttctgggcctgctcttttccctgctggtgccggagtccaagggcaagtcgctcgaggagctctcgaaggagaacgtcggcgacgacgacgccattgccccaactggtgtctagagacatgcaggtgt

SEQ ID NO: 1537 - protein, 525 aa, Hordeum vulgare
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDNPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEEAAQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGHHTGFVVLYGLTFFFANFGPNSTTFIVPAEIFPARLRSTCHGISAATGKAGAIIGAFGFLYASQDQRKPETGYSRGIGMRNALFVLAGTNFLGLLFSLLVPESKGKSLEELSKENVGDDDAIAPTGV

SEQ ID NO: 1538 - DNA, 1584 bp, Hordeum vulgare var
  CDS (1)..(1584)
atggcgggcgaccaggtacacgtgctcgcggcgctggacggggccaagacgcagtggtaccacttcacggccatcgtcgtcgccggcatgggcttcttcaccgacgcctacgacctcttctgcatctccctcgtcaccaagctcatcggccgcatctactacaccgtcccgggctctcccagcccaggcagcctcccgccgaccgtctccgcggtcgtcaacggcgtggcgttcgtcggcacgctctcaggccagctcttcttcggctggctcggcgacaaggtcggccggaagagcgtgtacggcatgacgctgatgctgatgatcatctgctccgtcgcgtcggggctctcgttcggccgcacgcccaccagcgtcatggccacgctctgcttcttcagattctggctgggcttcgggatcggcggcgactacccgctctccgccaccatcatgtccgagtacgccaacaagcggacgcgcggggcgttcatcgccgccgtcttcgcgatgcaggggttcggcatcctcgccggcggcggcgtggcgatcgggatcacggcgctgttcagggccctcttcccggcgccgccgtacgcggcggacccggtggcatccaccccggaccaggcggactatgtgtggcgcatcgtgctcatgctcggcgcgctccccgccgcgctcaccttctactggcggatgaagatgccggagacgccgcggtacacggcgctcatcgccaagaacgccgagcgcgccgcggccgacatgtccaaggtgctcaacgtggagatcaccaaggagcaggccggcgacctggagaccgcgatctccatcaagtcccacacgtcgccgtcgttcggcctcttctccagggagttcatgcggcgtcacgggctccatctcttgggcacggcgtcgacctggctcctcctggacatcgcctactactcgcagaacctgttccagaaggacatcttcagcgccatcgggtggatccctccggcgccgacgatgagcgcgctggatgagctctaccacatcgcgcgcgcccagatcctgatcgcgctgtgcggcaccgtgccgggctactggttcaccgtcgccttcatcgactccgtcggccgcttcaagatccagctcatgggtttcttcatgatgacggcattcatgctcggcctcgccgggccgtacgactactggacgggccagggccaccaggtcgggttcgtcgtcatgtacgcgctgaccttcttcttcgccaacttcgggcccaacgcgaccaccttcatcgtccccgccgagatctacccggccaggttccgcgcgacgtgccacgggatatcggccgcgtcggggaaggtgggcgccatcatcggctccttcgggttcttgtacctggcccaaagccccgacccggccaagacagcccatggataccaccccggcatcggcgtgcgctactccctcttcgtgctcgccttgtgtagcttgctggggttcatgctcacgttcctcgttcccgagcccaagggcaagtcgctggaggagatgtcgcgcgagaccgagcccgatcattgctaa

SEQ ID NO: 1539 - protein, 527 aa, Hordeum vulgare var
MAGDQVHVLAALDGAKTQWYHFTAIVVAGMGFFTDAYDLFCISLVTKLIGRIYYTVPGSPSPGSLPPTVSAVVNGVAFVGTLSGQLFFGWLGDKVGRKSVYGMTLMLMIICSVASGLSFGRTPTSVMATLCFFRFWLGFGIGGDYPLSATIMSEYANKRTRGAFIAAVFAMQGFGILAGGGVAIGITALFRALFPAPPYAADPVASTPDQADYVWRIVLMLGALPAALTFYWRMKMPETPRYTALIAKNAERAAADMSKVLNVEITKEQAGDLETAISIKSHTSPSFGLFSREFMRRHGLHLLGTASTWLLLDIAYYSQNLFQKDIFSAIGWIPPAPTMSALDELYHIARAQILIALCGTVPGYWFTVAFIDSVGRFKIQLMGFFMMTAFMLGLAGPYDYWTGQGHQVGFVVMYALTFFFANFGPNATTFIVPAEIYPARFRATCHGISAASGKVGAIIGSFGFLYLAQSPDPAKTAHGYHPGIGVRYSLFVLALCSLLGFMLTFLVPEPKGKSLEEMSRETEPDHC

SEQ ID NO: 1540 - DNA, 1620 bp, Hordeum vulgare var
  CDS (1)..(1620)
atggcgagccggcagcagcagcagctgcaggtgctgagcgcgctggacggcgccaagacgcagttgtaccacttcagggcggtcgtcgtcgccggcatgggcttcttcaccgacgcctacgacctcttctgcatctcgctcgtcaccaagctcctcggccgcatctactacgccgacccctccagccccaaccctggatcgctgccgcccaacgtggccgcggccgtcaacggcgtcgcgctctgcggcaccctcgccggccagctcttcttcggctggctcggcgacaggctcggccggaagagcgtctacggcatgacgctcatcctcatggtcgtctgctccgtcgcctccgggctctcgttcgggcacaccccggccagcgtcatggccacgctctgtttcttccgcttctggctcggcttcggcatcggcggcgactaccctctgtccgccaccatcatgtccgagtacgccaacaagaagacgcgcggagccttcatcgcggccgtcttcgcaatgcagggcttcggcatcctcgccggcggcgtcgtcacgctagtcctctccacggttttccgtagcgcgttcccggcgccggcgtaccagaccgacgccgcagcgtccaccgtgccgcaggccgactatgtgtggcgcatcatcctcatgctcggcgcgctgcctgcggcgctcacgtactactggcgaacgaagatgccggagacggcgcggtacacggcgctggtcgcaaagaacgcgaagaaggcctcgctggacatgtccaaggtgctccagtcggaggtcgaggcggagccggagaagctggacgagatcatggccagaggcgaggactacggcctcttgacgtcgcggttcgccaagcgccacggcctccacctgctcggcacggcgacggcgtggttcctggtcgacgtcgcgtactacagccagaacctgttccagaaggacatcttcggcagcattggctggatccccaaggcgcgcacaatggacgcgctcgaggaggtgttccgcatctcccgcgcgcagacgctcatcgcgctctgcggcaccgtgccgggctactggttcaccgtgttcctcatcgacgtcatcggaaggttctggatccagctcgtggggttcgccatgatggctgttttcatgctcggcctcgcggtgccgtaccaccactggacgacgccgggcaaccacgtcggcttcgtcgtcatgtatgggctcaccttcttcttcgccaacttcgggccgaacgcgacgacgttcatcgtgccggccgagatcttcccggcgcggctccggtcgacctgccacggcatctccgctgcggcggggaaggccggtgccatcatcggggcgttcgggttcctctacgcggcacagtcgccggacctggcgcacgtggacgccgggtacaagcctgggatcggcgtgcagaaggcgttgtatgtgctcgctgcgtgcaacctcctggggttcttggtcacgttcctcgtgccggagtcgaaagggaagtcgctcgaggagatgtccggcgaggccgacgccgaggaaggcaacggcgccaataacgttcgcccgtcgggagagcagctggtttga

SEQ ID NO: 1541 - protein, 539 aa, Hordeum vulgare var
MASRQQQQLQVLSALDGAKTQLYHFRAVVVAGMGFFTDAYDLFCISLVTKLLGRIYYADPSSPNPGSLPPNVAAAVNGVALCGTLAGQLFFGWLGDRLGRKSVYGMTLILMVVCSVASGLSFGHTPASVMATLCFFRFWLGFGIGGDYPLSATIMSEYANKKTRGAFIAAVFAMQGFGILAGGVVTLVLSTVFRSAFPAPAYQTDAAASTVPQADYVWRIILMLGALPAALTYYWRTKMPETARYTALVAKNAKKASLDMSKVLQSEVEAEPEKLDEIMARGEDYGLLTSRFAKRHGLHLLGTATAWFLVDVAYYSQNLFQKDIFGSIGWIPKARTMDALEEVFRISRAQTLIALCGTVPGYWFTVFLIDVIGRFWIQLVGFAMMAVFMLGLAVPYHHWTTPGNHVGFVVMYGLTFFFANFGPNATTFIVPAEIFPARLRSTCHGISAAAGKAGAIIGAFGFLYAAQSPDLAHVDAGYKPGIGVQKALYVLAACNLLGFLVTFLVPESKGKSLEEMSGEADAEEGNGANNVRPSGEQLV

SEQ ID NO: 1542 - DNA, 1850 bp, Medicago truncatula
  CDS (29)..(1615)
agagagtcttccttttttttttaccaaaatgggattagaagtccttgaggctcttgattcagctcgtacacaatggtaccatgtaacagctatagtaattgctggcatgggattcttcactgatgcctatgatctgttctgcatttcaaccgtttcgaagctcttgggacgattatattactttgatccaagcactaacaaaccagggaagcttccaccatcagttaataatgtagtcaccggtgtggcccttgtcggaacactttctggccaattagtcttcggctggctcggagacaaacttggacgcaagaaagtttatggtgtcacactcattatcatggttgcttgtgccatttgctctggtctttcttttggttcttccgcgaaatctgttatgataaccctttgttttttcaggttttggcttggatttggtattggtggagactaccctttatcagcaaccatcatgtctgaatacgccaacaaaaggacacgaggcgctttcatagcagcagttttcgcaatgcaaggcgtgggaatcatctttgccggattggtttcaatggtattttcaggaatttttaaagcatactaccaggctccccgtttcaatgaagacccaattttatcaacacagcccgaaggggatttactctggcgattaattctcatgatcggtgctgttccagctgcgatgacttactactggagaatgaaaatgcctgaaaccggtcgttacactgcaatcgtagaagggaacgcgaaacaagccgctgcagacatggcaagagttttggacatcgaaatcatagcggagcaagataagttggctgaatttaaagcagcaaatgattaccctctttggtctagcgagtttttcaacaggcacggtcgtcatttaatcggtacaatgagttgttggttcttgttagatattgctttctacagtcagaatttgacacagaaagatatttaccctgcaatgggacttattcgtcaagacaaagaaatgaatgctattgatgaagttttccaaacttcgcgcgccatgtttgttgtcgccttgtttggaacattccccggttattggttcactgttttcttcattgaaaagcttggaagattcaagatacagttggttggtttcttcatgatgtctttcttcatgtttgtcattggtgttaaatatgaatacttgaaagacgaaaacaaaaacctcttcgctcttttatacgggctaacattcttcttcgcgaactttgggcctaatagtacaacttttgtgttgcccgctgagctttttcctacgcgggtgaggtcaacatgccatgctttcagtgctgcatctgggaaggcgggtgctatggttggtgcgttcgggatacaatactacacgttggatggtacgccaaggaagattagacgcgcaatgatgattctggcttttacaaatttgataggattcttttgcacgttcttggtgacggaaactaagggacgatctttggaagagatttcgggtgaggatggaagagagagtgaactcactgcaacaccaaatgacagggctccggggattcgccaggactcaagaactgagaagatgtgaatttaattacatgctgcaacatccatgtttgttttgataatattatattaatgtaataataataaataatggggccaaaattgatgtgtttagctggtttatgattataagatgaaccataagttatattttgttatgtgttgctgacagaaaaataaacttattgtaatgtttattttttaatgaaacttatatagtactttattgtaaacaaaaaaaaaaaaaaaaaaaaaaa

SEQ ID NO: 1543 - protein, 528 aa, Medicago truncatula
MGLEVLEALDSARTQWYHVTAIVIAGMGFFTDAYDLFCISTVSKLLGRLYYFDPSTNKPGKLPPSVNNVVTGVALVGTLSGQLVFGWLGDKLGRKKVYGVTLIIMVACAICSGLSFGSSAKSVMITLCFFRFWLGFGIGGDYPLSATIMSEYANKRTRGAFIAAVFAMQGVGIIFAGLVSMVFSGIFKAYYQAPRFNEDPILSTQPEGDLLWRLILMIGAVPAAMTYYWRMKMPETGRYTAIVEGNAKQAAADMARVLDIEIIAEQDKLAEFKAANDYPLWSSEFFNRHGRHLIGTMSCWFLLDIAFYSQNLTQKDIYPAMGLIRQDKEMNAIDEVFQTSRAMFVVALFGTFPGYWFTVFFIEKLGRFKIQLVGFFMMSFFMFVIGVKYEYLKDENKNLFALLYGLTFFFANFGPNSTTFVLPAELFPTRVRSTCHAFSAASGKAGAMVGAFGIQYYTLDGTPRKIRRAMMILAFTNLIGFFCTFLVTETKGRSLEEISGEDGRESELTATPNDRAPGIRQDSRTEKM

SEQ ID NO: 1544 - DNA, 1608 bp, Hordeum vulgare var
  CDS (1)..(1608)
atggcgcgcgagcagctggaggtgctgtcggcgctggacacggccaagacgcagtggtaccacttcacggcgatcgtcatcgccggcatgggcttcttcaccgacgcgtatgatctcttctgcatctcgctcgtcaccaagctgctcggccgcatctactactaccgcgagggtgccgacgcccccggctcgctgccgcccaacgtcgccgccgccgtcaacggcgtcgccttctgcggcacgctctcgggccagctcttcttcggctggctcggcgaccgcatgggccgcaagcgcgtctacggcatgaccctcatgtgcatggtgctctgctccatcgcctcgggcctctccttcggctccacccccggctccgtcatggccacgctctgcttcttccgcttctggctcgggtttgggatcggcggcgactacccgctctccgccaccatcatgtccgagtacgccaacaagaagacgaggggcgccttcatcgccgccgtattcgccatgcagggcttcggcatcctcaccggcggcgtcgtcacgctcatcgtgtccgccgcgttccgcgccgccttccacgcgcccgcctacgagaagggcgccgtcgcatccacgcccccgcaggccgacttcgtgtggcgcttcatcctcatgttcggcgccgtcccggccctgctcacctactactggcggatgaagatgcccgagacggcgcgctacacggcgctcgtcgccaagaacgccaagcaggccgcggccgacatgtccaaggtgctccaggtggagatcgccgccgaggacgaaaccaaggacaacgacggggccggcgaagaccgcaactcgttcgggctcttctccggcgagttccttcggcggcacgggctccacctcctcggcacggccacctgctggttcctcctcgacatcgccttctactcgcagaacctgttccagaaggacatcttcacggcgatcaactggatccccaaggccaagacgatgagcgccctcgaagaagtgcaccgcatcgcgcgcgcgcagacgctcatcgcgctctgcggcacggtgccgggctactggttcaccgtggccctcatcgaccggatcgggcggttctggatccagctcggcggattcttcttcatggcggtgttcatgctggggctggccttcccgtaccaccactggacgaccccgggcaaccacatcgggttcgtggtgctgtacgcgctcaccttcttcttcgccaacttcgggccaaactccaccacattcatcgtgccggcggagatcttcccggccaggctccggtcgacgtgccacggcatctccgccgccgccgggaagctgggcgccatcgtggggtcgttcgggttcctgtacctggcgcagaaccaggaccccagcaaggtggaccacgggtacaaggccggcatcggggtcaagaactcgctattcatcctcgccgcctgcaacttcctcggcatggccttcaccttctgcgcgcccgagtccaacggcatctcgctcgaggagctctccggcgagaacgacgacgaggcgccggcgccggcgacgcacgccaggacggtgcccgtgtga

SEQ ID NO: 1545 - protein, 535 aa, Hordeum vulgare var
MAREQLEVLSALDTAKTQWYHFTAIVIAGMGFFTDAYDLFCISLVTKLLGRIYYYREGADAPGSLPPNVAAAVNGVAFCGTLSGQLFFGWLGDRMGRKRVYGMTLMCMVLCSIASGLSFGSTPGSVMATLCFFRFWLGFGIGGDYPLSATIMSEYANKKTRGAFIAAVFAMQGFGILTGGVVTLIVSAAFRAAFHAPAYEKGAVASTPPQADFVWRFILMFGAVPALLTYYWRMKMPETARYTALVAKNAKQAAADMSKVLQVEIAAEDETKDNDGAGEDRNSFGLFSGEFLRRHGLHLLGTATCWFLLDIAFYSQNLFQKDIFTAINWIPKAKTMSALEEVHRIARAQTLIALCGTVPGYWFTVALIDRIGRFWIQLGGFFFMAVFMLGLAFPYHHWTTPGNHIGFVVLYALTFFFANFGPNSTTFIVPAEIFPARLRSTCHGISAAAGKLGAIVGSFGFLYLAQNQDPSKVDHGYKAGIGVKNSLFILAACNFLGMAFTFCAPESNGISLEELSGENDDEAPAPATHARTVPV

SEQ ID NO: 1546 - DNA, 1566 bp, Hordeum vulgare var
  CDS (1)..(1566)
atggcgactgaacagctcaacgtgttgaaagcgctcgatgttgccaagacgcaactgtaccatttcaaggccgtggtgatcgccggcatgggcttcttcaccgacgcctacgacctcttctgcatcgcgcttgtcaccaagctgctggggcgcatctactacaccgatcctgctctcaacgagcccggccacctcccggcaaacgtgtcggccgccgtgaacggcgtggccctatgcggcacacttgccggccagctcttcttcggctggctcggtgacaagctcggccgcaagagcgtctacggcttcacgctcatcctcatggtcctctgctccatcgcgtcggggctctcgtttggacacgaggccaagggcgtaatggggactctatgtttcttccgcttctggctcggcttcggcgtcggcggcgactaccctctgagcgccaccatcatgtccgagtatgctaacaagaagacccgcggcacctttatcgccgccgtgtttgccatgcaggggtttggcatcctatttggtactattgttaccatcatcgtctcgtccgcattccgacatgcattccctgcaccgccattctacattgacgccgcggcatccattggtccggaggccgactacgtgtggcgcatcatcgtcatgttcggcaccatcccggccgccctgacctactactggcgcatgaagatgcccgaaactgcacggtacacagcactcatcgccggcaacacgaagcaagccacatcagacatgtccaaggtgctcaacaaggagatctcagaggaggctgggcagggtgagcgggccactggtgatacctggggcctcttctccaggcagttcatgaagcgccatggggtgcacttgctagcgaccacaagcacttggttcctgctcgatgtggccttctacagccagaacctgttccagaaggacatcttcaccaagatcgggtggatcccgccggccaagaccatgaatgcattggaggaattgtaccgcatcgcccgtgcccaagcgctcatcgcgctctgcggcacggtgccgggctactggttcaccgtcgccttcatcgacatcatcgggaggttctggatccagctcatgggattcaccatgatgaccattttcatgcttgcaatcgcgataccgtatgactacttggtgaaaccagggaaccacaccggcttcgtcgtgctttatgggctcactttcttcttcgccaacttcggccccaacagcacaaccttcatcgtaccggcagagatcttcccggcgaggctccggtcaacatgccacggtatatcggccgcaaccggtaaggcgggcgcgatcatcggcgcattcgggttcttgtatgcgtcgcaggaccagaagaagcctgagacagggtattcacggggaatcggcatgcgcaacgccctcttcgtgctcgctggcacaaactttctgggcctgctcttttccctgctggtgccggagtccaagggcaagtcgctcgaggagctctccaaggagaacgtcggcgatgatggcatcgatgcttag

SEQ ID NO: 1547 - protein, 521 aa, Hordeum vulgare var
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEEAGQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGNHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDGIDA

SEQ ID NO: 1548 - DNA, 1464 bp, Oryza sativa subsp
  CDS (1)..(1464)
atggccggcaaccagcagctgcgggtgctgcacgccctggacattgcaaggacacagctgtaccatttcatcgcgatcgtgatcgccggtatgggcttcttcaccgacgcctacgacctcttctccatctcccttgtcgccgacctcctcggccacgtctactaccacggcgagctgccccggaacatccacgccgccgtcaccggcatcgcgctttgtggcaccgtccctggacagctcgtcttcggctggctaggcgacaaaatgggccggaagcgtgtctatggaatcaccctcctcctcaatggttgtctcctctctcgcctccggactctccttcacatcggtggggattacccactctccgccaccatcatgtcagagtacgccaacaagaggactcgtggtgccttcattgctgctgtctttgctatgcaaggtttcggcaaccttgctgctgggatcattggaatgatagtatctgcagctttcaagcattcatcggcatcaaagattgactatgcctggcggataatcctcatgtttggcgccattcctgctgctctcacttaccactggcgcatgaagatgccagaaacagcacgttacactgccctcatctctaagaatgcaaagaaggccgccaaggacatgtctgccgtgctcaatgtcaacataaccccggacgatgaagttatcaatgagcttgcaaggcaggacgagtatggcctcttctcgttcgagtttctccaccgccatggcctccacctccttggcaccaccgtctgttggttcgtcctcgacgtcaccttctactcgctcaacattttcatgaagaatatcttcaccgaggtcggtcttcttcctcgtctagatagcgaataccaccataccctccagcggatgatcaccatgacagcagttcacacatttatctcgctttgcggtgcacttcccgggtacttcttcactgtcgccttcgttgatcgcatcggccgtgtcaagatccagctgattggattcaccatgatgactgttttcatgctttgtcttgcaattccttatgatcagtggctgaggcacaagaacaagtacggatttgcagtcatgtatggcctgaccttcttcttcgccaactttgggccaaatactacaaccttcataattccagctgagattttccctgcaaggctacggtccacatgccatgggatatctggtgcggttgggaagatcggtgcgattgtcggtgtgtttggtttcttgtacacagaataccatatcaggatctttctgtttgtccttattgggtgcaatcttgttggattcatcttcacccttctcttaccagagtcgaaagggaagtccctcgaggatctcactggggagattgaagagttccaggaggaagatgaaggaagtgaagttgctttgtctagacccatacatactgtgcctttatag

SEQ ID NO: 1549 - protein, 487 aa, Oryza sativa subsp
MAGNQQLRVLHALDIARTQLYHFIAIVIAGMGFFTDAYDLFSISLVADLLGHVYYHGELPRNIHAAVTGIALCGTVPGQLVFGWLGDKMGRKRVYGITLLLNGCLLSRLRTLLHIGGDYPLSATIMSEYANKRTRGAFIAAVFAMQGFGNLAAGIIGMIVSAAFKHSSASKIDYAWRIILMFGAIPAALTYHWRMKMPETARYTALISKNAKKAAKDMSAVLNVNITPDDEVINELARQDEYGLFSFEFLHRHGLHLLGTTVCWFVLDVTFYSLNIFMKNIFTEVGLLPRLDSEYHHTLQRMITMTAVHTFISLCGALPGYFFTVAFVDRIGRVKIQLIGFTMMTVFMLCLAIPYDQWLRHKNKYGFAVMYGLTFFFANFGPNTTTFIIPAEIFPARLRSTCHGISGAVGKIGAIVGVFGFLYTEYHIRIFLFVLIGCNLVGFIFTLLLPESKGKSLEDLTGEIEEFQEEDEGSEVALSRPIHTVPL

SEQ ID NO: 1550 - DNA, 1626 bp, Oryza sativa subsp
  CDS (1)..(1626)
  misc_feature (188)..(188): n is a, g, c or t
atgggaaggcaggaccagcagctgcaggtgctgaacgcgctcgacgcggccaagacgcaatggtaccacttcacggcgatcatcgtcgccggcatggggttcttcaccgacgcctacgacctcttctgcatctcgctcgtcaccaagcttctcggccgcatctactacaccgaccccgccagccccanccccggctcgctgccgcccaacatcgccgccgcggtgaatggcgtcgcgctctgcggcaccctctccggccagctcttcttcggatggctcggcgacaagctcggccgcaagagcgtctacgggatgacgctgctgctcatggtgatttgctccatcgcctcagggctctccttctcgcacacgccgacgagcgtcatggccacgctctgcttcttccgcttctggctcggcttcggcatcggcggtgactacccgctgagcgccaccatcatgtccgagtacgccaacaagaagacccgcggcgcgttcatcgccgccgtcttcgccatgcaggggttcggcatcctcgccggcggcgttgtcacgctcgccatgtccgcggggttccaggccgcgttcccggccccagcgtacgaggtcaatgccgctgcgtccaccgtgccgcaggccgactacgtgtggcgcatcatcctgatgctcggtgcgctgccggccatactgacgtactactggcggatgaagatgccggagacggcgcggtacacggcgctcgtcgccaaggacgcgaagcaggcgtcgtcggacatggccaaggtgctgcaggtggaaatcgaggtggaggaggagaagctccaggacatcacgaggggcagggactacggcctcttctcggcgcggttcgccaagcgccatggcgcgcacctcctgggcacggcggcgacgtggttcctcgtcgacgtcgcgtactacagccagaacctgttccagaaggacatcttcaccagcatccactggatccccaaggcgcgcaccatgagcgagctcgaggaggtgttccgcatctcccgcgcgcagacgctcatcgcgctctgcggcaccgtgccgggctactggttcaccgtcttcctcatcgacatcatcggccgcttcaagatccagctcctcggcttcgccgggatgacggcgttcatgctcggcctcgccatcccgtaccaccactggaccatgcctggcaaccaggtcatcttcgtcttcctctacggcttcaccttcttcttcgccaactttgggccgaacgcgacgacgttcatcgtgccggccgagatcttcccggcgcgtctccggtcaacctgccacggcatctccgccgcgtccggcaaggccggcgcgatcatcggagcattcggtttcctctacgcggcgcagccacaggacaaggcgcatgtcgacgccggctacaaacctgggattggcgtgcggaacgcgctcttcgtgctcgccgggtgcaacctcgttgggttcctcatgacatggatgctcgtgccggaatcgaaagggaagtcgctggaggagatgtccggcgaggccgacgacgaggaagcttctgccaacggcggtgccaccgccgtcaactcgtccggagttgagatggtgtaa

SEQ ID NO: 1551 - protein, 541 aa, Oryza sativa subsp
  misc_feature (63)..(63): The Xaa at location 63 stands for Asn, Ile, Ser, or Thr.
MGRQDQQLQVLNALDAAKTQWYHFTAIIVAGMGFFTDAYDLFCISLVTKLLGRIYYTDPASPXPGSLPPNIAAAVNGVALCGTLSGQLFFGWLGDKLGRKSVYGMTLLLMVICSIASGLSFSHTPTSVMATLCFFRFWLGFGIGGDYPLSATIMSEYANKKTRGAFIAAVFAMQGFGILAGGVVTLAMSAGFQAAFPAPAYEVNAAASTVPQADYVWRIILMLGALPAILTYYWRMKMPETARYTALVAKDAKQASSDMAKVLQVEIEVEEEKLQDITRGRDYGLFSARFAKRHGAHLLGTAATWFLVDVAYYSQNLFQKDIFTSIHWIPKARTMSELEEVFRISRAQTLIALCGTVPGYWFTVFLIDIIGRFKIQLLGFAGMTAFMLGLAIPYHHWTMPGNQVIFVFLYGFTFFFANFGPNATTFIVPAEIFPARLRSTCHGISAASGKAGAIIGAFGFLYAAQPQDKAHVDAGYKPGIGVRNALFVLAGCNLVGFLMTWMLVPESKGKSLEEMSGEADDEEASANGGATAVNSSGVEMV

SEQ ID NO: 1552 - DNA, 1650 bp, Oryza sativa subsp
  CDS (1)..(1650)
  misc_feature (219)..(219): k is g or t
atggctccgatcggcgtgctcacggcgctggaccaggcgcggacgcagtactaccacttcaaggccatcgtcatcgccggcatgggactcttcaccgactcctacgacctcttctgcatcgcgcccgtcatgaagatcgtgggccgggtgtactactccgacggcggcgcccgtccgggggttacgccgccggccgtcgtgtcggcgaccgtcggagtkgcgctgctgggcgcggtgatcgggaacgtggtgttcggcgcgctgggcgaccgcgtggggcggcgccgcgtctacggcgcgtgcctgctgctgatgctccgtcgggagcggcttctccgtgtgccggacgcgccggtgcgcgctcgccagcctctgcttcttccgttcctcctcggcgtcggcgtcggcggcgactacccgctgtcggccaccatcatgtcggagttcgccaaccggcgcacccgcggcgcgttcatcgccgccgtgttctccatgcaggggttcggcatcctcgccagctccgcggtcaccatggccgtcgccgccgccttcgaccactacaccggctaccccgcgccgctcgacacgccggagtgcgccgacctcgcctggcggatcattctcatggccggcgccgtccccgccgcgctgacgtactactggaggatgtccatgccggagacggccagatatacggctttggtggagcgcgacgtggtgaaggccaccaacgacatcggccgcgttctggccgacctcgacctgggcgccgtcgccgaggaggaggtggcggcggcgttgagccggcctccgccgccgccgcgcccttcgtacggcctcctctctcggcgcttcgtccggcagcacgggcgggacctgttcgcgtgcgcggcggcgtggttcctcctcgacatcccctactacagcagcacgctgttccagtctcagatctaccggccgctgttcccggcgccggggctcatcaacgcgttccaggaggcgttcaacgtggccaagttccaggccgtcatcgccgtcgcctccaccatcccgggctacttcgtcgccgtgctcctcatcgaccgcgtcggccggcggtgcctccagatggccgggttcctcctcatggccgtcttcctcttcgcgctcgcgggtccgtacgacggatactggcgcgaccacggcgcgcacgccggctacatcgtgctctactcgctcaccttcttctccgccaacctcgggccgaacaccaccaccttcatcctgccggcggagctcttcccggcgcgcttccggtcgacgtgccacggcctctccggcgcggcggggaagctcggcgcgctcgtcggctccatcggcttcctgtgggcgtcgcagcagaaggacggcgcggcggccgggcacctgccgggcatcggcatgatgtacgcgctgttcgttcttggcgggatctgcctgctcgggctggcactcacctacgtgttcacgccggagacgatgatgcggtcgctggaggagaacgagagcgacagggcgcagacccaggtcggcgacggcggcagcgacaccgaggcggccaagagcccggcgtccatggcgagctcgcacctcagcatgtcgcccatccttccagcccgggtctccgtgtga

SEQ ID NO: 1553 - protein, 549 aa, Oryza sativa subsp
MAPIGVLTALDQARTQYYHFKAIVIAGMGLFTDSYDLFCIAPVMKIVGRVYYSDGGARPGVTPPAVVSATVGVALLGAVIGNVVFGALGDRVGRRRVYGACLLLMLRRERLLRVPDAPVRARQPLLLPFLLGVGVGGDYPLSATIMSEFANRRTRGAFIAAVFSMQGFGILASSAVTMAVAAAFDHYTGYPAPLDTPECADLAWRIILMAGAVPAALTYYWRMSMPETARYTALVERDVVKATNDIGRVLADLDLGAVAEEEVAAALSRPPPPPRPSYGLLSRRFVRQHGRDLFACAAAWFLLDIPYYSSTLFQSQIYRPLFPAPGLINAFQEAFNVAKFQAVIAVASTIPGYFVAVLLIDRVGRRCLQMAGFLLMAVFLFALAGPYDGYWRDHGAHAGYIVLYSLTFFSANLGPNTTTFILPAELFPARFRSTCHGLSGAAGKLGALVGSIGFLWASQQKDGAAAGHLPGIGMMYALFVLGGICLLGLALTYVFTPETMMRSLEENESDRAQTQVGDGGSDTEAAKSPASMASSHLSMSPILPARVSV

SEQ ID NO: 1554 - DNA, 1749 bp, Oryza sativa subsp
  CDS (1)..(1749)
  misc_feature (312)..(312): y is t or c
  misc_feature (377)..(377): m is a or c
  misc_feature (1044)..(1044): r is g or a
  misc_feature (1518)..(1518): m is a or c
atggcgccgaggatacgggtgctcgcggcactggaccaggcgcggacgcagtactaccacttcaaggccatcgtcatcgccggcatgggcctcttcaccgactcctacgacctcttctgcatctcgccggtcatgaagatcttcgggcgggtgtactacgcgccatcgggatcagtagacggcagcggcagcggccccggggtgacgccgccggccgtcgtgtcggccaccgtcggcgtggcgctgctgggcgcggtggccgggaacgtggtgttcggcgcgctgggcgaccgcgtggggcggcgccgcgtytacggcgcgtgcctgctgctgatggtgtgcagctccgtcgggagcggcctctccgtgtgccggamgcgccggtgcgcgctcgccagcctctgcttcttccgcttcctcctcggcgtcggcgtcggcggcgactacccgctgtcggccaccatcatgtcggagttcgccaaccggggcacccgcggcgcgttcatcgccgccgtgttctccatgcaggggttcggcatcctcgtcagctccgccgtcaccatggccgtcgccgccgccttcgaccactacaccggctaccccgcgccgctcgacacgccggagtgcgccgacctcgcctggcggatcatactcatggccggcgccgtccccgccgcgctgacgtactactggaggatgtccatgccggagacagccaggtatacggcgctggtggagcgcgacgtggtgaaggccaccaacgacatcggccgcgtcctggccgacctcgacctggccgccgtcgccgaggaagaggtggcggcggcggcgttgagcccgcctccggtgacgacgccgccgccgccgcgcccttcgtacggcctcttctcgcgccgcttcgtccggcagcatgggagagacctgttcgcgtgcgcggcggcgtggttcctcctcgacatcccctactacagcagcacgctgttccagtcgcagatctaccggccatggttcccgccggcggcgaaggtgaacgcgttccaggargcgttcaacgtggccaagttccaggccgtcatcgccgtcgcctccaccatcccgggctacttcgccgccatgctcctcatcgagcgcgccggccggcggcgtctccagatggccgggttcctcctcatggccgtcttcctcttcgcgctcgcgggtccctacgatggatactggcgcgaccacgccaagaccgccggctacatcgtgctctactcgctcaccttcttctccgccaacctcgggcccaacaccaccaccttcatcctgccggcggagctcttcccggcgcgcttccggtcgacctgccacggcctgtccggagcggcggggaagctcggcgcgctcgtcggctccatcggcttcctgtgggcgtcgcagcagaaggacggcgcggcggccgggcacctgccgggcatcggcatgatgtacgcgctgttcgttcttggcgggatctgcctgctcgggctggcgctmacctacgcgttcacgccggagacgatgacgcggtcgctggaggagaacgagagcagcgtgcaggcgcagagccaggtcggcgacggcggcagcgatgccggcaatggcagtgatgggctgcgcttccacgaactaaatgttctcatggaggcggcgaccaagagccctgtgtccatggcgagctcgcacctcagcatgtcgcctatccttccgcaccggatgtctctatga

SEQ ID NO: 1555 - protein, 582 aa, Oryza sativa subsp
  misc_feature (126)..(126): The Xaa at location 126 stands for Lys, or Thr.
MAPRIRVLAALDQARTQYYHFKAIVIAGMGLFTDSYDLFCISPVMKIFGRVYYAPSGSVDGSGSGPGVTPPAVVSATVGVALLGAVAGNVVFGALGDRVGRRRVYGACLLLMVCSSVGSGLSVCRXRRCALASLCFFRFLLGVGVGGDYPLSATIMSEFANRGTRGAFIAAVFSMQGFGILVSSAVTMAVAAAFDHYTGYPAPLDTPECADLAWRIILMAGAVPAALTYYWRMSMPETARYTALVERDVVKATNDIGRVLADLDLAAVAEEEVAAAALSPPPVTTPPPPRPSYGLFSRRFVRQHGRDLFACAAAWFLLDIPYYSSTLFQSQIYRPWFPPAAKVNAFQEAFNVAKFQAVIAVASTIPGYFAAMLLIERAGRRRLQMAGFLLMAVFLFALAGPYDGYWRDHAKTAGYIVLYSLTFFSANLGPNTTTFILPAELFPARFRSTCHGLSGAAGKLGALVGSIGFLWASQQKDGAAAGHLPGIGMMYALFVLGGICLLGLALTYAFTPETMTRSLEENESSVQAQSQVGDGGSDAGNGSDGLRFHELNVLMEAATKSPVSMASSHLSMSPILPHRMSL

SEQ ID NO: 1556 - DNA, 1638 bp, Oryza sativa subsp
  CDS (1)..(1638)
  misc_feature (612)..(612): n is a, g, c or t
  misc_feature (614)..(614): n is a, g, c or t
  misc_feature (617)..(617): n is a, g, c or t
atggttcaggatcgcaaggtgctcgacgcgctggacacggcgaagacgcagtggtaccacttcacggcggtggtgatcgccggcatgggcttcttcaccgacgcctacgacctcttctccatctccctcgtcaccaagctgctcggccgcatctactacttcaacccggcgtccaagagccccggctccctcccgcccaacgtctccgccgccgtcaatggcgtcgccttctgcggcacgctcgccggccagctcttcttcggctggctcggcgacaagatggggcgcaagaaggtgtacgggatgacgctcatgctcatggtcatctgctgcctcgcctccggcctctcgttcgggtcgtcggcgaaaggcgtcatggccacgctctgcttcttccgcttctggcttgggttcggcatcggtggcgactacccgctctcggcgaccatcatgtcggagtatgctaacaagcgtacccgtggcgcgttcatcgccgccgtgttcgccatgcagggcttcggcaacctcaccggcggcatcgtggccatcatcgtgtccgccgcgttcaagttgcggttcgacgcgccggcgtacagggacgaccgggccggntncancgctgactacgcgtggcgcatcgtgctcatgttcggcgccatcccggcgctgctcacctactactggcggatgaagatgccggagacggcgcgctacaccgcgctggtcgccaagaacgacaagaaggcagccgccgacatggcgcgcgttctcaacgtcgagctcgtcgacgagcaggagaaggcagcggcggcgacggcggcggctgcggaggaggaggcagcacggcgcgagcagtacgggctcttctcccgggaattcgcacggcgccatggccaccacctgctgggcacgacggtgtgctggttcgtgctggacatcgcctactactcgcagaacctgttccagaaggacatctacacggcggtgcagtggctgcccaaggcggacaccatgagcgccctggaggagatgttcaagatctcccgggcacagacgctcgtggcgctgtgcggcaccatcccgggctactggttcaccgtcctcttcatcgacatcgtcggccgcttcgccatccagctcggcggcttcttcctcatgacggcgttcatgctcggcctcgccgtgccgtaccaccactggacgacgccggggaaccacgtcggcttcgtggtcatgtacgccttcaccttcttcttcgccaacttcgggccaaactccacgaccttcatcgtgccggccgagatcttcccggcgaggctgcgttccacctgccacggcatctcgtcggcggccgggaagatgggcgccatcgtcgggtcgttcgggttcttgtacgccgcgcagagcaccgacccgagcaagacggacgccggctacccgcggggcatcggcgtgcgcaactcgctgttcctgctcgccggatgcaacgtcgtcggcttcttgttcacgttcttggtgccagagtcgaaggggaagtcgctggaggagctctccggcgagaacgaaatggaggctgagccggcggcagcaactaactcctacaggcagaccgtccctgacagcggacagtccgagtaa

SEQ ID NO: 1557 - protein, 545 aa, Oryza sativa subsp
  misc_feature (205)..(205): The Xaa at location 205 stands for Cys, Phe, Ser, or Tyr.
  misc_feature (206)..(206): The Xaa at location 206 stands for Asn, Ile, Ser, or Thr.
MVQDRKVLDALDTAKTQWYHFTAVVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKLRFDAPAYRDDRAGXXADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIYTAVQWLPKADTMSALEEMFKISRAQTLVALCGTIPGYWFTVLFIDIVGRFAIQLGGFFLMTAFMLGLAVPYHHWTTPGNHVGFVVMYAFTFFFANFGPNSTTFIVPAEIFPARLRSTCHGISSAAGKMGAIVGSFGFLYAAQSTDPSKTDAGYPRGIGVRNSLFLLAGCNVVGFLFTFLVPESKGKSLEELSGENEMEAEPAAATNSYRQTVPDSGQSE

SEQ ID NO: 1558 - DNA, 1581 bp, Oryza sativa subsp
  CDS (1)..(1581)
  misc_feature (386)..(386): n is a, g, c or t
  misc_feature (786)..(786): n is a, g, c or t
  misc_feature (805)..(805): n is a, g, c or t
  misc_feature (1476)..(1476): n is a, g, c or t
atggcggacgggcagctcaaggtactgacgacgctggaccatgcgaggacgcagtggtaccatttcatggcgatcgtgatcgccggcatgggcttcttcaccgacgcctacgacctcttctgcatctccctcgtctccaagctgctcggccgcatctactacaccgacctcgccggggacaaccccggcagcctgccgcccaacgtgtcggcagcggtgaacggcgtcgcgctgtgcggcacgctcgcggggcagctcttcttcgggtggctcggcgacaagctcgggcggaagagcgtgtacggcttcacgctcgtgctcatggtggtgtgctccgtcgcgtcgggcctctcgttcgggcgcacggcgaagggcgtcgtcgccangctctgcttcttccggttctggctcggcttcggcatcggcggcgactacccgctgtcggcgacgatcatgtcggagtacgccaacaagaggacgcgcggggcgttcatcgccgccgtgttcgccatgcaggggttcggcatcctgttcggcgccatcgtggcgctcgtcgtgtcggccgggttccggaacgcgtacccggcgccgtcgtacgccgacggccgcgcggcgtcgctggtgcccgaggccgactacgtgtggcggatcatcctcatgttcggcaccgtcccggcggcgctcacctactactggcgcatgaagatgccggagacggcgaggtacaccgcgctcatcgcgcgcaacgccaagcaggccgccgccgacatgtccaaggtgctcganacggagatccaggaggacncggaacgcgccgaggcggttgccgccggcggcgccggcaacgagtgggggctcttctcgcggcagttcgtgcggcggcacggggtgcacctggtggcgacgacgagcacgtggttcctgctcgacatcgcgttctacagccagaacctgttccagaaggacatcttctccaaggtcgggtggatcccgccggcgaggacgatgaacgccgtcgaggaggtgttccgcatcgcgcgcgcgcaggcgctcatcgcgctgtgcggcaccatcccgggctactggttcaccgtcgcgttcatcgacgtcgccggacgcttcgccatccagctgatggggttcgccatgatgaccgtcttcatgctcggcctcgccgcgccgtaccaccactggacgacgccggggaaccacaccggcttcgtcgtcatgtacggcttcaccttcttcttcgccaacttcggccccaacgccaccaccttcatcgtgccggcggagatctacccggcgaggctgcgttccacgtgccacggcatctcggcggcggcggggaaggccggcgccatcgtcggcgcgttcgggttcctgtacgcggcgcaggacccgcacaagccggaggccgggtacaagccaggcattggcatccggaacgcgctgttcgtgctcgccggcacgaanttcctcggcatgctcatgacgctgctggtgccggagtcgaagggcatgtcgctggaggaggtgtccaaggagaacgtcgccgacgacgaggaggcgacggcgtag

SEQ ID NO: 1559 - protein, 526 aa, Oryza sativa subsp
  misc_feature (129)..(129): The Xaa at location 129 stands for Arg, Lys, Met, or Thr.
  misc_feature (262)..(262): The Xaa at location 262 stands for Asp, or Glu.
  misc_feature (269)..(269): The Xaa at location 269 stands for Ala, Pro, Ser, or Thr.
  misc_feature (492)..(492): The Xaa at location 492 stands for Asn, or Lys.
MADGQLKVLTTLDHARTQWYHFMAIVIAGMGFFTDAYDLFCISLVSKLLGRIYYTDLAGDNPGSLPPNVSAAVNGVALCGTLAGQLFFGWLGDKLGRKSVYGFTLVLMVVCSVASGLSFGRTAKGVVAXLCFFRFWLGFGIGGDYPLSATIMSEYANKRTRGAFIAAVFAMQGFGILFGAIVALVVSAGFRNAYPAPSYADGRAASLVPEADYVWRIILMFGTVPAALTYYWRMKMPETARYTALIARNAKQAAADMSKVLXTEIQEDXERAEAVAAGGAGNEWGLFSRQFVRRHGVHLVATTSTWFLLDIAFYSQNLFQKDIFSKVGWIPPARTMNAVEEVFRIARAQALIALCGTIPGYWFTVAFIDVAGRFAIQLMGFAMMTVFMLGLAAPYHHWTTPGNHTGFVVMYGFTFFFANFGPNATTFIVPAEIYPARLRSTCHGISAAAGKAGAIVGAFGFLYAAQDPHKPEAGYKPGIGIRNALFVLAGTXFLGMLMTLLVPESKGMSLEEVSKENVADDEEATA

SEQ ID NO: 1560 - DNA, 1605 bp, Oryza sativa subsp
  CDS (1)..(1605)
atgggcggcggcggcggggagcagcagcagcttgaggtgctccacgccctgaacgtggccaagacgcaatggtaccatttcacggccatcgtggtggccggaatggggttcttcaccgacgcctatgacctcttctgcatctccctcgtcaccaagctgctgggccgcatctactaccgcgtcgacgggtccccgtcccccggcacgctccccccgcacgtctccgcctgcgtcaacggcgtggccttcgtgggcacgctctcagggcaactcttctttggctggctgggcgacaagctcggccgtaagcgcgtctatggcatcaccctcatgctcatggtgctctgctccctcgcctccgcgctctcctttggccacaccccgacctccgtcatggccaccctctgcttcttccgcttctggctcggcttcggcatcggcggcgactacccgctctccgccaccatcatgtccgagtacgccaacaagaagacgcgtggcgccttcatcgccgccgtcttcgcgatgcagggcttcggcatcatcaccggcggcctcgtcgccatcctcgtctccgcctccttcagggccgccttcccggcgcctccctacggcgaggaccccgtggcctccacgccgccgcaggccgacttcgtgtggaggatcatactcatgctgggcgcgctgccggcggcgctcacctactactggcgcaccaagatgcccgagacggcgcgctacacggcgctcgtggccaccaacgccaagcaggccgcggccgacatgtccaaggtgctgcaggtggtggagatgcgtaatattggtaataatggtggcagcaggaggccgttcgggctgttctccggcgagtttgtccggcggcacgggctgcacctggtgggcacgtcggcgacgtggttgctgctggacattgcgttctacagccagaacctgttccagaaggacatattcagcgcggtggggtggatccccaaggcggcgactatgagcgcgctggaggagctgttccgcatcgcgcgggcgcagacgctgatcgcgctgtgcgggacggtgcccggctactggttcaccgtcacgctcatcgaagtggtgggccgtttcaagatccaggccgttggcttcttcatgatgaccctcttcatgctcaccctcgccctgccgtaccaccactggacggcgccggggaagaaccacgtcggcttcctgctgctctacggcctcaccttcttcttcgccaacttcggccccaactccaccaccttcatcgtgccggcggagattttcccggcgcggctgcgggccacgtgccacggcatctcggcggcgtcggggaagctgggcgccatcgtcggatccttcgggttcctgtacctggcgcagagccccgaccggagcaagacggagcacgggtaccctccgggcatcggcgtccgcaactcgctcttcctgctcgccgcctgcaacctgctgggcctgctcttcaccttcctcgtgccggagtccaaggggaagtcgctggaggagatgtccggcgacgccgaggcccaggaggaggcgccgccgcccctgcaaactgtactgtag

SEQ ID NO: 1561 - protein, 534 aa, Oryza sativa subsp
MGGGGGEQQQLEVLHALNVAKTQWYHFTAIVVAGMGFFTDAYDLFCISLVTKLLGRIYYRVDGSPSPGTLPPHVSACVNGVAFVGTLSGQLFFGWLGDKLGRKRVYGITLMLMVLCSLASALSFGHTPTSVMATLCFFRFWLGFGIGGDYPLSATIMSEYANKKTRGAFIAAVFAMQGFGIITGGLVAILVSASFRAAFPAPPYGEDPVASTPPQADFVWRIILMLGALPAALTYYWRTKMPETARYTALVATNAKQAAADMSKVLQVVEMRNIGNNGGSRRPFGLFSGEFVRRHGLHLVGTSATWLLLDIAFYSQNLFQKDIFSAVGWIPKAATMSALEELFRIARAQTLIALCGTVPGYWFTVTLIEVVGRFKIQAVGFFMMTLFMLTLALPYHHWTAPGKNHVGFLLLYGLTFFFANFGPNSTTFIVPAEIFPARLRATCHGISAASGKLGAIVGSFGFLYLAQSPDRSKTEHGYPPGIGVRNSLFLLAACNLLGLLFTFLVPESKGKSLEEMSGDAEAQEEAPPPLQTVL

SEQ ID NO: 1562 - DNA, 1608 bp, Solanum tuberosum
  CDS (1)..(1608)
atggctaaaaatcaattacaagtactaaatgctcttgatgttgctaaaacacaattgtaccattttacagcaattgtgatagcaggaatgggatttttcactgatgcatatgaccttttctgcatttcacttgtgactaaattgcttggtcgaatttactatcatcatgaaggtgcacctaagccaggaattctccctcctggtatctcagctgcagtcaatggagtcgcgtttgttgggacactctcgggccagctgtttttcggatggctaggtgataagatgggaaggaaaagagtttatggaatgactctcatgatcatggttatttgctcgattgcatcgggtctttcttttggtaagacccctagtggtgtgattgctacattatgtttttttcgattttggcttggttttggtattggtggtgattaccctttatcagcaacgatcatgtctgaatacgctaataagaagactcgtggagcttttatagctgcagtattcgcgatgcaaggatttgggattttggcaggagggattgttgcacttgttgttagtggtgcatttaaaaacgcgtatcctgctccaatttattctgtcaataatgaaggctcaacccctcaagaggctgatattgtatggagaatcatactcatgtttggtgctataccggctttgcttacttattattggcgtatgaagatgcctgagacagcgcgttacacagctttagtagctaagaatgctactaaggctgcttccgatatgtctaaagtgttgaatgttgaaattgaagcagaggatgataagattgagaagattgttgcaatacaggggaataatttcgggttgtttagtaaggagtttcttcatcgtcatgggctgcatttgcttggaacaactagtacatggtttttactagatatcgctttttatagtcagaatctttttcagaaggatatatttagtaaaatcggatggatacctcatccagagacgatgaacgcgttggatgaggtattcaaaattgcaaaggcacaaactcttattgctctttgtagtactgtacctggttactggtttactgttgcattcatcgatagaatgggtcgatttgcaattcaattgatggggtttttcttcatgacagtgtttatgttcgcgttagccataccatataatcattggactaaaaaggaaaacagatttggttttgtggtgatgtactcacttacctttttcttcgcgaattttggtccaaatgccacaacttttgttgtacccgcggagatttttccagctaggttgagatcaacgtgccacgggatatcagctgcagctgggaaagctggtgcaattgttggtgcatttggttttctgtatgctgctcaatctactgatccatctaaagtcgacgcgggttatccaactggaattggtgtgaaaaatgcacttattgtgttaggttgtgtgaattttcttggaatgttgttcacattattagtgccagaatcaaaaggaaaatcattggaagaaatgtcaaaggaaaatgaaggagaagaggaaatgactaaggtggaaaatgcacaaacgattccagtttaa

SEQ ID NO: 1563 - protein, 535 aa, Solanum tuberosum
MAKNQLQVLNALDVAKTQLYHFTAIVIAGMGFFTDAYDLFCISLVTKLLGRIYYHHEGAPKPGILPPGISAAVNGVAFVGTLSGQLFFGWLGDKMGRKRVYGMTLMIMVICSIASGLSFGKTPSGVIATLCFFRFWLGFGIGGDYPLSATIMSEYANKKTRGAFIAAVFAMQGFGILAGGIVALVVSGAFKNAYPAPIYSVNNEGSTPQEADIVWRIILMFGAIPALLTYYWRMKMPETARYTALVAKNATKAASDMSKVLNVEIEAEDDKIEKIVAIQGNNFGLFSKEFLHRHGLHLLGTTSTWFLLDIAFYSQNLFQKDIFSKIGWIPHPETMNALDEVFKIAKAQTLIALCSTVPGYWFTVAFIDRMGRFAIQLMGFFFMTVFMFALAIPYNHWTKKENRFGFVVMYSLTFFFANFGPNATTFVVPAEIFPARLRSTCHGISAAAGKAGAIVGAFGFLYAAQSTDPSKVDAGYPTGIGVKNALIVLGCVNFLGMLFTLLVPESKGKSLEEMSKENEGEEEMTKVENAQTIPV

SEQ ID NO: 1564 - DNA, 1665 bp, Glomus intraradices
  CDS (1)..(1566)
atgtctacatccgatagagtaacaattgatgtcgataaacgtagagcggctctcaaagagattgatgatgcaaaatttggctggcaacatattcgtgcgtgtttggtagctggtaccggcttttttatggacgcgtacgatctttttgctatcaattttgcctctactatgatagggtacgtctattatggtggtaaaactcctgcaaatatcgacttgggtttgaaagtgtcaggttctattggcactttacttggtcaattatttttcggttatttggcagatcgtcttgggagaaagaagatgtatggtgttgaattaatgatcattattgttgcgacagttgcttcatcgttggccggtcaaagtcgtgctgttacagtagtcggtattatcatgttttggcgtgttgtaatgggtgtcggtattggaggagattatcctctttccgcaattattacatctgaattcgccacaaaaaaaagaagaggtgctatgatggcctcagtatttgctatgcaaggatttggaattttaggctctgctattgtagcacttatcgttttggcagcttttagaagtgcaattatcgccgatgtttctgctgttgattattgttggcgtatagtgctcggttgtggtgctattcccggtattgcggctctatacttccgtctcacaattccagaaaccccacgatatactatggacgtagaacacgatgtcaacaaagcaacttcggacgtcgccaactatttgcaaaaaactgacacaacagatgaaaatgatggaccaggcaatcatgtcggtgtaccaaaagcaagctggtcggatttcacaagttattttggaaaatggaaaaatggaaaagttttactaggaacctctatgtcatggttcgcgttggatattgctttttatggaatcggtcttaataacggaattattttgagtgctattggctacgctgacacacatgatgcagattttaatctaagggcttataattcactcaaaaatatggctcttggtaatattattatcactattatgggaaccgttcctggttattgggttactgtagcttttgttgataaatggggtagaaaacctattcaaataatgggtttcgctgtcctcactgtactatttattgtcatgggtgctgcctttaatccactcaaagaacattctattccagcttttatcgtcttattcacattgttgcagttcttccaaaattttggtcccaacacaacaacattcatcgttccaggggaagttttcccaacacgttacagatcaactggtcatggtatatcagctgcatccggaaaacttggagctattgttgctcaagttggtttctcaaaactaaaagacattggtggaccaaacgcatttgttggacaattgcttttaatctttgccgcatggatgtttattgggggtttattctcaatactcattcctgaaacaaaaggtttgtctcttgaagaattagcaaatgaagaccatgatttcaacgttgaagaaaggaaagaaagagtaaaggcggaagcataataaaatctacacataatatatctaatataaacacacattcaacatataaaatttttttattcttttacattacgataaattgggagaatataaaaatcc

SEQ ID NO: 1565 - protein, 521 aa, Glomus intraradices
MSTSDRVTIDVDKRRAALKEIDDAKFGWQHIRACLVAGTGFFMDAYDLFAINFASTMIGYVYYGGKTPANIDLGLKVSGSIGTLLGQLFFGYLADRLGRKKMYGVELMIIIVATVASSLAGQSRAVTVVGIIMFWRVVMGVGIGGDYPLSAIITSEFATKKRRGAMMASVFAMQGFGILGSAIVALIVLAAFRSAIIADVSAVDYCWRIVLGCGAIPGIAALYFRLTIPETPRYTMDVEHDVNKATSDVANYLQKTDTTDENDGPGNHVGVPKASWSDFTSYFGKWKNGKVLLGTSMSWFALDIAFYGIGLNNGIILSAIGYADTHDADFNLRAYNSLKNMALGNIIITIMGTVPGYWVTVAFVDKWGRKPIQIMGFAVLTVLFIVMGAAFNPLKEHSIPAFIVLFTLLQFFQNFGPNTTTFIVPGEVFPTRYRSTGHGISAASGKLGAIVAQVGFSKLKDIGGPNAFVGQLLLIFAAWMFIGGLFSILIPETKGLSLEELANEDHDFNVEERKERVKAEA

SEQ ID NO: 1566 - DNA, 1578 bp, Triticum aestivum
  CDS (1)..(1578)
atggcgactgaacagctcaacgtgttgaaagcactcgatgttgccaagacgcaactgtaccatttcaaggcggtcgtgatcgccggcatgggcttcttcacggacgcctacgacctcttctgcatcgccctcgtcaccaagctgctggggcgcatctactacaccgaccctgccctcaacgagcccggccacctcccggcaaacgtgtcggccgccgtgaacggcgtggccctgtgcggcacacttgccggccagctcttcttcggctggctcggtgacaagctcggccgcaagagcgtctacggcttcacgctcatcctcatggtcctctgctccatcgcgtccgggctctcgcttggacacgaggccaagggcgtaatggggacgctatgtttcttccgcttctggcttggcttcggcgtcggcggcgactatcctctgagcgccaccatcatgtcggaatatgctaacaagaagacccgcggcacctttatcgccgctgtgtttgccatgcaggggtttggcatcctatttggtactattgtcacgatcatcgtctcgtccgcattccgacatgcattccctgcaccgccattctacattgacgccgcggcgtccattggcccggaggccgactacgtgtggcgcatcatcgtcatgttcggcaccatcccggccgccctgacctactactggcgtatgaagatgcccgaaactgcgcggtacacagcactcatcgccggcaacacgaagcaagccacatcagacatgtccaaggtgctcaacaaggagatctcagaggagaatgtgcagggtgagcgtgccactggtgatacttggggcctcttctcgcgacagttcatgaagcgccacggggtgcacttgctagcgaccacaagcacttggttcctgctcgatgtggccttctacagccagaacctgttccaaaaggacatcttcaccaagatcgggtggatcccgccggccaagactatgaatgcattggaggagttgtaccgcatcgcccgcgcccaagcgctcatcgcgctctgcggcaccgtgcccggctactggttcaccgtcgccttcatcgacattattgggaggttttggatccagctcatgggattcaccatgatgaccattttcatgctcgcaatcgccataccttacgactacttggtgaagccagggcaccacaccggcttcgtcgtgctctacgggctcactttcttcttcgccaacttcggccccaacagcacaaccttcattgtgccagccgagatcttccctgcgaggctccggtccacatgccacggtatctctgccgctaccggtaaggcgggcgcgatcatcggcgcgttcgggttcctgtatgcgtcgcaggaccagaagaagcccgagaccggctactcacgggggatcggcatgcgcaacgcactctttgtgctcgcaggcacaaacttcctgggcctgctcttttccttgttggtgccagagtctaagggcaagtcgcttgaggagctctccaaggagaacgtcggcgacgacgacaccattgttccgactggtgtctag

SEQ ID NO: 1567 - protein, 525 aa, Triticum aestivum
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSLGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEENVQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGHHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDTIVPTGV

SEQ ID NO: 1568 - DNA, 1617 bp, Oryza sativa subsp
  CDS (1)..(1617)
atggccggcgagctcaaggtgctgaacgcgctcgactcggcgaagacgcagtggtaccatttcacggcgatcgtgatcgccggcatgggcttcttcaccgacgcctacgacctcttctccatctccctcgtcaccaagctgctcggccgcatctactacttcaacccggcgtccaagagccccggctctctcccgcccaacgtctccgccgccgtcaatggcgtcgccttctgcggcaccctcgccggccagctcttcttcggctggctcggcgacaagatggggcgcaagaaggtgtacgggatgacgctcatgctcatggtcatctgctgcctcgcctccggcctctcgttcgggtcgtcggcgaaaggcgtcatggccacgctctgcttcttccgcttctggctcggcttcggcatcggcggcgactacccgctctcggcgaccatcatgtcggagtatgctaacaagcgtacccgtggcgcgttcatcgccgccgtgttcgccatgcaggggttcggcaacctcaccggcggcatcgtggccatcatcgtgtccgccgcgttcaaggcgaggttcgacgcgccggcgtacagggacgaccgggccggctccaccgtgccgcaggccgactacgcgtggcgcatcgtgctcatgttgggcgccatcccggcgctgctcacctactactggcggatgaagatgccggagacggcgcgctacaccgcgctggtggccaagaacgcgaagcaggccgccgccgacatgacgcaggtgctcaacgtcgagatcgtggaggagcaggagaaggccgacgaggtcgcgcggcgcgagcagttcgggctcttctcccgccagttcttgagacgccatgggcgccacctgctgggcacgacggtgtgctggttcgtgctggacatcgccttctactcgtcgaacctgttccagaaggacatctacacggcggtgcagtggctgcccaaggcggacaccatgagcgccctggaggagatgttcaagatctcccgggcacagacgctcgtggcgctgtgcggcaccatcccgggctactggttcaccgtcttcttcatcgacatcatcggccgcttcgtcatccaactcggcggcttcttcttcatgacggcgttcatgctcggcctcgccgtgccgtaccaccactggacgacgccggggaccacatcgggcttcgtggtcatgtacgccttcaccttcttcttcgccaacttcgggcccaactccacgaccttcatcgtgccggcggagatcttcccggcgaggctgcgttccacctgccacggcatctcggcggcggcggggaaggccggcgccatcgtcgggtcgttcgggttcctgtacgcggcgcagagcacggacgcgagcaagacggacgccggctacccgccgggcatcggcgtgcgcaactcgctcttcttcctcgccggatgcaacgtcatcggcttcttcttcacgttcctggtgccggagtcgaaggggaagtcgctggaggagctctccggcgagaacgaggacgatgacgatgtgccggaggcgccctcgacggccgatcaccggactgcgccggcgccgccagcttga

SEQ ID NO: 1569 - protein, 538 aa, Oryza sativa subsp
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKARFDAPAYRDDRAGSTVPQADYAWRIVLMLGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGTTSGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPSTADHRTAPAPPA

SEQ ID NO: 1570 - DNA, 1975 bp, Pholiota nameko
  CDS (31)..(1686)
ccctttcttccgtcgtcttatctcgccaaaatggccagctatcaggaaaagagctccgaccgcgactcgcacgagaaggtagtccctgcgaactcaggctacgtgctaggcgagcgtcgtcgcgctgcactggccgaggtcgataacgccaaattttcttggttccatgctaaagtttgcattgtcgccggggtcggcttcttcaccgatgcctacgacatttttgctatcaacatcgcctcaacgatgttgggatatgtttacggatcgggaaagcctggcgcactcaaggctctcaacaagcagcaggatcttggtgtaaaggttgctacccccgtcggtactttggtcggtcaacttttgtttggatggcttgcggatctccttggacgcaagaagatgtatggtgttgagttgatgatcataattattgcgacattcgcgcaggccctgtccgaaaatgctcctgctgttcacatcattggtgttctggttgtatggcgcttcataatgggggtgggcatcggaggcgattatccccttagcgccgtcatctcttctgagttcgcatccaccaagatacgtggtcgtatgatgaccgcggtgtttgcttctcaaggctggggcaatttcaccgctgctctcgttggtttcatcattaccgctgcttacaagtcctccatccttaaggaagcttcaatcacaaacctgcactccgtcgacgtcatgtggcgcctcctcatcggtctcggtgctgttcccggtgttgtagcattgtacttccgtttgaccatccccgagacccctcgattcaccatggatatcgagcgcaacattgatcaagcagccactgatattcaagccgttctcgctggaaggaaaagccatgtcgacgatgatgccttcatccaacgcattgaggcacccaaagctagctgggctgacttcagagagcacttcgggaaatttgaaaacttcaagattcttttcggtacagcttattcctggttcgcgctggacatagcattttacggcctgggattgaattccggtatcatcttgcaagccattggtttcgggaacccgacgagcactggcacccaagccatctacgacaacttgaagaacatttgcgtgggaaatttgattctttcggctgccggcttgatccctggatactgggtcagcttcctcttcatcgacaagtggggacgcaagcctatccaactcatgggattcatcgctctcactatcctcttcgtcatcttgggcttcggctacgacaagttgatctccaccccctcttccaaaaaggccttcgtcttcctctactgtctcgcagatttcttccagaattttggaccaaatactaccacgtttgtgatacctggagagattttccccactcgttaccgttccaccgcccacggtatatctgctgccagcggcaagcttggggctattgtcgcccaagtcggtttcagtcagctcaaggatattggcgggcctagcgcatgggtaaagcacattctcgaaatctttgctttcttcatgttgactggtatcggctcaacactcctcctccccgagaccaagaacaggactctcgaagatttatcaaacgaaaaccaagaaggcttcgtgcggggaacgtcgaacaagacagcagttatcactgatgcttgattttcatactctatttcccttctatcacctttatgtacgctttccttgttataccgcctcatgtacttaataccgctcaaaaacggacccctcacttttctggatcacaatgctatctttcttaccgaattagcgggttggattaaaggcaaaagcgactattattatccacacacgatatacagatcctttcgttcattcttgctgtgatttcgagatcccgagtaattggcgcgtaggattgaaatgaagagacattaagtttcccttggaacagggtggcagacaa

SEQ ID NO: 1571 - protein, 551 aa, Pholiota nameko
MASYQEKSSDRDSHEKVVPANSGYVLGERRRAALAEVDNAKFSWFHAKVCIVAGVGFFTDAYDIFAINIASTMLGYVYGSGKPGALKALNKQQDLGVKVATPVGTLVGQLLFGWLADLLGRKKMYGVELMIIIIATFAQALSENAPAVHIIGVLVVWRFIMGVGIGGDYPLSAVISSEFASTKIRGRMMTAVFASQGWGNFTAALVGFIITAAYKSSILKEASITNLHSVDVMWRLLIGLGAVPGVVALYFRLTIPETPRFTMDIERNIDQAATDIQAVLAGRKSHVDDDAFIQRIEAPKASWADFREHFGKFENFKILFGTAYSWFALDIAFYGLGLNSGIILQAIGFGNPTSTGTQAIYDNLKNICVGNLILSAAGLIPGYWVSFLFIDKWGRKPIQLMGFIALTILFVILGFGYDKLISTPSSKKAFVFLYCLADFFQNFGPNTTTFVIPGEIFPTRYRSTAHGISAASGKLGAIVAQVGFSQLKDIGGPSAWVKHILEIFAFFMLTGIGSTLLLPETKNRTLEDLSNENQEGFVRGTSNKTAVITDA

SEQ ID NO: 1572 - DNA, 1632 bp, Lupinus albus
  CDS (1)..(1632)
atggctagggagcatattcatgtgctaaatgcacttgatgtggcaaaaacacaatggtaccatttcactgcaattatcattgcaggaatgggtttcttcactgatgcatatgacctgttctgcatatctcttgttacaaaattgctgggccgaatttactaccacgttgatggcgcagggaagcctggtacattgcctccaaatgtatcagctgctgtaaatggtgtagccttctgtggaacactttctggtcagcttttcttcggttggctcggtgataagatgggccgaaaaaaagtgtatggcatgaccctgatgattatggttatttgctcaattggttcaggcctttcttttggacatagtccaaattctgtgttggcaactctttgctttttcaggttctggcttggatttggtattggtggagattatcctctttctgctaccataatgtctgagtattctaataagaagactcgcggctcgttcattgctgcggtctttgctatgcaaggttttggaattttgggaggtgggatattcgcaattataatttcggctgcgtttaaggccaggtttgatgctccagcttatgaggttgatccagttggttcaactgttccacaagcagattatatttggaggataattgttatggtaggagcacttccagcagcattgacttactattggcgaatgaagatgcctgaaactgcacgttacacagcgcttgttgcaaagaatgcacaacaagccgcagcagatatgtctaaggttctacaagtcgagattcaatctgaaacaaataaagaagaggcgcagggaaaaccatcatttggcttgttctccaaggaattccttcgacgccatggactacatttacttggcactgcaggcacatggttcttgcttgatattgcattctacagtcagaatctattccaaaaagatattttcagcgcaataggttggatccctcctgccaaaacaatgaatgctcttgatgaagtttatcgaattgcgagggcgcaaacgcttatcgctctttgcagtacagttccaggatactggttcacagttgccttaattgacaggattggaaggtttgctatacaattgatgggattcttcttcatgacagtcttcatgttcgctctcgccattccttatgatcactggactcataaggataaccgaatcggctttgtggtcatttattcactaaccttcttcttcgcgaattttgggcctaatgctacaacatttgttgtccctgcagagattttccctgccagattccggtccacttgccacggaatatcatcagcatccggtaagcttggggctatagttggtgcattcggattcttgtacttggcacagaacaaggacaagagtaaaacagatgcagggtaccctgcaggtattggtgtgaagaattcactgattgtgttaggtgtagttaatattttaggcttctgctttactttcttggtgcctgagccaaatggaaaatctttggaagagatgtctggtgagaatgaagaggaagaaccaaccaaggaaggttcatacaacaacaacaacaacaacaacaacaacaacaacagaactgttccatatgtttag

SEQ ID NO: 1573 - protein, 543 aa, Lupinus albus
MAREHIHVLNALDVAKTQWYHFTAIIIAGMGFFTDAYDLFCISLVTKLLGRIYYHVDGAGKPGTLPPNVSAAVNGVAFCGTLSGQLFFGWLGDKMGRKKVYGMTLMIMVICSIGSGLSFGHSPNSVLATLCFFRFWLGFGIGGDYPLSATIMSEYSNKKTRGSFIAAVFAMQGFGILGGGIFAIIISAAFKARFDAPAYEVDPVGSTVPQADYIWRIIVMVGALPAALTYYWRMKMPETARYTALVAKNAQQAAADMSKVLQVEIQSETNKEEAQGKPSFGLFSKEFLRRHGLHLLGTAGTWFLLDIAFYSQNLFQKDIFSAIGWIPPAKTMNALDEVYRIARAQTLIALCSTVPGYWFTVALIDRIGRFAIQLMGFFFMTVFMFALAIPYDHWTHKDNRIGFVVIYSLTFFFANFGPNATTFVVPAEIFPARFRSTCHGISSASGKLGAIVGAFGFLYLAQNKDKSKTDAGYPAGIGVKNSLIVLGVVNILGFCFTFLVPEPNGKSLEEMSGENEEEEPTKEGSYNNNNNNNNNNNRTVPYV

SEQ ID NO: 1574 - DNA, 2083 bp, Lupinus albus
  CDS (44)..(1663)
aagccaccaaggtccagtttagctttcacttccaaatctagctatggctcgtgatgaactgagtgttctcactgcccttgatgtagccaagacacaatggtaccacttcactgcaatcatcgttgctggtatgggtttcttcacagatgcatacgatcttttcagcatagctaacgttaccaaattactcggaagaatatactacacacaccaaggtgcaccaaagccaggaaccctgcccccaaacgtgtccttagcagttaatggtgttgcactttgtggcactttaacaggccaagtattctttggttggcttggggacaaaatgggaagaaaaaaagtttatgggctaactcttgccatcatggttttcgcttctcttgcatctggcctttcattcggccacaccgcaaagggtacagtatccaccctttgtttcttccggttctggcttgggttcggcatcggtggtgactatcctctttctgccaccatcatgtcagagtatgccaacaagaagactcgcggcgcgttcattgccgcggtctttgctatgcagggctttggaattttgtttggtggcattgtttcgcttgtaatttcgactattttcgatcacgcttatagcgccccagcctatgaggttgatgcagaggcgtcactagtgcctcaagctgactatgtctggcgcataattttgatgcttggtgctttacctgctgcactcacttactactcgcgaatgaaaatgcctgagactgcgaggtataccgcgctcgttgcaaggaatgcgaaacaagcggcacaagacatgtcaaaggtgttgcaagttgaaattgaagcagagcaggacatggtggacaagttatccgagcgtgacaacaacaactttggtttgtttacaaaggaatttgctaaaaggcatgggaagcacttgattggaacatgtactacttggtttctactagatattgcttattacagttcaaatctcttccagaaagacatttactcgagtatcgggtggcttcctccagcgaaagaaatgaatgcaattcatgaagttttcagggtttccaaagcgcaagtgcttatagcactatgtggcactgttccaggatactggttcacagtggcattcattgaccacttaggccgtttcttcatccaacttatgggtttcttcttcatgactgttttcatgtttgcacttgctatcccatatgaccattggaccaagaaagacaacagaattgggtttcttgtcatgtatgcactgactttcttctttgccaattttggtccaaattctaccacttttgtggtgccagcggagattttcccggccaggttgaggtctacctgccatgggatatcatcggccgccgggaaagctggcgcgattgtgggagcatttgggttcttgtatgcatcacagagcaaggatgctacaaaaagagatgttgggtaccctgctggtattggaatgaagaacacacttattgtgcttgctgtgtgcaactgtcttggcatgtttttcacgttcttggtgcctgaatcaaaaggaaaatcattggaggagttgagtggtgagaatgaagatgaaggaactaatgaaacttctcagcaaccagctgcctccaatagaactgttcctgtatgatgatattataattgtttttgatggcatctcatcaaattaaggtggctaaggtgaaatcaattatcattgtataataaatattatcatcaaagtttgcacaaactatgcatagccctagtgtctacaaacaatatctaaatcacttccccaaacatgtttcgcactcatcaaaatatgacaggaatggggtgttaggaacaacatatcattgtccccacaaattaggcaaagtttaatatatgtgtagaacattagttttttttggttttgtttatagtcgttgaggtcttgagaactatgtttgaaattagaacttgtgtttgcctttatctttcctgctttgctcaaatttaatgttcacagtttagagttaaatttcgaaataaaataaataataataataaaaaaaaaaaaaaaaaa

SEQ ID NO: 1575 - protein, 539 aa, Lupinus albus
MARDELSVLTALDVAKTQWYHFTAIIVAGMGFFTDAYDLFSIANVTKLLGRIYYTHQGAPKPGTLPPNVSLAVNGVALCGTLTGQVFFGWLGDKMGRKKVYGLTLAIMVFASLASGLSFGHTAKGTVSTLCFFRFWLGFGIGGDYPLSATIMSEYANKKTRGAFIAAVFAMQGFGILFGGIVSLVISTIFDHAYSAPAYEVDAEASLVPQADYVWRIILMLGALPAALTYYSRMKMPETARYTALVARNAKQAAQDMSKVLQVEIEAEQDMVDKLSERDNNNFGLFTKEFAKRHGKHLIGTCTTWFLLDIAYYSSNLFQKDIYSSIGWLPPAKEMNAIHEVFRVSKAQVLIALCGTVPGYWFTVAFIDHLGRFFIQLMGFFFMTVFMFALAIPYDHWTKKDNRIGFLVMYALTFFFANFGPNSTTFVVPAEIFPARLRSTCHGISSAAGKAGAIVGAFGFLYASQSKDATKRDVGYPAGIGMKNTLIVLAVCNCLGMFFTFLVPESKGKSLEELSGENEDEGTNETSQQPAASNRTVPV

SEQ ID NO: 1576 - DNA, 1968 bp, Lupinus albus
  CDS (142)..(1764)
acacaaaaaaacacttctacattgttcttcaatatctctttcttttcttcatctcatcataaatcataaccttctcttctactattttcagtgaagggaaagaatttgtaaagagtgaaaaagtaattttggcttcaagtaatggctagggagcatattcatgtgctaaatgcacttgatgtggcaaaaacacaatggtaccattcactgcaaattatcattgcaggaatgggtttcttcactgatgcatatgacctgttctgcatatctcttgttacaaaattgctgggccgaatttactaccacgttgatggcgcagggaagcctggtacattgcctccaaatgtatcagctgctgtaaatggtgtagccttctgtggaacactttctggtcagcttttcttcggttggctcggtgataagatgggccgaaaaaaagtgtatggcatgaccctgatgattatggttatttgctcaattggttcaggcctttcttttggacatagtccaaattctgtgttggcaactctttgctttttcaggttctggcttggatttggtattggtggagattatcctctttctgctaccataatgtctgagtattctaataagaagactcgcggctcgttcattgctgcggtctttgctatgcaaggttttggaattttgggaggtgggatattcgcaattataatttcggctgcgtttaaggccaggtttgatgctccagcttatgaggttgatccagttggttcaactgttccacaagcagattatatttggaggataattgttatggtaggagcacttccagcagcattgacttactattggcgaatgaagatgcctgaaactgcacgttacacagcgcttgttgcaaagaatgcacaacaagccgcagcagatatgtctaaggttctacaagtcgagattcaatctgaaacaaataaagaagaggcgcagggaaaaccatcatttggcttgttctccaaggaattccttcgacgccatggactacatttacttggcactgcaagcacatggttcttgcttgatattgcattctacagtcagaatctattccaaaaagatattttcagcgcaataggttggatccctcctgccaaaacaatgaatgctcttgatgaagtttatcgaattgcgagggcgcaaacgcttatcgctctttgcagtacagttccaggatactggttcacagttgccttaattgacaggattggaaggtttgctatacaattgatgggattcttcttcatgacagtcttcatgttcgctctcgccattccttatgatcactggactcataaggataaccgaatcggctttgtggtcatttattcactaaccttcttcttcgcgaattttgggcctaatgctacaacatttgttgtccctgcagagattttccctgccagattccggtccacttgccacggaatatcatcagcatccggtaagcttggggctatagttggtgcattcggattcttgtacttggcacagaacaaggacaagagtaaaacagatgcagggtaccctgcaggtattggtgtgaagaattcactgattgtgttaggtgtagttaatattttaggcttctgctttactttcttggtgcctgagccaaatggaaaatctttggaagagatgtctggtgagaatgaagaggaagaaccaaccaaggaaggttcatacaacaacaacaacaacaacaacaacagaactgttccatatgtttaggtcttatgttagtgtccatctatagtgttaattagtagaataaaacagtgcctttaggtgagaacaaaacctttcccttcccttctaaactcttcatgtttaaccttgcctactcattttgtaacaggaactgttagttctatggatagtggaaaattttatagagatttctcatcatgtgtaaccaaaaaaaaaaaaaaaaaa

SEQ ID NO: 1577 - protein, 540 aa, Lupinus albus
MAREHIHVLNALDVAKTQWYHSLQIIIAGMGFFTDAYDLFCISLVTKLLGRIYYHVDGAGKPGTLPPNVSAAVNGVAFCGTLSGQLFFGWLGDKMGRKKVYGMTLMIMVICSIGSGLSFGHSPNSVLATLCFFRFWLGFGIGGDYPLSATIMSEYSNKKTRGSFIAAVFAMQGFGILGGGIFAIIISAAFKARFDAPAYEVDPVGSTVPQADYIWRIIVMVGALPAALTYYWRMKMPETARYTALVAKNAQQAAADMSKVLQVEIQSETNKEEAQGKPSFGLFSKEFLRRHGLHLLGTASTWFLLDIAFYSQNLFQKDIFSAIGWIPPAKTMNALDEVYRIARAQTLIALCSTVPGYWFTVALIDRIGRFAIQLMGFFFMTVFMFALAIPYDHWTHKDNRIGFVVIYSLTFFFANFGPNATTFVVPAEIFPARFRSTCHGISSASGKLGAIVGAFGFLYLAQNKDKSKTDAGYPAGIGVKNSLIVLGVVNILGFCFTFLVPEPNGKSLEEMSGENEEEEPTKEGSYNNNNNNNNRTVPYV

SEQ ID NO: 1578 - DNA, 1905 bp, Sesbania rostrata
  CDS (89)..(1711)
acctcttcatccccaacacaactcatcttctgactgacaatacaagcaggaaacttgtaatcactgatttggggtagcagagttagtgatggctggaggtggaggacaactaggagtgcttaatgcactcgatgtggccaagacacaatggtaccacttcactgcaattgtgattgctggaatgggtttcttcacagatgcctatgatcttttttgcatttcccttgtcaccaagttgctgggacggatatattacacagattataacaaaccaaagcctggtgttcttcctcctaatgtgcaagctgctgtgactggtgttgcactatgtggcactttagctggccagcttttctttggttggcttggtgacaagttgggaagaaaaaaggtttatgggataacacttatgctcatggtagtgtgttccattgcctcggggctatcttttgggtcaagtgcaaagggtgtcatggccacactttgtttcttcaggttttggcttggatttgggattggtggtgattaccctctttcagctacaatcatgtctgaatatgccaacaaaaagacacgaggggcatttattgctgcagtgtttgctatgcaaggatttggaatcatggctggtggaattgttgccttgattgtctcatctgcatttgaccacaaatacaaggttcctgcttatcaagaagatgcaaaagcatcaatggtgttacctgcctttgattatgtttggcgtatcattttgatgtttggtgcagttccagctgctcttacctactactggcgtatgaaaatgccagagacagctcgttacacagcccttgttgcaaagaatgcaaaacaagctgcttcagacatgtctaaggtgttacaagttgaaattgaagctgaagaggacaaggtgcagcacttgattgagagtcaaaaccaaacatttggtttgttcagcaaggaatttgctaaacgccacgggctgcacttggtaggaaccacaactacttggttcttattggacattgccttctatagtcagaaccttttccaaaaggacattttcactgccattggatggatccctcctgcaaaagaaatgaatgcaatccatgaggtttataggattgcaagagcacaaacacttatagcattgtgcagtactgtgccagggtactggtttacagtggccttcattgattacatgggccgtttcgccatccaattgatgggtttcttcttcatgactgtcttcatgtttgccctggctataccttatcatcactggaccttgaaggaaaacagaattgggtttgttgtgatgtactccctcaccttcttcttcgccaattttggtccaaatgccaccacatttgttgtgccagcagagattttcccagcaaggctaagatctacttgtcatggaatctcagctgctgcaggaaaagcaggagcaattgttggtgcatttggattcttatatgctgcacaaagtacggaccctgccaagactgatgcaggctacccaactggtattggggttaagaactctctcattatgcttggtgtgatcaacttctttggaattatattcaccttgttagtaccagaatcaaagggaaaatcactggaagagctgagtggggagactgaagaagatggtgttgaggctatagaggcagcagcgtcttctaggacagtaccagtttaatcaaagtctctgttcaaagttatgattattattgttatatgataattttaattcggtatttctactgtcaaatgcacaataatgatgtagatatctgtttttggggtgctataactttaaattaatagcagagtgtttatgtatttcattcatgtttttagttaaaattggtatctaaacaattatatttgttg

SEQ ID NO: 1579 - protein, 540 aa, Sesbania rostrata
MAGGGGQLGVLNALDVAKTQWYHFTAIVIAGMGFFTDAYDLFCISLVTKLLGRIYYTDYNKPKPGVLPPNVQAAVTGVALCGTLAGQLFFGWLGDKLGRKKVYGITLMLMVVCSIASGLSFGSSAKGVMATLCFFRFWLGFGIGGDYPLSATIMSEYANKKTRGAFIAAVFAMQGFGIMAGGIVALIVSSAFDHKYKVPAYQEDAKASMVLPAFDYVWRIILMFGAVPAALTYYWRMKMPETARYTALVAKNAKQAASDMSKVLQVEIEAEEDKVQHLIESQNQTFGLFSKEFAKRHGLHLVGTTTTWFLLDIAFYSQNLFQKDIFTAIGWIPPAKEMNAIHEVYRIARAQTLIALCSTVPGYWFTVAFIDYMGRFAIQLMGFFFMTVFMFALAIPYHHWTLKENRIGFVVMYSLTFFFANFGPNATTFVVPAEIFPARLRSTCHGISAAAGKAGAIVGAFGFLYAAQSTDPAKTDAGYPTGIGVKNSLIMLGVINFFGIIFTLLVPESKGKSLEELSGETEEDGVEAIEAAASSRTVPV

SEQ ID NO: 1580 - DNA, 1905 bp, Sesbania rostrata
  CDS (60)..(1670)
cccaacaccaccgcctcttctctttactccttcaccttggtttgacaagaaggaaagtgatggctggagaactgggagtgctgaatgcactcgacgttgccaagacacaatggtaccattttactgcaattgtgatagctggaatgggtttctttactgatgcctatgatctcttctgcatttcccttgtcaccaagttgctggggaggatatattacagtgatccaaaagcaccaaagcctggaactcttcctcctaatgttcaagctgctgtgactggtgttgccctttgtgggacattagcaggccaactattctttggttggcttggtgacaagttgggaagaaaaaaggtctatggaataactcttattctcatggttgtatgttccttggcttcagggctctcttttggatcaagtgcaaagggtgtcatggccacactatgtttcttcaggttctggcttggttttgggattggtggcgactaccctctttctgctacaatcatgtctgaatatgctaacaaaaagactcgaggggcattcatagctgcagtgtttgctatgcaaggttttggaatcatggctggtggaatagttgccttgattgtctctgctggatttgaccacaaatacaaggttcctagctatcaagaaaatcctcaagcatccttggttctgcctcaatttgattatgtttggcgtattgttttaatgtttggtgcactcccagcagcacttacctactactggcgtatgaaaatgccagagacagctcgttacacagctcttgttgccaagaacgcccaacaagctgctacagacatgtccaaggtgttgaaagttgaacttgaagttgaagaggaaaaggtacagaaaattacagaggctgataccaataagtatggtttattcagcaaggaatttgctaaacgccacggcctgcatttggtgggaaccaccaccacttggttcttgttggacatagcattctatagtcagaaccttttccagaaggacattttcagtgcaattggatggatccctcctgcaaaggaaatgaatgcaatccatgaagtttataagattgcaagagcacaaacactgatagcactatgcagtactgtgccaggttactggttcacagtagcatttatagattacatgggccgttttgctatccaattgatgggtttcttcttcatgactgtcttcatgtttgctctagccataccatatgaccattggaccaagaaagaaaacagaattgggtttgttgtgatgtactcactcaccttcttctttgccaattttggcccaaatgctaccacatttgttgtcccagcagagatattcccagcaaggctaaggtctacttgtcatggaatctcagctgctgcaggaaaagcaggggcaattgtgggtgcatttggattcttatatgctgcacagagtaaggaccccaccaagactgataaagggtacccaactggtattgggattaagaactctcttattatgcttggtgtgatcaactttgctggtatgttattcaccttactggttccagaatcaaagggaaaatcactagaggaattgagtggggaaaatgaagatggtgctgaagggattgagctaccagcatctgctaggacagttccagtttgattatagtctgcattcaacaaagtgattcaatttatgttatttgcaacatttcaatactaggtttcgtttgtgattcacaataataataatgatgtagttgtttgtttcgggcttcgggggtgctagaagaacaattataaagtatatgcttttggttttagttaaaaaccactcttgtataataatttaatctaccctttgattgagaatgtgataatacatgtatgtaatttct

SEQ ID NO: 1581 - protein, 536 aa, Sesbania rostrata
MAGELGVLNALDVAKTQWYHFTAIVIAGMGFFTDAYDLFCISLVTKLLGRIYYSDPKAPKPGTLPPNVQAAVTGVALCGTLAGQLFFGWLGDKLGRKKVYGITLILMVVCSLASGLSFGSSAKGVMATLCFFRFWLGFGIGGDYPLSATIMSEYANKKTRGAFIAAVFAMQGFGIMAGGIVALIVSAGFDHKYKVPSYQENPQASLVLPQFDYVWRIVLMFGALPAALTYYWRMKMPETARYTALVAKNAQQAATDMSKVLKVELEVEEEKVQKITEADTNKYGLFSKEFAKRHGLHLVGTTTTWFLLDIAFYSQNLFQKDIFSAIGWIPPAKEMNAIHEVYKIARAQTLIALCSTVPGYWFTVAFIDYMGRFAIQLMGFFFMTVFMFALAIPYDHWTKKENRIGFVVMYSLTFFFANFGPNATTFVVPAEIFPARLRSTCHGISAAAGKAGAIVGAFGFLYAAQSKDPTKTDKGYPTGIGIKNSLIMLGVINFAGMLFTLLVPESKGKSLEELSGENEDGAEGIELPASARTVPV

SEQ ID NO: 1582 - DNA, 1866 bp, Nicotiana tabacum
  CDS (73)..(1644)
  misc_feature (1767)..(1767): r is g or a
  misc_feature (1772)..(1772): k is g or t
ctaaattcataaggtgtacaatcttctgaagaagataatcttgaactgttggaacaagaagcaattttagcaatgtctgcagataacaatctacaagtgcttaatgcacttgatgtggccaagactcaactctaccatttcaccacaattgttattgctggaatgggatttttcactgatgcctatgatctcttcagcatttcacttgtaaccaaattacttgggcgtttatactacaccaagccagagttattgaagcccggaacactccctccgaccgtctcagcgtcggtcacgggtgtcgcccttgtcggcaccctcgccggccagcttttcttcggctggctcggtgacaagatgggccgaaaaacggtctatggtatgactttgattatcatggttttgtgttccgttgcatcagggctctcctttgggagtactcctaagggtgttatggccactctctgtttcttcaggttttggcttggatttggcatcggtggcgattaccctttatcagccacgattatgtccgaatacgcaaacaagaaaacccgtggcgccttcattgctgctgtcttcgctatgcaaggttttggaattttgttcagcgggataattgcacttattgtgtcagctggatttgatcatgcttataacgtcccaagtttccaagaaaatccagctctttctactgtgccacaagccgactacatttggcgtataattctcatgttcggagcattaccagctggcctcacttactactggcgcatgaagatgcccgaaacagcccgatacacagctctcgtggcgaaagacgcaaaaagagccgcacaggacatggggagggtgctacaagttgaaattgatcccgaggatgcaaaaatcgaacaaatgtctagggacaaaaccaataaatttggtctattttcatgggaattcgttcgtcgccacgggctgcacctattcggcacaacttccacatggttcttgttggacattgctttctatagccagaatcttttccagaaagatgtgttcagtgcaattggatggattccaccagccaaaaccatgaatgctgttcaagaagtttacaagattgcaagagcacaaaccttgattgcactacttagtacagtgccagggtactggttcaccgtggcgttcatcgatatcgttggaaggttcgcgatccaattgatgggattcttcttcatgactgtattcatgtttgccattgccattccctacgatcattggacaaagaaggacaaccatatcgggttcgttgcaatgtacgccctcacattcttcttcgcgaactttgggccaaacgcaaccacattcgtggtcccggctgagattttcccggccagacttcgatcaacatgtcatggtatttctgcagctgcaggtaaagccggagctatagtaggagcgtacggattcctgtacgctgcacaaagcaaagatccaacgaaaaccgatgcaggatacccggcgggtatcggcataaagaactcgctcattgccctaggggccatcaatgctctgggaatggtttgtaccttctgtgtgccagagtccaaaggaaaatccctggaggaagcatcacaggaaactataactgaagaatgaacagggaatgaatagcctcaaatggattttggaggtagactttgtgatgctaatgcagttttttttcctcctttattttctatgtattgttgctttaatttcctttttctttgtattgtctargcttktttgctgtaatttttaaattatttattttttaaaaaaaaaaaaaaaaaaaaaaaaaaaaaaaaaaaaaaaaaaaaaaaaaaaaaaaaaaaaaaa

SEQ ID NO: 1583 - protein, 523 aa, Nicotiana tabacum
MSADNNLQVLNALDVAKTQLYHFTTIVIAGMGFFTDAYDLFSISLVTKLLGRLYYTKPELLKPGTLPPTVSASVTGVALVGTLAGQLFFGWLGDKMGRKTVYGMTLIIMVLCSVASGLSFGSTPKGVMATLCFFRFWLGFGIGGDYPLSATIMSEYANKKTRGAFIAAVFAMQGFGILFSGIIALIVSAGFDHAYNVPSFQENPALSTVPQADYIWRIILMFGALPAGLTYYWRMKMPETARYTALVAKDAKRAAQDMGRVLQVEIDPEDAKIEQMSRDKTNKFGLFSWEFVRRHGLHLFGTTSTWFLLDIAFYSQNLFQKDVFSAIGWIPPAKTMNAVQEVYKIARAQTLIALLSTVPGYWFTVAFIDIVGRFAIQLMGFFFMTVFMFAIAIPYDHWTKKDNHIGFVAMYALTFFFANFGPNATTFVVPAEIFPARLRSTCHGISAAAGKAGAIVGAYGFLYAAQSKDPTKTDAGYPAGIGIKNSLIALGAINALGMVCTFCVPESKGKSLEEASQETITEE

SEQ ID NO: 1584 - DNA, 1918 bp, Nicotiana tabacum
  CDS (73)..(1644)
ctaaattcataaggtgtacaatcttctgaagaagataatcttgaactgttggaacaagaagcaattttagcaatgtctgcagataacaatctacaagtgcttaatgctcttgatgtggccaagactcaactctaccatttcaccacaattgttattgctggaatgggattttttactgatgcctatgatctcttcagcatttcacttgtaaccaaattacttgggcgtttatactacaccaagtcggatttattgaagcccggaacactccctccaaccgtctcagcatcggtcacgggtgtcgccttggtcggcaccctagccggccagcttttcttcggctggctcggtgacaagatgggccgaaagacggtctatggtatgactttgattatcatggttttgtgttccgttgcatcggggctctcctttgggagtactcctaagggtgttatggccactctctgtttcttcaggttttggcttggatttggcatcggtggcgattaccctttatccgccacgattatgtccgaatacgcaaacaaaaaaacccgtggcgccttcattgctgctgtcttcgctatgcaaggttttggaattttgttcagtgggataattgcacttattgtgtcagctggatttgatcatgcttataatgtcccaagtttccaagaaaatgcagctctttccaccgtgccacaagccgactacatttggcgtataattctcatgttcggagcattaccagctttcctcacttactactggcgcatgaagatgcccgaaacagcccgatacacagctctcgtggcgaaagacgcaaaaagagccgcacaggacatggggagggtactacaagttgaaattgatcccgaggatgcaaaaatcgaacaaatgtctagggacgaaaccaataaatttggtctattttcttgggaattcgtttgtcgccacgggttgcacctattcggcacatgttccacatggtttttgttggacattgctttctatagccagaatcttttccagaaagatgtgttcagtgcagttggatggatcccagcggccaaaaccatgaatgccgttcaagaagtttacaagattgcaagagcacaaaccttgattgcactacttagtacagtgccagggtactggttcaccgtggcgttcatcgatatcgttggaaggttcgcgatccaattgatgggattcttcttcatgactgtattcatgttcgccatcgccattccctacgaacattggacaaagaaggacaaccatattgggttcgttgcaatgtacgccctcacattcttcttcgcgaactttgggccaaatgcaaccacattcgtggtcccggctgagattttcccggccagacttcgatcaacatgtcatggtatttctgcagctgcaggtaaagccggagctatagtaggagcgtacgggttcctctacgctgcacaaagtaaagatccaacaaaaaccgatgcaggatacccagcgggtattggcataaagaactcgctccttgccctaggggccattaatgctctgggaatggtttgtaccttctgtgtgccagagtccaaaggaaaatctctggaggaagcatcacaggaaactataactgaagaatgaacagggaatgaatagcctcaaatggattttggaggttgactttgtgattctaaagcagttttttattctccttttattttctatgtatttgttgaattaatttcctttttctttatattgtctaagcttgtttgctgtaagtttcaaaattatttatttttcgaccaagtgtgtaattataattatttcacttcattgtgaggtgaaaaaggttttgctttttattcatattacagatttgtttttaactgagtgataaaaaaaaaaaaaaaaa

SEQ ID NO: 1585 - protein, 523 aa, Nicotiana tabacum
MSADNNLQVLNALDVAKTQLYHFTTIVIAGMGFFTDAYDLFSISLVTKLLGRLYYTKSDLLKPGTLPPTVSASVTGVALVGTLAGQLFFGWLGDKMGRKTVYGMTLIIMVLCSVASGLSFGSTPKGVMATLCFFRFWLGFGIGGDYPLSATIMSEYANKKTRGAFIAAVFAMQGFGILFSGIIALIVSAGFDHAYNVPSFQENAALSTVPQADYIWRIILMFGALPAFLTYYWRMKMPETARYTALVAKDAKRAAQDMGRVLQVEIDPEDAKIEQMSRDETNKFGLFSWEFVCRHGLHLFGTCSTWFLLDIAFYSQNLFQKDVFSAVGWIPAAKTMNAVQEVYKIARAQTLIALLSTVPGYWFTVAFIDIVGRFAIQLMGFFFMTVFMFAIAIPYEHWTKKDNHIGFVAMYALTFFFANFGPNATTFVVPAEIFPARLRSTCHGISAAAGKAGAIVGAYGFLYAAQSKDPTKTDAGYPAGIGIKNSLLALGAINALGMVCTFCVPESKGKSLEEASQETITEE

SEQ ID NO: 1586 - DNA, 2070 bp, Nicotiana tabacum
  CDS (228)..(1841)
ccgctgatacagagaagctaattaataaatgcaaaaatcagagtttttatttttggctttttgttaagcctttgaacgtaaaattttattggaaattttcttcattgaaatttccaagcttttagctttctgcttctctgctgttcttgattctgttgcactctgtggaattgaaaatttcgtggagaaaatcatttaaggaatttaagggttgagaaagtatagtcatggctaaagatcaattgcaagtgctaaatgcactagatgtagcaaaaacacaattgtatcactttacagcaattgttattgctggtatgggcttctttactgatgcttatgatcttttctgcatttctttggtcacaaaattgcttggccggatttactaccaccacgacggggcaccgaaacctggaactctccctcctaatgtctcggctgctgtaaatggagtcgcattctgtgggacccttgctggacaactgtttttcgggtggctcggagataagatgggaagaaaaagagtttatggaatgactcttatgatgatggttatttgttcaatagcctcaggactctcttttggtcatacaccaaaaagtgttatgactacactttgtttcttcaggttttggttaggctttggcattggtggtgattatcctctttctgctactatcatgtccgagtatgctaacaaaaagacgcgtggcgcgttcattgctgctgtttttgcaatgcaaggttttggaattttggctggtggaatggtagcaatcattgtttctgctgcatttaagggcgcgtttcctgcacaaacatatcagactgaccctcttggttcaacaatctctcaggctgatttcgtgtggcgcataattctaatgtttggtgcaatcccagctgcaatgacttattactggcgtatgaagatgcctgaaactgctcgttatactgcattggtggccaagaacttaaaacaggcagctaacgacatgtctaaagtgttgcaagtcgatattgaagaagagcaagagaaagttgagaatgtttctcaaaacactaggaatgagtttggtttgttttctaaggagttcctccgtcgccatggacttcacttgcttggaactgctagtacatggttcttgttggacattgctttctacagtcaaaaccttttccaaaaggacattttcagcgcaattggatggattcctccagcgcaaaccatgaatgcgttggaggaagtttacaaaattgcaagggcgcaaactcttatcgccctttgcagtactgttcctggttactggttcacagtattcttcatcgacaaaataggtcgatttgcatttcagttaatgggattcttcttcatgacagtattcatgtttgccttagccattccatatcatcattggactctaaaggataacagaatcgggttcgtgatcatgtactcacttacctttttcttcgcgaattttggtccaaacgccacaacatttgttgtccccgcggagattttcccagccaggcttaggtcaacatgccatggaatatcagcagcagctggaaaagcaggagcaatgattggtgcattcggattcttgtacgctgctcagccaacagatcgaaaaaaggctgatgccggttaccctgctggaattggtgtgagaaattcactgattgtcttaggttgtgttaacttcttaggaatggtgttcacatttttggtgccagaatccaaaggaaaatcattggaagaaatgtcaagggaaaatgaaggggaagaggaaagtggaacagaaatgaagaatagtggaaggacagttcctgtttaattttggaccttttaacatatactatatatatgatgcatgtttgtgaatttgtgttttttggagcttaagatgaaatatgctctctactttttgcttgtttctggtggtaattatatgggaaagtgggaagagaaatgaggtccttttgttgtctatttctatcttttgaaaaaaaattaacattataagaatgaagagaatattttcaattaaaaaaaaaaaaaaaaaa

SEQ ID NO: 1587 - protein, 537 aa, Nicotiana tabacum
MAKDQLQVLNALDVAKTQLYHFTAIVIAGMGFFTDAYDLFCISLVTKLLGRIYYHHDGAPKPGTLPPNVSAAVNGVAFCGTLAGQLFFGWLGDKMGRKRVYGMTLMMMVICSIASGLSFGHTPKSVMTTLCFFRFWLGFGIGGDYPLSATIMSEYANKKTRGAFIAAVFAMQGFGILAGGMVAIIVSAAFKGAFPAQTYQTDPLGSTISQADFVWRIILMFGAIPAAMTYYWRMKMPETARYTALVAKNLKQAANDMSKVLQVDIEEEQEKVENVSQNTRNEFGLFSKEFLRRHGLHLLGTASTWFLLDIAFYSQNLFQKDIFSAIGWIPPAQTMNALEEVYKIARAQTLIALCSTVPGYWFTVFFIDKIGRFAFQLMGFFFMTVFMFALAIPYHHWTLKDNRIGFVIMYSLTFFFANFGPNATTFVVPAEIFPARLRSTCHGISAAAGKAGAMIGAFGFLYAAQPTDRKKADAGYPAGIGVRNSLIVLGCVNFLGMVFTFLVPESKGKSLEEMSRENEGEEESGTEMKNSGRTVPV

SEQ ID NO: 1588 - DNA, 2059 bp, Nicotiana tabacum
  CDS (220)..(1833)
tcagagaagctaattaataaatgcaaaaatcagagtttttatttttggctttttgttaagcctttgaacgtaaaattttattggaaattttcttcattgaaatttccaagcttttagctttctgcttctctgctgttcttgattctgttgcactctgtggaattgaaaatttcgtggagaaaatcatttaaggaatttaagggttgagaaagtatagtcatggctaaagatcaattgcaagtgctaaatgcactagatgtagcaaaaacacaattgtatcactttacagcaattgttattgctggtatgggcttctttactgatgcttatgatcttttctgcatttctttggtcacaaaattgcttggccggatttactaccaccacgacggggcaccgaaacctggaactctccctcctaatgtctcggctgctgtaaatggagtcgcattctgtgggacccttgctggacaactgtttttcgggtggctcggagataagatgggaagaaaaagagtttatggaatgactcttatgatgatggttatttgttcaatagcctcaggactctcttttggtcatacaccaaaaagtgttatgactacactttgtttcttcaggttttggttaggctttggcattggtggtgattatcctctttctgctactatcatgtccgagtatgctaacaaaaagacgcgtggcgcgttcattgctgctgtttttgcaatgcaaggttttggaattttggctggtggaatggtagcaatcattgtttctgctgcatttaagggcgcgtttcctgcacaaacatatcagactgaccctcttggttcaacagtctctcaggctgatttcgtgtggcgcataattctaatgtttggtgcaatcccagctgcaatgacttattactggcgtatgaagatgcctgaaactgctcgttatactgcattggtggccaagaacttaaaacaggcagctaacgacatgtctaaagtgttgcaagtcgatattgaagaagagcaagagaaagttgagaatgtttctcaaaacactaggaatgagtttggtttgttttctaaggagttcctccgtcgccatggacttcacttgcttggaactgctagtacatggttcttgttggacattgctttctacagtcaaaaccttttccaaaaggacattttcagcgcaattggatggattcctccagcgcaaaccatgaatgcgttggaggaagtttacaaaattgcaagggcgcaaactcttatcgccctttgcagtactgttcctggttactggttcacagtattcttcatcgacaaaataggtcgatttgcaattcagttaatgggattcttcttcatgacagtattcatgtttgccttagccattccatatcatcattggactctaaaggataacagaatcgggttcgtgatcatgtactcacttacctttttcttcgcgaattttggtccaaacgccacaacatttgttgtccccgcggagattttcccagccaggcttaggtcaacatgccatggaatatcagcagcagctggaaaagcaggagcaatgattggtgcattcggattcttgtacgctgctcagccaacagatcgaaaaaaggctgatgccggttaccctgctggaattggtgtgagaaattcactgattgtcttaggttgtgttaacttcttaggaatggtgttcacatttttggtgccagaatccaaaggaaaatcattggaagaaatgtcaagggaaaatgaaggggaagaggaaagtggaacagaaatgaagaatagtggaaggacagttcctgtttaattttggaccttttaacatatactatatatatgatgcatgtttgtgaatttgtgttttttggagcttaagatgaaatatgctctctactttttgcttgtttctggtggtaattatatgggaaagtgggaagagaaatgaggtccttttgttgtctatttctatcttttgaaaaaaaattaacattataagaatgaagagaatattttcaaaaaaaaaaaaaaaaaaa

SEQ ID NO: 1589 - protein, 537 aa, Nicotiana tabacum
MAKDQLQVLNALDVAKTQLYHFTAIVIAGMGFFTDAYDLFCISLVTKLLGRIYYHHDGAPKPGTLPPNVSAAVNGVAFCGTLAGQLFFGWLGDKMGRKRVYGMTLMMMVICSIASGLSFGHTPKSVMTTLCFFRFWLGFGIGGDYPLSATIMSEYANKKTRGAFIAAVFAMQGFGILAGGMVAIIVSAAFKGAFPAQTYQTDPLGSTVSQADFVWRIILMFGAIPAAMTYYWRMKMPETARYTALVAKNLKQAANDMSKVLQVDIEEEQEKVENVSQNTRNEFGLFSKEFLRRHGLHLLGTASTWFLLDIAFYSQNLFQKDIFSAIGWIPPAQTMNALEEVYKIARAQTLIALCSTVPGYWFTVFFIDKIGRFAIQLMGFFFMTVFMFALAIPYHHWTLKDNRIGFVIMYSLTFFFANFGPNATTFVVPAEIFPARLRSTCHGISAAAGKAGAMIGAFGFLYAAQPTDRKKADAGYPAGIGVRNSLIVLGCVNFLGMVFTFLVPESKGKSLEEMSRENEGEEESGTEMKNSGRTVPV

SEQ ID NO: 1590 - DNA, 1735 bp, Nicotiana tabacum
  CDS (64)..(1674)
ggaaagtgaaaatttcgtggagaaaaaccatataaggaatttaagggttgagaaagtatagtcatggctaaagatttgcaagtgctaaatgcactagatgtagcaaaaacacaattgtatcactttacagcaattgtgattgctggtatgggcttctttactgatgcttatgatcttttctgcatttctttagtcacaaaattgcttggccgcatttactaccaccgcgacggggcattgaaacctggatctctgcctcctaacgtctcggctgctgttaatggagtcgccttctgtgggacccttgctggacaactgtttttcgggtggctcggagataaaatgggaagaaaaaaggtttatggaatgactcttatgatgatggttatttgttcaatagcctcagggctttcttttggtcatacaccaaaaggtgttatgactacactttgtttcttcaggttttggttaggatttggcattggtggtgattatcctctttctgctactattatgtccgagtatgctaataaaaagacgcgtggagcgttcattgctgctgtttttgcaatgcaaggttttggaattctggctggtggaatggtagcaatcattgtttctgctgcatttaagggcgcgtttcctgcaccaacatatcatgccgacgctcttgcttcaactgtctctcaggctgatttcgtgtggcgtataattcttatgtttggtgcaatcccagctgcaatgacttattactggcgtatgaagatgcctgaaactgcccgttacactgcattggtggccaagaacttaaaacaggcagctaacgacatgtctaaagtgttacaagtcgaaattgaagaagagcaagagaaagttgagaatgtttctcaaaacactgggaatgagtttggtttgttttctaaggagttcctccgacgccacggacttcacttgctcggaactgctagcacatggttcttgttggacattgctttctatagtcaaaaccttttccaaaaggacattttcagcgccattggttggattcctccagcggaaaccatgaatgcgttggaggaagtttacagaattgcaagggcgcaaactcttatcgccctttgcagtactgttcctggttactggttcacagtattcttcatcgacagaataggtcgatttgcaattcagttaatgggattcttcttcatgacagtcttcatgtttgccttagccattccttatcatcattggactctcaaggataacagaatagggttcgtgatcatgtactcactcacctttttcttcgcgaattttggtccaaatgcgacaacatttgttgtccccgcggagattttcccagccaggcttaggtcaacatgccatggaatatcagcagcagctggaaaagcaggagcgatgattggtgcattcggattcttgtatgctgctcaaccaacagatccaaaaaaggttgatgccggttaccctgctggaattggtgtgagaaattcactgattgtcttaggttgtgttaacttcttgggaatggtgttcacatttttggtgccagaatctaaaggaaaatcattggaagaaatgtcaagggaaaatgaaggggaagaggaaagtggaacagaaatgaagaatagtggaaggacagttcctgtttaattttggacctttatttaacatatattatatatatgatgcatgtttgtgaaaaaaaaaaaat

SEQ ID NO: 1591 - protein, 536 aa, Nicotiana tabacum
MAKDLQVLNALDVAKTQLYHFTAIVIAGMGFFTDAYDLFCISLVTKLLGRIYYHRDGALKPGSLPPNVSAAVNGVAFCGTLAGQLFFGWLGDKMGRKKVYGMTLMMMVICSIASGLSFGHTPKGVMTTLCFFRFWLGFGIGGDYPLSATIMSEYANKKTRGAFIAAVFAMQGFGILAGGMVAIIVSAAFKGAFPAPTYHADALASTVSQADFVWRIILMFGAIPAAMTYYWRMKMPETARYTALVAKNLKQAANDMSKVLQVEIEEEQEKVENVSQNTGNEFGLFSKEFLRRHGLHLLGTASTWFLLDIAFYSQNLFQKDIFSAIGWIPPAETMNALEEVYRIARAQTLIALCSTVPGYWFTVFFIDRIGRFAIQLMGFFFMTVFMFALAIPYHHWTLKDNRIGFVIMYSLTFFFANFGPNATTFVVPAEIFPARLRSTCHGISAAAGKAGAMIGAFGFLYAAQPTDPKKVDAGYPAGIGVRNSLIVLGCVNFLGMVFTFLVPESKGKSLEEMSRENEGEEESGTEMKNSGRTVPV

SEQ ID NO: 1592 - DNA, 1642 bp, Solanum tuberosum
  CDS (14)..(1636)
aggaagtttagtgatggcgaacgatttgcaagtgctaaatgcactagatgtggcaaagacacaactgtatcacttcacagcaattgtgattgctgggatggggttttttactgatgcttatgaccttttctgcatttctatggtcactaaattgcttggtcgtatttactaccatcatgacaatgcattgaaacctggctctctgccccctaatgtttcagcagctgttaatggagtcgccttctgtggcacccttgctggacagttgttctttgggtggcttggagataaaatgggaaggaagaaagtctatggaatgacccttatgattatggtcatttgttcaattgcctcggggctttcatttggtcatacaccaaaaagtgttatgactacgctttgtttcttcagattctggctaggatttggcattggtggtgattatcccctttctgccaccatcatgtctgagtatgctaacaaaaagactcgtggagcgttcattgctgctgtgtttgctatgcaaggtttcggaattctggctggtggaatggtggcaatcattgtttcttcagcattcaagggagcattccctgcaccagcatatgaggttgatgctcttgcttcaacagtctctcaggctgatttcgtgtggcgcataattctcatgttcggtgcaatccctgctggacttacttattactggcgtatgaagatgcctgaaactgcccgttacactgccttggtcgccaagaacttgaaacaggcagctaacgacatgtccaaggtgttgcaagtcgaaattgaagcagagccagagaaagttggagctatttctgaagcaaaaggagccaatgagtttggtttgttcagtaaggagttcctccgtcgccatggacttcacttgcttggaactgctagcacatggttcttgttggacattgctttctacagtcaaaaccttttccagaaggacattttcagtgcaattggatggattccaccagcacaaaccatgaacgcgttggaagaagtttacaagattgcaagggcacaaactctaattgctctttgtagtactgttcctggttactggttcacagttgcattcatcgataggattggtcgattcgcaattcagttgatgggattcttcttcatgacagtcttcatgtttgccttagcccttccataccatcactggactctcaaggataacagaatcggcttcgtggtcatgtactcactcacctttttcttcgccaactttggtccaaacgccacaacattcgtcgtccctgctgagattttcccagccaggcttaggtccacatgccatggaatatcagcggcagctggaaaagcaggagctatggttggtgcattcggattcttgtacgctgctcagcccacagatccaaaaaagactgatgctggttaccctcctggcattggtgtgaggaactcgttgatcgtccttggttgcgttaacttccttggtatgttgttcacattcttggttccagaatccaatgggaagtcattggaagaaatgtcgagggaaaacgaaggggaagaggaaactgtagctgaaatgagagcaacaagtggaaggacagtcctgtttaagttttagacaaga

SEQ ID NO: 1593 - protein, 540 aa, Solanum tuberosum
MANDLQVLNALDVAKTQLYHFTAIVIAGMGFFTDAYDLFCISMVTKLLGRIYYHHDNALKPGSLPPNVSAAVNGVAFCGTLAGQLFFGWLGDKMGRKKVYGMTLMIMVICSIASGLSFGHTPKSVMTTLCFFRFWLGFGIGGDYPLSATIMSEYANKKTRGAFIAAVFAMQGFGILAGGMVAIIVSSAFKGAFPAPAYEVDALASTVSQADFVWRIILMFGAIPAGLTYYWRMKMPETARYTALVAKNLKQAANDMSKVLQVEIEAEPEKVGAISEAKGANEFGLFSKEFLRRHGLHLLGTASTWFLLDIAFYSQNLFQKDIFSAIGWIPPAQTMNALEEVYKIARAQTLIALCSTVPGYWFTVAFIDRIGRFAIQLMGFFFMTVFMFALALPYHHWTLKDNRIGFVVMYSLTFFFANFGPNATTFVVPAEIFPARLRSTCHGISAAAGKAGAMVGAFGFLYAAQPTDPKKTDAGYPPGIGVRNSLIVLGCVNFLGMLFTFLVPESNGKSLEEMSRENEGEEETVAEMRATSGRTVLFKF

SEQ ID NO: 1594 - DNA, 1575 bp, Arabidopsis thaliana
  CDS (1)..(1575)
atggccgaacaacaactaggagtgctaaaggcactcgatgttgcgaagacgcaactttatcatttcacggcgattgtcatcgccggtatgggtttctttaccgatgcctacgatcttttttgcgtgtccttggtgacgaaactccttggccgcatctactatttcaatccggagtcagcgaagcctggctcacttccccctcatgttgcggccgcggtcaacggtgtggccctttgtggaaccctttctggtcaactcttcttcggttggctcggtgacaaactcggacggaaaaaagtgtacggtctcactttggtaatgatgatcttgtgctctgtcgcttctggtctctcttttggccacgaagccaagggtgtcatgaccaccctttgcttcttcaggttttggttgggatttggtattggaggtgactacccactttctgccaccatcatgtctgaatacgcaaacaagaagacccgtggggctttcatcgcagctgtcttcgccatgcaaggtgtcggtatcttggctggaggtttcgtggcactcgcagtatcttctatattcgacaaaaagttcccagctccaacatatgcagtaaacagggccctctcaacgcctcctcaagttgactacatttggcgaatcatcgtcatgtttggtgctttacccgcagctttgacttactactggcgtatgaagatgcctgaaactgcccgttacaccgctttggttgccaagaacatcaaacaagccacagccgacatgtccaaggtcttacaaacagatatcgagcttgaggaaagggtggaggatgacgtcaaagaccccaaacaaaactatggcttgttctccaaggaattccttagacgccatgggcttcatctccttggaactacctccacatggtttttgcttgacattgccttctacagccaaaacttgttccagaaggatattttctcggccatcggatggatcccaaaggcagccaccatgaacgccacccatgaggttttcaggattgctagggctcagactcttatcgccctttgcagtacagtcccaggctactggttcacagttgcgtttattgataccattggaaggtttaagatccaactaaatggatttttcatgatgaccgtgtttatgtttgccattgccttcccttacaaccactggatcaaaccagaaaaccgtatcggatttgtggttatgtactctcttactttcttcttcgccaattttggtccaaatgcaaccacttttattgtccctgctgagatattcccggccaggctaaggtctacatgtcatggaatatcagccgcggctggtaaggctggagccattgttggagcctttgggttcctatatgcggctcaatcacaagacaaggccaaggtagacgcaggatacccaccaggcatcggagttaagaactcattgatcatgcttggtgttcttaactttatcggtatgctcttcaccttccttgtcccagagcccaaaggcaagtcccttgaagaactctctggtgaggctgaggttagccatgacgagaaataa

SEQ ID NO: 1595 - protein, 524 aa, Arabidopsis thaliana
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLVMMILCSVASGLSFGHEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPKQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIVGAFGFLYAAQSQDKAKVDAGYPPGIGVKNSLIMLGVLNFIGMLFTFLVPEPKGKSLEELSGEAEVSHDEK

SEQ ID NO: 1596 - DNA, 1575 bp, Arabidopsis thaliana
  CDS (1)..(1575)
atggctgaacaacaactaggagtgctaaaggcactcgatgttgcgaagacgcaactttatcatttcacggcgattgtcatcgccggtatgggtttctttaccgatgcgtacgatcttttttgcgtgtccttggtaacaaagctccttggccgcatctactacttcaatccggagtcagcgaagcctggctcacttccccctcatgttgcggccgctgtcaatggtgtggccctttgtggaaccctttctggtcaactcttcttcggttggctcggtgacaaactcggacggaaaaaagtgtacggtcttactttgatcatgatgatcttatgctctgtcgcttctggcctctcttttggcaacgaagccaagggtgtcatgaccaccctttgcttcttcaggttttggttgggatttggtattggaggtgactacccactttctgccaccatcatgtctgaatacgcaaacaagaagacccgtggggctttcatcgcagctgtcttcgccatgcaaggtgtcggtatcttggctggaggtttcgtggcactcgcagtatcttctatattcgacaaaaagttcccagctccaacatatgcagtaaacagggccctctcaacgcctcctcaagttgattacatttggcgaatcatcgtcatgtttggtgctttacccgcagctttgacttactactggcgtatgaagatgcctgaaactgcccgttacaccgctttggttgccaagaacatcaaacaagccacagccgacatgtccaaggtcttacaaacagatatcgagcttgaggaaagggtggaggatgacgtcaaagaccccagacaaaactatggcttgttctccaaggaattccttagacgccatggacttcatctccttggaactacctccacttggtttttgcttgacattgccttctacagccaaaacttgttccagaaggatattttctcggccatcggatggatcccaaaggcagccaccatgaacgccacccatgaggttttcaggattgctagggctcagactcttatcgccctttgcagtacagtcccaggctactggttcacagttgcgtttattgataccattggaaggtttaagatccaactaaatggatttttcatgatgaccgtgtttatgtttgccattgccttcccttacaaccactggatcaaaccagaaaaccgtatcggatttgtggttatgtactctcttactttcttcttcgccaattttggtccaaatgcaaccacttttattgtccctgctgagatattcccggccaggctaaggtcaacatgtcatggaatatcagccgcggctggtaaggctggagccatcattggagccttcgggttcttatatgcggctcaaaatcaagacaaggctaaggtggatgcaggatacccaccaggtatcggagttaagaactcattgatcgtgcttggtgttcttaacttcatcggtatgctcttcaccttccttgtcccagagcccaagggcaagtccctcgaagaactctctggtgaagctgaagttagccatgacgagaaataa

SEQ ID NO: 1597 - protein, 524 aa, Arabidopsis thaliana
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLIMMILCSVASGLSFGNEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPRQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIIGAFGFLYAAQNQDKAKVDAGYPPGIGVKNSLIVLGVLNFIGMLFTFLVPEPKGKSLEELSGEAEVSHDEK

SEQ ID NO: 1598 - DNA, 1566 bp, Arabidopsis thaliana
  CDS (1)..(1566)
atggccgatcaacagctaggagtgctaaaggcacttgatgttgcgaagacgcaactttaccatttcacggctattgtcattgccggtatgggcttctttacggacgcgtacgatctcttttgtgtgtccttggtgaccaagcttcttggccgcctctactacttcaatccaacgtcagcaaagcctggctcacttccccctcatgttgcggctgcagtcaacggtgtggccctttgtggaacccttgccggtcaactcttcttcggatggcttggtgacaaactcggacggaaaaaggtgtacggtatcactttgatcatgatgattctctgctcagttgcttccggtctttccttgggcaattcggccaagggtgtcatgacgactctttgcttcttcaggttttggctcgggtttggcattggaggtgactaccctctatctgccaccatcatgtctgaatacgctaacaagaagactcgtggggctttcatcgcggcagtgttcgccatgcaaggtgtaggtatcttggcgggaggttttgtggcacttgcagtttcttccatatttgacaaaaagttcccatcgccgacgtatgagcaagacaggtttctatcaacgcctcctcaagctgattacatttggcgaatcatcgtcatgtttggtgctttacccgcagctttgacttactattggcgtatgaagatgcctgaaacagcccgttacaccgctttagttgccaagaacatcaaacaagccacagcagacatgtccaaggtcttacaaacagatctcgagcttgaggaaagggtggaggatgacgtcaaggaccccaaaaaaaactatggcttgttctccaaggaattccttagacgccatgggcttcatctccttgggactacctccacttggtttttgcttgacatcgccttctacagccaaaacttgttccaaaaggatattttctcggccattggatggatcccaaaggcagccactatgaacgccatccatgaggttttcaagattgctagggctcagactctcattgccctctgcagtacagtcccaggttactggttcacagtagcctttattgatatcattggaaggtttgcgatccaactaatgggatttttcatgatgaccgtttttatgtttgctattgccttcccatacaaccactggattttaccagataatcgtatcggattcgtggttatgtactcactcacatttttcttcgccaactttggacccaatgcaactactttcattgtcccagctgaaatctttccagcaaggctaaggtctacgtgccatggaatatcagccgcaactggtaaggctggagccatcgttggagccttcgggttcctatatgctgctcaaccacaggataagaccaagacagacgcaggatacccaccgggcatcggagtcaagaactcattgatcatgcttggtgtcattaactttgttggtatgctcttcaccttcctcgtccctgagcccaagggcaagtcccttgaagaactctccggcgaggctgaggttgataaatga

SEQ ID NO: 1599 - protein, 521 aa, Arabidopsis thaliana
MADQQLGVLKALDVAKTQLYHFTAIVIAGMGFFTDAYDLFCVSLVTKLLGRLYYFNPTSAKPGSLPPHVAAAVNGVALCGTLAGQLFFGWLGDKLGRKKVYGITLIMMILCSVASGLSLGNSAKGVMTTLCFFRFWLGFGIGGDYPLSATIMSEYANKKTRGAFIAAVFAMQGVGILAGGFVALAVSSIFDKKFPSPTYEQDRFLSTPPQADYIWRIIVMFGALPAALTYYWRMKMPETARYTALVAKNIKQATADMSKVLQTDLELEERVEDDVKDPKKNYGLFSKEFLRRHGLHLLGTTSTWFLLDIAFYSQNLFQKDIFSAIGWIPKAATMNAIHEVFKIARAQTLIALCSTVPGYWFTVAFIDIIGRFAIQLMGFFMMTVFMFAIAFPYNHWILPDNRIGFVVMYSLTFFFANFGPNATTFIVPAEIFPARLRSTCHGISAATGKAGAIVGAFGFLYAAQPQDKTKTDAGYPPGIGVKNSLIMLGVINFVGMLFTFLVPEPKGKSLEELSGEAEVDK

SEQ ID NO: 1600 - DNA, 1605 bp, Arabidopsis thaliana
  CDS (1)..(1605)
atggcaagggaacaattacaagtgttgaatgcacttgacgtggccaagacgcaatggtaccatttcacggcgatcataatcgccggaatgggattcttcactgatgcttacgatctcttttgcatctctctcgtaacgaagctcctcggtcgtatttattaccacgtggaaggcgcacaaaagcctgggactctccctcccaacgtcgcagccgccgtcaatggcgttgccttctgtgggactctcgccggtcagctctttttcgggtggcttggtgataagctcgggaggaagaaagtttacggtatgacgttgatggtcatggtcctttgttcaatagcctctggtctctctttcggacatgagccaaaagctgtgatggccacgctctgtttttttcggttttggcttggatttggcatcggtggtgactaccctttatccgcaaccatcatgtctgaatatgcgaacaagaagactcgcggagcctttgtctctgcggtttttgctatgcaagggttcggaatcatggctggtggtattttcgctattataatttcctctgcttttgaagctaagtttccatccccggcctatgcggatgatgccttgggatccacgattcctcaagctgatttggtatggcggataatcctgatggctggtgctatccctgcggctatgacgtattactcaaggtcgaagatgcctgagaccgcaaggtacacggctttggttgctaaggacgcaaagcaggcagcttcggacatgtctaaggttctgcaagtggagatagagccagaacaacagaaattggaagagatctcaaaggagaagtccaaggcctttggattgttctcaaaggaattcatgagtcgccatgggcttcatttgctaggcactacatcgacatggttccttctcgacattgctttctacagtcaaaaccttttccaaaaggatattttcagcgcgatcggatggattcctcccgcgcaaagcatgaacgcaattcaagaggttttcaagattgcccgtgcgcaaacgctaatcgccttgtgtagcacggtacctggttactggttcacagttgcgttcatcgacgtcattggaagatttgcgattcagatgatgggtttctttttcatgacggtctttatgtttgctctggctattccttacaaccactggactcacaaggagaaccgaatcggatttgttatcatgtactcgttaacattctttttcgccaactttggacccaatgctacaaccttcgttgtgccggccgaaatcttcccagccaggttcagatcaacctgccacggtatctctgcagcatcaggaaaattaggagcaatggttggtgcgttcgggttcttgtacttggctcagaacccagacaaggacaagaccgacgcaggataccctccagggattggggtcaggaactcgcttattgtgttgggtgtagttaacttcttaggtatcctcttcactttcttggtacctgaatctaaaggtaagtcactcgaggaaatgtccggtgaaaatgaagacaatgagaatagcaacaatgatagtagaacggtcccaatagtttag

SEQ ID NO: 1601 - protein, 534 aa, Arabidopsis thaliana
MAREQLQVLNALDVAKTQWYHFTAIIIAGMGFFTDAYDLFCISLVTKLLGRIYYHVEGAQKPGTLPPNVAAAVNGVAFCGTLAGQLFFGWLGDKLGRKKVYGMTLMVMVLCSIASGLSFGHEPKAVMATLCFFRFWLGFGIGGDYPLSATIMSEYANKKTRGAFVSAVFAMQGFGIMAGGIFAIIISSAFEAKFPSPAYADDALGSTIPQADLVWRIILMAGAIPAAMTYYSRSKMPETARYTALVAKDAKQAASDMSKVLQVEIEPEQQKLEEISKEKSKAFGLFSKEFMSRHGLHLLGTTSTWFLLDIAFYSQNLFQKDIFSAIGWIPPAQSMNAIQEVFKIARAQTLIALCSTVPGYWFTVAFIDVIGRFAIQMMGFFFMTVFMFALAIPYNHWTHKENRIGFVIMYSLTFFFANFGPNATTFVVPAEIFPARFRSTCHGISAASGKLGAMVGAFGFLYLAQNPDKDKTDAGYPPGIGVRNSLIVLGVVNFLGILFTFLVPESKGKSLEEMSGENEDNENSNNDSRTVPIV

SEQ ID NO: 1602 - DNA, 1740 bp, Arabidopsis thaliana
  CDS (57)..(1685)
atcaaaaattgttgtatcaagattttctctcaggtgactgaacaacagagaaaaacatggcgaaaaaaggaaaagaagtgttgaacgctttggacgcagccaaaacgcagatgtaccatttcacagcgattgtaatcgcgggtatgggttttttcactgatgcttacgatctatttagcatctccctcgtcacgaagctcctaggccgcatatactaccacgttgatagctccaagaagcctggaacgctccctcctaatgttgctgccgctgttaatggtgtggccttctgcggtaccttagcaggccagctcttcttcggttggctcggtgacaagctcggccgcaagaaagtttacggtattaccttgatgctcatggtactatgttctctcgggtctggtctatcatttggtcactcagctaacggagtaatggccacactttgtttcttccggttctggctcggtttcggcataggcggcgactaccctctctcagccaccatcatgtcggaatacgccaacaagaaaacacgtggcgccttcatagcagccgtcttcgctatgcaaggcttcggaatcttagccggaggaatcgtgtctctcatcgtctcgagtacatttgaccatgccttcaaagcgcccacctacgaggttgatcctgttggctccactgttcctcaagcggattacgtgtggcggattgtgctcatgtttggagctatcccagctttacttacttattattggcggatgaaaatgccggaaactgctcggtataccgctcttgtagctcggaataccaaacaagccgcctccgatatgtctaaggtgcttcaagtggatctaattgcagaagaagaagcacaatcaaattcaaattcatcaaaccctaatttcaccttcggtttattcaccagagaattcgctcgccgtcacggtctccaccttctcggcacaaccaccacatggttcctcctagacatcgcctattacagcagcaacctcttccaaaaagacatctacacagcaatcggatggattcccgccgccgaaacaatgaacgcaatccacgaagtcttcaccgtctcaaaagctcaaaccctaatcgctctctgcggcaccgtccctggttactggttcaccgtcgcattcatcgatatactcggtcgattcttcatccagttgatgggatttatcttcatgacgatctttatgttcgctttagcgattccttatgatcattggagacatagagagaatcgaattggttttttgattatgtattcgttgactatgttcttcgctaattttggacctaatgcgacgacgtttgttgttcctgctgagatatttccggcgaggttgagatcgacttgtcatgggatatcggcggcgagtggtaaggcgggagcgattgttggagcgtttgggtttctttacgcggcgcagagttcggattcggagaagactgatgctggttatcctcctgggattggtgttaggaattcgttgttgatgcttgcttgtgttaatttcttggggattgtttttactctgttggttccggagtctaaagggaagtctttggaagagatttcgagagaagatgaggaacaaagcggcggagatacggtggtggagatgactgtggcaaattccggtagaaaagtcccggtttgattattttgtgttactcattttgtaaatttactctatatatgaaagtcccttgcat

SEQ ID NO: 1603 - protein, 542 aa, Arabidopsis thaliana
MAKKGKEVLNALDAAKTQMYHFTAIVIAGMGFFTDAYDLFSISLVTKLLGRIYYHVDSSKKPGTLPPNVAAAVNGVAFCGTLAGQLFFGWLGDKLGRKKVYGITLMLMVLCSLGSGLSFGHSANGVMATLCFFRFWLGFGIGGDYPLSATIMSEYANKKTRGAFIAAVFAMQGFGILAGGIVSLIVSSTFDHAFKAPTYEVDPVGSTVPQADYVWRIVLMFGAIPALLTYYWRMKMPETARYTALVARNTKQAASDMSKVLQVDLIAEEEAQSNSNSSNPNFTFGLFTREFARRHGLHLLGTTTTWFLLDIAYYSSNLFQKDIYTAIGWIPAAETMNAIHEVFTVSKAQTLIALCGTVPGYWFTVAFIDILGRFFIQLMGFIFMTIFMFALAIPYDHWRHRENRIGFLIMYSLTMFFANFGPNATTFVVPAEIFPARLRSTCHGISAASGKAGAIVGAFGFLYAAQSSDSEKTDAGYPPGIGVRNSLLMLACVNFLGIVFTLLVPESKGKSLEEISREDEEQSGGDTVVEMTVANSGRKVPV

SEQ ID NO: 1604 - DNA, 1551 bp, Arabidopsis thaliana
  CDS (1)..(1551)
atggctaacgaagaacaaggaagcatcttgaaagctcttgacgttgcaaagactcaatggtaccacgtcacggcggttgtagtctccggtatgggtttcttcacagactcatacgatctcttcgtgatatctcttatcacgaagcttcttggccggatctactatcaggttcctggctcctcctctcccggaagcctccctgacggcatctctgcggccgtgagtggtgtggccttcgctggaacgtttatcggacagattttctttgggtgtcttggtgacaagcttggacgtaagagagtctatggtttgactctcttgatcatgaccatatgctccatttgttctggtctttcccttggaagagacccgaaaaccgtcatggtaactctctgcttcttccgcttctggctcgggtttggcatcggtggtgactatcctctctcggctacgatcatgtccgagtattccaacaaacgtactcgcggtgctttcatagcagctgttttcggtatgcaagggattgggatccttgccgcaggagctgtctcgttacttgtctcagctgttttcgagagtaagtttccgtcccgagcctatatattggatggtgcagcctccaccgtcccacaggcggattacgtttggaggatcatcctgatggtcggcgccttaccagctctcttgacctactactggcggatgaagatgcccgaaaccgctcgttacacggctcttgtctccaagaacgcggagcaagcggctttagatatgactaaggttctcaacgtagacattgaagcctctgccgcaaagaatgatcaagctagggtttcctcggacgagtttggcttgttctccatgaagttccttcgccgtcacggactccacttactcggaacagcctccacatggttcctcctcgacatcgctttctacagccaaaacttgttccagaaggatatcttcaccaccattgggtggttaccttcggctaaaaccatgaacgcaatccaagagctctacatgatcgctaaggctcaaaccataatcgcttgttgcagcaccgttcccggttactttttcactgtagggttcatcgattatatgggacggaaaaagatccagatcatgggtttcgctatgatgaccatcttcatgctcagtttagccataccgtaccatcattggaccttaccggctaaccggattggtttcgtcgttctttactctttcacatttttcttctccaattttggacctaacgcaactactttcattgtcccggctgagattttcccggcgaggataaggtcgacttgtcacggtatatcggcggcgtctggtaaagccggtgcgatggtcggttctttcgggttttcggctttggttaaagctttgggtatgagtaacacgttatacatcatggcaggaatcaatttgcttggcttgcttctcacgtttacaattccggagactaatgggaaatcacttgaggagctttccggcgaaactgagccggagaaaatcaaggagaagattgttgtttag

SEQ ID NO: 1605 - protein, 516 aa, Arabidopsis thaliana
MANEEQGSILKALDVAKTQWYHVTAVVVSGMGFFTDSYDLFVISLITKLLGRIYYQVPGSSSPGSLPDGISAAVSGVAFAGTFIGQIFFGCLGDKLGRKRVYGLTLLIMTICSICSGLSLGRDPKTVMVTLCFFRFWLGFGIGGDYPLSATIMSEYSNKRTRGAFIAAVFGMQGIGILAAGAVSLLVSAVFESKFPSRAYILDGAASTVPQADYVWRIILMVGALPALLTYYWRMKMPETARYTALVSKNAEQAALDMTKVLNVDIEASAAKNDQARVSSDEFGLFSMKFLRRHGLHLLGTASTWFLLDIAFYSQNLFQKDIFTTIGWLPSAKTMNAIQELYMIAKAQTIIACCSTVPGYFFTVGFIDYMGRKKIQIMGFAMMTIFMLSLAIPYHHWTLPANRIGFVVLYSFTFFFSNFGPNATTFIVPAEIFPARIRSTCHGISAASGKAGAMVGSFGFSALVKALGMSNTLYIMAGINLLGLLLTFTIPETNGKSLEELSGETEPEKIKEKIVV

SEQ ID NO: 1606 - DNA, 1608 bp, Arabidopsis thaliana
  CDS (1)..(1608)
atggcaggagatcaactaaacgtgctaaacgcactcgacgtcgccaaaacgcaatggtaccatttcacggcgattataatcgccggaatgggattcttcaccgacgcttacgaccttttttgtatctcactcgtcacaaagcttcttggccgtatttactatcacgtggacggctcagagaagccaggaacgctgccaccaaacgtctcagccgctgttaatggagtcgccttctgcggtacactcgcaggccagctcttctttggctggctcggtgacaagcttgggaggaaaaaagtttacggtatgaccctcatggtcatggttctttgttccatcgcttcgggtctatcctttgggagtaacccaaaaacagtgatgactacactatgtttcttccggttctggcttggtttcggcattggtggtgattatccgttatccgccacgattatgtctgaatacgctaataaaaagacccgtggtgcgtttatagccgccgtttttgctatgcaagggtttggaatcttgaccggggggatttttgccatcatcgtgtctgccgctttcgaggctaaatttccagctccaacctatcaaatagatgccttggcatccacggttcctcaggcggattatgtgtggcggatcatactgatggtgggtgctttgcctgcagcgatgacgtattactcaaggtccaagatgcctgagactgcccggtacacggctcttgtggccaaggacgcgaaactagcggcttcaaacatgtctaaggttttgcaagtggagatcgaagcagagcagcagggaactgaagataagtccaattcctttggcttgttttccaaggaattcatgaaacgccatggccttcatttgctaggaactacaagcacatggttcctactcgacatcgccttctacagtcagaacctattccagaaagatattttcagcgcaatcggatggatccctccggctcagacaatgaacgcaattcaagaggttttcaagattgcacgtgcacaaaccctaatcgccttgtgtagcacggtacctggttactggttcacagtggcctttattgacgtcattggtagatttgcgatacagatgatgggtttcttctttatgaccgtctttatgttcgctctcgccattccttacgaccattggactcacaaggagaacagaatcggattcgttgctatgtactctctaacattcttcttcgccaactttggacctaatgcaacaactttcgttgtgcccgctgagatcttcccggctaggtttagatcaacctgccatggaatttccgcggcttctggaaaattaggagcaatggttggtgcgtttgggttcttgtacttagcacaaagtcctgacaagaccaagacagagcatggatatcctccaggtattggagtcaagaactccctcattgttttgggtgtggttaatcttttggggatggtttttacactgttggttcctgaatctaaaggcaagtctctcgaggaaatgtccggtgagaacgaacaaaatgatgaaagcagcagcagcagcaacaacaacagtaacaacgcagtgtcaactgcatag

SEQ ID NO: 1607 - protein, 535 aa, Arabidopsis thaliana
MAGDQLNVLNALDVAKTQWYHFTAIIIAGMGFFTDAYDLFCISLVTKLLGRIYYHVDGSEKPGTLPPNVSAAVNGVAFCGTLAGQLFFGWLGDKLGRKKVYGMTLMVMVLCSIASGLSFGSNPKTVMTTLCFFRFWLGFGIGGDYPLSATIMSEYANKKTRGAFIAAVFAMQGFGILTGGIFAIIVSAAFEAKFPAPTYQIDALASTVPQADYVWRIILMVGALPAAMTYYSRSKMPETARYTALVAKDAKLAASNMSKVLQVEIEAEQQGTEDKSNSFGLFSKEFMKRHGLHLLGTTSTWFLLDIAFYSQNLFQKDIFSAIGWIPPAQTMNAIQEVFKIARAQTLIALCSTVPGYWFTVAFIDVIGRFAIQMMGFFFMTVFMFALAIPYDHWTHKENRIGFVAMYSLTFFFANFGPNATTFVVPAEIFPARFRSTCHGISAASGKLGAMVGAFGFLYLAQSPDKTKTEHGYPPGIGVKNSLIVLGVVNLLGMVFTLLVPESKGKSLEEMSGENEQNDESSSSSNNNSNNAVSTA

SEQ ID NO: 1608 - DNA, 1605 bp, Arabidopsis thaliana
  CDS (1)..(1605)
atgccgataaaggtattgtcgtcgcttgatgtagctcgaacacaatggtaccatttcaaagcgatcatagtagcgggaatgggtctattcaccgacgcatacgatcttttctgcatagcaccggtcatgaaaatgattagtcatgtttattacaacggtgactcaatcaacacagccgttctttcaacttcttacgccatcgctttactcggcacagccacgggtcaactagtcttcggttacctcggtgaccgagtcggtcgtcgccgagtctacggactttgtttgattattatgatccttagctcctttggttgtggcttttccgtgtgcaccactcgtcggtcttgtgttatggttagcctcggttttttccggttctttcttggtttaggtatcggtggtgattacccgctctcggctaccattatgtcggagtttgctaataagaggacacgtggcgcgtttatcgctgcggtgttttcgatgcaagggttggggattttggttagctctgccgtgaccatggctgtttgcgtggcgtttaagagaagtggcggtggtttggaggtggatgcggcggctccgacggaagctgacttggcctggagacttatacttatgatcggtgctcttcctgctgcattgacgttctattggcgaatgttgatgcctgaaaccgcaagatacacagcacttgtagaaaacaatatcgtccaagcagcaaaagacatgcaaagagtcatgtcaagatctcatatctccgacgaagccacgacggatccacctcctcctccgccgccaccttcctacaaactcttctcccgctgcttcttccgcctccatggtcgcgacctcttcgcagcctcctttaattggttcctagtagacattgtcttctacacaagcaacctcctcctgtcccatatcttcagtcattactccaagaaaccttccactgcagaaaacgtctacgacgcagcctttgaagtggcggaattaggagccatcatcgctgcttgctccaccattcccggttattggttcacagtttacttcatcgacaagataggtcgtgtcaaaatccagattatggggtttttcttcatggccgttatttatttagtcgctggtattccgtacagttggtattggtcaaagcacgagcataataataaaggcttcatggttctctacggtttggttttcttcttttgcaattttggtcccaacactacaacttttattattcccgcagagcatttcccggctaggtttaggtctacttgtcacgggatctctggtgccgcgggtaagcttggggctattgtgggcactgttgggttcttgtgggctaccaagaagatggaaagcgatgataaaaaccagatttatcccgaagtaaaccgtatgagaattgctttcttgattcttggtggcgtttgcattgctggaatcttggtgacgtatttcttcaccaaggaaactatgggaagatcgttagaggagaacgagcatgaccaagataacaatgctgagtctgaagatgagccacagattgttgacgggcaatcctccgtgagcactttgcttcagacacgatga

SEQ ID NO: 1609 - protein, 534 aa, Arabidopsis thaliana
MPIKVLSSLDVARTQWYHFKAIIVAGMGLFTDAYDLFCIAPVMKMISHVYYNGDSINTAVLSTSYAIALLGTATGQLVFGYLGDRVGRRRVYGLCLIIMILSSFGCGFSVCTTRRSCVMVSLGFFRFFLGLGIGGDYPLSATIMSEFANKRTRGAFIAAVFSMQGLGILVSSAVTMAVCVAFKRSGGGLEVDAAAPTEADLAWRLILMIGALPAALTFYWRMLMPETARYTALVENNIVQAAKDMQRVMSRSHISDEATTDPPPPPPPPSYKLFSRCFFRLHGRDLFAASFNWFLVDIVFYTSNLLLSHIFSHYSKKPSTAENVYDAAFEVAELGAIIAACSTIPGYWFTVYFIDKIGRVKIQIMGFFFMAVIYLVAGIPYSWYWSKHEHNNKGFMVLYGLVFFFCNFGPNTTTFIIPAEHFPARFRSTCHGISGAAGKLGAIVGTVGFLWATKKMESDDKNQIYPEVNRMRIAFLILGGVCIAGILVTYFFTKETMGRSLEENEHDQDNNAESEDEPQIVDGQSSVSTLLQTR

SEQ ID NO: 1610 - DNA, 1599 bp, Arabidopsis thaliana
  CDS (1)..(1599)
atgccggagttaagtttattatcggcgttagacgcagcgaggatacagtggtaccatttcaaagcgataatagtcgccggaatgggacttttcaccgacgcatacgatcttttctgtatagctccgatcatgaaaatgataagtcaaatatattaccacaaagactcaatcggaaccgctcttctctcaacttcttacgcaatcgctcttcttggcaccgcgttaggtcagctcatctttggttacttaggtgaccgagtcggacgtcgtaaagtctatggacttagtctcttgatcatggtgtttagctcctttggttgtggcttctctgtttgcacgactcgacgttcttgtgttatggttagtcttggattctttagattcgttcttggacttggaatcggtggagattatcctctttcggccacgattatgtcggagtttgctaacaaaaggacgcgtggagcttttatcgctgccgtgttctcgatgcaagggttagggattttgatgagctctgctgtgactatggttgtgtgcttggcgttcaagaacgctggagaggggagttcggagaagacgaacgtggcggggttagagactttggctccgccggaatcggatatagcgtggaggttgattcttatgatcggagctcttcccgccgcgttaacgttttactggcgaatgctcatgcctgaaaccgccagatacacagcattggttgagaacaatgtagtccaagcagcaaaagacatgcaaagagtcatgtccgtatcaatgatatctcaaataaccgaagattcatcatcggagctagaacaaccaccgtcttcttcctcatacaaactcttctctcgccgtttcctcagtctccacggtcgagacctcttcgcagcctcagccaattggttcctagtggacgtcgtcttctatacaagcaatctccttctctctcaaatctttaacttctccaacaaacccctcaactccacaaacgtctacgactctgcctttgaagtagctaagcttgcagccattgtagccgcttgctccaccatccctggttactggttcacggtctatttcatcgataaaatcggtagagtcaagattcagatgatggggtttttccttatggcggtcgtttacttagtcgctgggattccgtatagttggtattggtctaagcatgagaagactaataaaggctttatggttctctacggattgattttcttctttagcaactttggccctaacacgacgacgtttatcatcccggcggagctttttccggctaggtttaggtccacgtgtcacgggatatctggagctgcagggaagtttggtgcgattgttggcactgtcggtttcttgtgggccacgagacaccatgaagaggacggttttccagatgtgaaacgtgtgagaatcgcgtttttgatccttggcggcgtttgtatcgcgggaatgatcgtaacgtatttgttcacgcgtgaaactatgggaagatcgttagaagagaacgaagacgagattgtttccacgtcagcagggtcgtctcctgcgaatgagttacttcggagacaatactaa

SEQ ID NO: 1611 - protein, 532 aa, Arabidopsis thaliana
MPELSLLSALDAARIQWYHFKAIIVAGMGLFTDAYDLFCIAPIMKMISQIYYHKDSIGTALLSTSYAIALLGTALGQLIFGYLGDRVGRRKVYGLSLLIMVFSSFGCGFSVCTTRRSCVMVSLGFFRFVLGLGIGGDYPLSATIMSEFANKRTRGAFIAAVFSMQGLGILMSSAVTMVVCLAFKNAGEGSSEKTNVAGLETLAPPESDIAWRLILMIGALPAALTFYWRMLMPETARYTALVENNVVQAAKDMQRVMSVSMISQITEDSSSELEQPPSSSSYKLFSRRFLSLHGRDLFAASANWFLVDVVFYTSNLLLSQIFNFSNKPLNSTNVYDSAFEVAKLAAIVAACSTIPGYWFTVYFIDKIGRVKIQMMGFFLMAVVYLVAGIPYSWYWSKHEKTNKGFMVLYGLIFFFSNFGPNTTTFIIPAELFPARFRSTCHGISGAAGKFGAIVGTVGFLWATRHHEEDGFPDVKRVRIAFLILGGVCIAGMIVTYLFTRETMGRSLEENEDEIVSTSAGSSPANELLRRQY

SEQ ID NO: 1612 - DNA, 1680 bp, Schizosaccharomyces pombe
  CDS (1)..(1680)
atgaatcgcttaaatcctttttcaaaatctcactccaaaaactccaatgaaaacaacgaagtttccttggctgatgtcgccgagtccgatactcgtcgccattggcttggtttgactaaacgagaattcaagctcatgggctttgctggtgccggtttcttcctcgattcttatgacttgttcatcattaatctcgtctcccccatttacgaatatttatactggggcggtttggagggcaaaaagcctcactacccttccggtatccatggtcttgtcaacgctgccgctaacattggaaatgtctttggtcaaatcttgtttggcttcatgggcgatttctttggtcgtaaatttgtctacggtaaagagatgatcgtcgttattattgctaccgtccttgtcatcgcccttcccaaaagtatacctactcctcttggtaaaatgatgtggatctttgcttggcgttggttgctgggtttaggaattggtggtgactatcctatgtccgcaacaatcacatcagaacgctctttgcttagtcgtcgtggtacccttctctccatcgtcttctcctttcaaggctttggtactctggccggcgccatcgtcactatcatcctcttggcctgctttgagaagcctctcaaccaacgtggcgagtacactaagcttgaaggtgtatggcgtcttcaaatgggtttggctttggttcctgccctcctcgttttgattccacgtctcactatgaaggaatccaagtcctatgaacagtcgaaagctctcaacaagtataccgacaacgatacctacattgctgacgacgacgaaccgaagaaagataaccaaaacgttgttgaagaaaagcaaattaatttgaccacctcctcggactctcaccctacttctacagaggattttggagataaacgtgcatccactgttccaacttctgagaataccagtggatttatcgaatatttcagtcaatggcaccatttcaagcatctcttggctactgccgtgtcctggttcctactcgatattgccttttacggtgttaatctcaatcaatccgtcattttaaaggccattggctttagttcgggaaagaatgagtatcacacacttatgcgtggtgctatcggtaatctcatcattgcaattgctggttatgttcctggttattggtttacagttttcctcgttgagaaacttggccgtaaatggatccaacttcaaggattgtttattaccggtttaatgtttgccatccttgcaggtagttgggacaccatttctacgggtggaagatttgcatgttttgtcattgcccaatttttctctaattttggacccaatgccactacttttttgtatcctgctgaagtttttcctgcacgtgttcgtggtaccgctcatggtctttctgctgctttgggtaaatgcggtgccatcttggcttctctgttgtttaacttcttaacatctgtaattggctatggcaatgtcatgtggattttctgcggctgcatgtggggagcaatctttttcactttgcttctccctgaaaccaagatgcgggatgccgatgaaattgatcgcgaagaagttttgcgcggtggtaatggtaaaactcaccagggccgctggtcttggtatttcaacggaattttctaa

SEQ ID NO: 1613 - protein, 559 aa, Schizosaccharomyces pombe
MNRLNPFSKSHSKNSNENNEVSLADVAESDTRRHWLGLTKREFKLMGFAGAGFFLDSYDLFIINLVSPIYEYLYWGGLEGKKPHYPSGIHGLVNAAANIGNVFGQILFGFMGDFFGRKFVYGKEMIVVIIATVLVIALPKSIPTPLGKMMWIFAWRWLLGLGIGGDYPMSATITSERSLLSRRGTLLSIVFSFQGFGTLAGAIVTIILLACFEKPLNQRGEYTKLEGVWRLQMGLALVPALLVLIPRLTMKESKSYEQSKALNKYTDNDTYIADDDEPKKDNQNVVEEKQINLTTSSDSHPTSTEDFGDKRASTVPTSENTSGFIEYFSQWHHFKHLLATAVSWFLLDIAFYGVNLNQSVILKAIGFSSGKNEYHTLMRGAIGNLIIAIAGYVPGYWFTVFLVEKLGRKWIQLQGLFITGLMFAILAGSWDTISTGGRFACFVIAQFFSNFGPNATTFLYPAEVFPARVRGTAHGLSAALGKCGAILASLLFNFLTSVIGYGNVMWIFCGCMWGAIFFTLLLPETKMRDADEIDREEVLRGGNGKTHQGRWSWYFNGIF

SEQ ID NO: 1614 - DNA, 1719 bp, Schizosaccharomyces pombe
  CDS (1)..(1719)
atggcatttgggagcaaaattttaaacattggatctaagtctgatgagtataacgacgatgcagtacctctcgaccaagtcgaagagggtgcgcaagagcgtcgctattacttggggttgacaaagcgcgaatttaaacttatgatgcttgcaggtgtcgggtttttccttgacagttacgatctttttatcatcaatttagttactcccatttttgaatatctttattggggtggtattgaaaaaggtcccacaggaaaaggccattatccctctggtattcgtggtcttgtaaatgcgtcagccaatattggtaacatttttggacaactgttatttggttttatgggtgatttctttggccgtaaatttgtctacggtaaagaaatggttattgttatcatcgctactgttctggttatcgctatgcctaaaagcattcattctcctctttcgaaaatgatgtgggttttctgttggcgttggttgctcggtgtaggtattggtggtgattatccaatgtctgccgctatcacttctgagcgtagtaaaattaaacgacgtggtacacttatttctttaatttttgccttccaaggtttcggaactcttgctggtgccattgttaccatcatccttttgggttgtttcgaacatccattgaatcgggaaggtcattatcataaactcgaaggtgtctggcgtcttcaatttggtcttgctttggttcctgctattggtgttcttattccccgtctcatcatgaaagaatctaaatcatacgagaattctaaagcacttaatagtgctgaaggaaaagatccaaaggcattcttcaataccgatgatgaggacaatatgaagaagtcatctagccatggtgactccgaggttgtcgaagcttctgatcgttatgctaatcaagcagatgctgctgacgctgaagttgataacattgaaaaacaatttgccgcagttacaacccctgaaaacagcagtggatttatcacttacttcagacaatggcgtcattttaagcatcttttgggtacatctgtttgttggtttctgttggatattgccttttacggtgtcaatcttaatcaatctgtcattctcaagaatattggcttcagtactggtacgaacgaataccgcacattgatgaaaaacgcaattggcaacttgattatcgctgttgccggctatgttcctggatactggttcaacgtcttccttgttgaaattcttggacgtaaatggattcaactacaaggcttcgtgattactggtttgatgtttgcaattttggcaggacgttggaacgaaatttccactggtggtcgatttgcttgttttgttattgcccaactgttttctaactttggtcccaactccaccacttttatttatcccgctgaggttttccctgcacgcgtacgtggtactgctcatggtgtttcagctgctttgggtaaatgtggcgctattcttgcatcacttctttttaactttttgaccggtgttattggatatggtaacgttatgtggattttctgcggatgcatgtggggtggcattcttttcacacttttgcttcctgaaacaaagggtcgtgatgctgatgaaattgataggttggaattattttatggcaaggacggcaaagttcaatgtgatagcaagtggaagagctggtattttaatggaatcttttaa

SEQ ID NO: 1615 - protein, 572 aa, Schizosaccharomyces pombe
MAFGSKILNIGSKSDEYNDDAVPLDQVEEGAQERRYYLGLTKREFKLMMLAGVGFFLDSYDLFIINLVTPIFEYLYWGGIEKGPTGKGHYPSGIRGLVNASANIGNIFGQLLFGFMGDFFGRKFVYGKEMVIVIIATVLVIAMPKSIHSPLSKMMWVFCWRWLLGVGIGGDYPMSAAITSERSKIKRRGTLISLIFAFQGFGTLAGAIVTIILLGCFEHPLNREGHYHKLEGVWRLQFGLALVPAIGVLIPRLIMKESKSYENSKALNSAEGKDPKAFFNTDDEDNMKKSSSHGDSEVVEASDRYANQADAADAEVDNIEKQFAAVTTPENSSGFITYFRQWRHFKHLLGTSVCWFLLDIAFYGVNLNQSVILKNIGFSTGTNEYRTLMKNAIGNLIIAVAGYVPGYWFNVFLVEILGRKWIQLQGFVITGLMFAILAGRWNEISTGGRFACFVIAQLFSNFGPNSTTFIYPAEVFPARVRGTAHGVSAALGKCGAILASLLFNFLTGVIGYGNVMWIFCGCMWGGILFTLLLPETKGRDADEIDRLELFYGKDGKVQCDSKWKSWYFNGIF

SEQ ID NO: 1616 - DNA, 1521 bp, Glycine max
  CDS (1)..(1521)
atggctaggttgaaggtgttgtctgccctagacacagcaaggacacaatactaccacttcaaagccatcatcattgcagggatggggctcttcaccgatgcctacgacctcttctcaatcactctcatcatcaagataattggaagggtatattacggccaccgcgaaggtgaaaaccggtacgaaaccccaccggaggtcgtgtccgccttggtcgccgtcgccctgctgggcaccgccgtcggccagctggtatttggccggcttggcgacctcaaggggcgacggcgagtgtacggattcgctcttttgttgatggtcttcagctccttagcttctggcttctccatttgcataagaaaaacctgcgttctcctcactcttggcttcttcaggtacttcctggggctgggtattggaggagactaccctcagtcttctaccataatatcggagtttgcgaacaagaagacaagagggtcgttcatagcggcggtgttttcgatgcaaggcttcggcatattggccagctccaccgtgaccatggcagtgtgctccatattcggcgcagcgtccaagaattccgaggctgacgtggcatggagactcatactcatgctcggttctgtccccgcagccatgacttactactggcgcatgatgatgcccgaaaccgccaggtacacagcattagtggagcaaaatgtgatgcaagcagcaaaggacatggagaaagtccttgatgtaacactgagccagattgctgaagaagatcctttgccaccaaccccgcatgcttaccctctactttcatgggaatacttgcgtaagcacggtcctgacctatttgcatgttctttcacatggttccttgtggacattgtgttctatagccaagttttgttccaaagtgaaatatacaaacgctacctagacaaaaaggaggacgtggatgtgtatcaagagactttccatgctgcatggatccaagccgttattgctgtttgttccacaattcctggctacttcttctcaatgtatttcattgacaaatggggaagggtcaaaaatccaatgatgggctttttcttcatggcattggcctttttctccattggaattccctattactcttattggaccaccaaggaacatcataagaataaagtgttcatggtgttgtatggacttgcttttttctttgccaattttgggcccaacactactactttcatagtcccggctgagctttttcctgctaggtttaggtcaagttgtcatggcatttctggggcagttggcaaggttggggcaattattgggtctgtggggtttctttgggcttcacatagaaagaaggaggatgggtaccctaagggaattgggatgaaagtgtcccttattatacttggaggggtgtgcttattgggaatggtgatcacctaccttttcacgagggaaaccatgggaaggtctttggaagagaatgaggttgagattgaagagcaagataatctttga

SEQ ID NO: 1617 - protein, 506 aa, Glycine max
MARLKVLSALDTARTQYYHFKAIIIAGMGLFTDAYDLFSITLIIKIIGRVYYGHREGENRYETPPEVVSALVAVALLGTAVGQLVFGRLGDLKGRRRVYGFALLLMVFSSLASGFSICIRKTCVLLTLGFFRYFLGLGIGGDYPQSSTIISEFANKKTRGSFIAAVFSMQGFGILASSTVTMAVCSIFGAASKNSEADVAWRLILMLGSVPAAMTYYWRMMMPETARYTALVEQNVMQAAKDMEKVLDVTLSQIAEEDPLPPTPHAYPLLSWEYLRKHGPDLFACSFTWFLVDIVFYSQVLFQSEIYKRYLDKKEDVDVYQETFHAAWIQAVIAVCSTIPGYFFSMYFIDKWGRVKNPMMGFFFMALAFFSIGIPYYSYWTTKEHHKNKVFMVLYGLAFFFANFGPNTTTFIVPAELFPARFRSSCHGISGAVGKVGAIIGSVGFLWASHRKKEDGYPKGIGMKVSLIILGGVCLLGMVITYLFTRETMGRSLEENEVEIEEQDNL

SEQ ID NO: 1618 - DNA, 1521 bp, Glycine max
  CDS (1)..(1521)
atggctaggttgaaggtgttgtctgccctagacacagcaaggacacaatactaccacttcaaagccatcatcattgcagggatggggctcttcaccgatgcctacgacctcttctcaatcactctcatcatcaagataattggaagggtatattacggccaccgcgaaggtgaaaaccggtacgaaaccccaccggaggtcgtgtccgccttggtcgccgtcgccctgctgggcaccgccgtcggccagctggtatttggccggcttggcgacctcaaggggcgacggcgagtgtacggattcgctcttttgttgatggtcttcagctccttagcttctggcttctccatttgcataagaaaaacctgcgttctcctcactcttggcttcttcaggtacttcctggggctgggtattggaggagactaccctcagtcttctaccataatatcggagtttgcgaacaagaagacaagagggtcgttcatagcggcggtgttttcgatgcaaggcttcggcatattggccagctccaccgtgaccatggcagtgtgctccatattcggcgcagcgtccaagaattccgaggctgacgtggcatggagactcatactcatgctcggttctgtccccgcagccatgacttactactggcgcatgatgatgcccgaaaccgccaggtacacagcattagtggagcaaaatgtgatgcaagcagcaaaggacatggagaaagtccttgatgtaacactgagccagattgctgaagaagatcctttgccaccaaccccgcatgcttaccctctactttcatgggaatacttgcgtaagcacggtcctgacctatttgcatgttctttcacatggttccttgtggacattgtgttctatagccaagttttgttccaaagtgaaatatacaaacgctacctagacaaaaaggaggacgtggatgtgtatcaagagactttccatgctgcatggatccaagccgttattgctgtttgttccacaattcctggctacttcttctcaatgtatttcattgacaaatggggaagggtcaaaaatccaatgatgggctttttcttcatggcattggcctttttctccattggaattccctattactcttattggaccaccaaggaacatcataagaataaagtgttcatggtgttgtatggacttgcttttttctttgccaattttgggcccaacactactactttcatagtcccggctgagctttttcctgctaggtttaggtcaagttgtcatggcatttctggggcagttggcaaggttggggcaattattgggtctgtggggtttctttgggcttcacatagaaagaaggaggatgggtaccctaagggaattgggatgaaagtgtcccttattatacttggaggggtgtgcttattgggaatgttggtcacctaccttttcactagggaaaccatgggaaggtctttggaagagaatgaggttgagattgaagagcaagataatctttga

SEQ ID NO: 1619 - protein, 506 aa, Glycine max
MARLKVLSALDTARTQYYHFKAIIIAGMGLFTDAYDLFSITLIIKIIGRVYYGHREGENRYETPPEVVSALVAVALLGTAVGQLVFGRLGDLKGRRRVYGFALLLMVFSSLASGFSICIRKTCVLLTLGFFRYFLGLGIGGDYPQSSTIISEFANKKTRGSFIAAVFSMQGFGILASSTVTMAVCSIFGAASKNSEADVAWRLILMLGSVPAAMTYYWRMMMPETARYTALVEQNVMQAAKDMEKVLDVTLSQIAEEDPLPPTPHAYPLLSWEYLRKHGPDLFACSFTWFLVDIVFYSQVLFQSEIYKRYLDKKEDVDVYQETFHAAWIQAVIAVCSTIPGYFFSMYFIDKWGRVKNPMMGFFFMALAFFSIGIPYYSYWTTKEHHKNKVFMVLYGLAFFFANFGPNTTTFIVPAELFPARFRSSCHGISGAVGKVGAIIGSVGFLWASHRKKEDGYPKGIGMKVSLIILGGVCLLGMLVTYLFTRETMGRSLEENEVEIEEQDNL

SEQ ID NO: 1620 - DNA, 1665 bp, Zea mays
  CDS (1)..(1665)
atgacggcgccgggcgggtcgaacctggcggtgctggacgcgctggactcggcgcgcacccagatgtaccacatgaaggccatagtcatcgccggcatgggcttcttcaccgacgcctacgacctcttctgcatctccaccgtgtccaagctgctcggccgcatctactacccggacgacaacctgtacatagacaagcccaagcccggcactctgcccgtgtccgtcaacaacatggtgacaggcgtcgcgctcgtcggcacgctcatgggccagctcgtcttcggctacttcggcgacaagctcgggcggaagcgcgtgtacggcatcacgctcgtgctgatggccgcctgcgccatcggctcgggcctctcgttcggcagctcggcgcacgccgtcatcggcacgctctgcttcttccgcttctggctcggcttcggcatcggcggggactacccgctgtccgcgaccatcatgtccgagtactccaacaagaagacgcggggcgcgttcatcgccgcggtgttcgcgatgcagggcgtcggcatcatcttcgcggggctcgtgtccatgatcgtctcgggcatcctcctgcactaccacccggcgccggcgtggaaggagaaccacgaccggtcgtggcaggaccagatgccggcggcggactacatgtggcgcatcgtcctgatgatcggcgcgttcccggcgctggccacgttctactggcggatgaagatgcccgagacggcaaggtacaccgcgctcatcgagggcaacgccaagcaggcggccaacgacatgcagaaggtgatggacgtcgagatccaggccgagcaggacaagctcgcgaggtacaaggcggcgaacgactacccgctgctgtcgagggagttcgcccggcgccacggcctgcacctcatcggcacggccaccacgtggttccttctcgacatagccttctacagccagaacctgacccagaaagacatcttcccggcgatcaaactgacgagccccgtcgacgacataaacgccctcaaggaggtgttcgagatttccaaggccatgttcctcgtcgcactcctcggcaccttccccggctactgggtcaccgtcgcgctcatcgacaaaatgggcaggtacctgatccagctcatcggtttcttcatgatgtctgtcttcatgctactgatgggcgtcatgtacaacgacctcaagaacaaacacaccacgctcttcgccctcttctacgcgctcaccttcttcttcgccaacttcggccccaacagcaccaccttcgtgctgccggccgagctattcccgacgcgcgtgcgctccacctgccacgccatcagcgccgcgtcaggcaaggccggcgccatcgtcgcggccttcggggtgcagagcctcacgctcaagggagacgtgggccacatcaagaaggcgctcatcatcctctccgtcaccaacatcctcggcttcttcttcaccttcctcgtcccggagaccatgggccgctcgctcgaggagatctccggggaggacggcaacgtcgaaaacggtcccggtgctcccgccggcgtggccatgggcgtcgcggacgtgagcaaggatgacaagatgcctgtttccagtactgagtggcagagctccatgcatgcgtga

SEQ ID NO: 1621 - protein, 554 aa, Zea mays
MTAPGGSNLAVLDALDSARTQMYHMKAIVIAGMGFFTDAYDLFCISTVSKLLGRIYYPDDNLYIDKPKPGTLPVSVNNMVTGVALVGTLMGQLVFGYFGDKLGRKRVYGITLVLMAACAIGSGLSFGSSAHAVIGTLCFFRFWLGFGIGGDYPLSATIMSEYSNKKTRGAFIAAVFAMQGVGIIFAGLVSMIVSGILLHYHPAPAWKENHDRSWQDQMPAADYMWRIVLMIGAFPALATFYWRMKMPETARYTALIEGNAKQAANDMQKVMDVEIQAEQDKLARYKAANDYPLLSREFARRHGLHLIGTATTWFLLDIAFYSQNLTQKDIFPAIKLTSPVDDINALKEVFEISKAMFLVALLGTFPGYWVTVALIDKMGRYLIQLIGFFMMSVFMLLMGVMYNDLKNKHTTLFALFYALTFFFANFGPNSTTFVLPAELFPTRVRSTCHAISAASGKAGAIVAAFGVQSLTLKGDVGHIKKALIILSVTNILGFFFTFLVPETMGRSLEEISGEDGNVENGPGAPAGVAMGVADVSKDDKMPVSSTEWQSSMHA

SEQ ID NO: 1622 - DNA, 1680 bp, Triticum aestivum
  CDS (1)..(1680)
atggcgcgcgagcagctggaggtgctgacggcgctggacgcggccaagacgcagtggtaccacttcacggccatcgtcatcgccggcatgggcttcttcaccgacgcctacgacctcttctgcatctccctcgtcaccaagctgctcggccgcatctactactaccgcgagggcgccgacgcgcccggctcgctcccgcccaacgtcgccgccgccgtcaacggcgtcgccttctgcggcacgctctccggccagctcttcttcggctggctcggcgaccgcatgggccgcaagcgcgtctacggcatgacgctcatgtgcatggtgctctgctccatcgcctccggcctctccttcggctccacccccggttccgtcatggccacgctctgcttcttccgcttctggctcggcttcggcatcggcggcgactacccgctctccgccaccatcatgtccgagtacgccaacaagaagacgaggggcgccttcatcgccgccgtcttcgccatgcagggcttcggcatcctcaccggcggcgtcgtcacgctcatcgtctccgccgcgttccgcgccgccttccacacgcccgcctaccaggacgcccccctcgcctccacgccgccgcaggccgacttcgtgtggcgcttcatcctcatgttcggggccgtcccggccctcatgacctactactggcggatgaagatgcccgagacggcgcgctacacggcgctcgtcgccaagaacgccaagcaggccgcggccgacatgtccaaggtgctccaggtggacatcggcgccgaggaagaggaccccaaggccaacgacggcggcgccggagccgccgacgaccgcaactcgttcgggctcttctccggcgagttcctgcgccggcacgggctgcacctcctcggcacggccacctgctggttcctgctcgacatcgccttctactcgcagaacctgttccagaaggacattttcacggcgatcaactggatccccaaggccaagacgatgagcgccctcgaggaggtgcatcgcatcgcgcgcgcgcagacgctcatcgcgctctgcggcacggtgccgggctactggttcacggtggcgctgatcgaccggatcgggcggttctggatccagctgggcggcttcttcttcatggcggtgttcatgctggggctcgccttcccgtaccaccactggacgacgccggggaaccacatcgggttcgtggtgctgtacgcgctcaccttcttcttcgccaacttcgggcccaactccaccaccttcatcgtgcccgccgagatcttcccggcgaggctccggtcgacgtgccacggcatctccgcggcggccgggaagctgggggccatcgtggggtcgttcgggttcctgtacctggcgcagaacaaggacccggccaaggtggaccacgggtacaaggccggcatcggggtgaggaactcgctcttcatcctcgccgcctgcaacttcctgggcatgggcttcaccttctgcgcgcccgagtccaacggcatctcgctcgaggagctctcccggcgagaacgacgacggcgaggcggccgcgccggcgcacgccaggacggtgcccgtgtgagacagtcctcgtcagatagtatattctgcaggtttggatggatgtatggatcattttaa

SEQ ID NO: 1623 - protein, 559 aa, Triticum aestivum
MAREQLEVLTALDAAKTQWYHFTAIVIAGMGFFTDAYDLFCISLVTKLLGRIYYYREGADAPGSLPPNVAAAVNGVAFCGTLSGQLFFGWLGDRMGRKRVYGMTLMCMVLCSIASGLSFGSTPGSVMATLCFFRFWLGFGIGGDYPLSATIMSEYANKKTRGAFIAAVFAMQGFGILTGGVVTLIVSAAFRAAFHTPAYQDAPLASTPPQADFVWRFILMFGAVPALMTYYWRMKMPETARYTALVAKNAKQAAADMSKVLQVDIGAEEEDPKANDGGAGAADDRNSFGLFSGEFLRRHGLHLLGTATCWFLLDIAFYSQNLFQKDIFTAINWIPKAKTMSALEEVHRIARAQTLIALCGTVPGYWFTVALIDRIGRFWIQLGGFFFMAVFMLGLAFPYHHWTTPGNHIGFVVLYALTFFFANFGPNSTTFIVPAEIFPARLRSTCHGISAAAGKLGAIVGSFGFLYLAQNKDPAKVDHGYKAGIGVRNSLFILAACNFLGMGFTFCAPESNGISLEELSRRERRRRGGRAGARQDGARVRQSSSDSIFCRFGWMYGSF

SEQ ID NO: 1624 - DNA, 1602 bp, Glycine max
  CDS (1)..(1602)
atggctggagaattgggagttttgaatgcacttgatgtggcaaagacacaatggtaccacttcactgctattgtgatcgctggaatgggtttcttcaccgatgcctatgacctcttctgcatttccctagtcaccaagcttctagggaggctatattacacagaaccaggtgcaccaaagccaggttcacttcctccaagagttcaagcttctgtgactggtgtagcactatgtggcacattagccggccaactattctttggttggcttggtgacaaaatggggagaaaaagagtctatggactaacactcattctcatggtagtgtgctcccttgcctcaggactctcctttgggtcaactccagagggtgtcatggcctcactttgcttcttcaggttctggctagggtttgggattggtggtgactaccctctttctgccacaatcatgtctgaatatgccaacaagaagacgcgtggcgcgttcatagccgcggtgtttgcaatgcaaggattcggaatcctggctggtggagtggtggcattgattgtttcatatgcatatgaccaaaagtacaagcttcctagttatgaacagaatccagaagcatccttggaccccgcatttgactatgtttggagaatagttttgatgtttggtgcagttcctgctgcactcacctactactggcgcatgaagatgccagagacagcacgttacactgcccttgtggccaagaatgcaaaacaagctgctgcagacatgtctaaggtgttgcaagtggaacttgaagctgaagaggagaaggtgaagaaattgacagagaatgagagcaacaagtatggtttgttcaccaaggaatttgtgaaacgccatggcctgcatttgttgggaaccaccaccacttggttcttgttggacatagcattctacagccaaaaccttttccagaaggacattttcagtgcaattgggtggatccctccagcaaaggaaatgaatgcaatccacgaggtgtataagattgcaagagcacaaacactcatagcactatgcagtactgtgccaggttactggttcacagtggcattaattgattacatgggccgttttgccatccaattgttggggttcttcttcatgactgtgttcatgtttgctttggctataccatatgatcattggtctgagaaagaaaacagaattgggtttgtggtgatgtactctttcacctttttctttgccaattttggtccaaattccaccacatttgttgtgccagcagagattttccctgcaaggctaaggtccacttgccatggaatctctgctgctgcaggaaaggctggtgcaattgtgggtgcatttgggttcctatatgctgcacaaagcaaggacccttccaagactgatgcagggtaccctactggtattggaattaagaactcactcattatgcttggtgtgatcaacttcattgggatgttgttcaccttgcttgttccagaatcaaagggaaaatcactggaggagttgagtggggagaatggtgaaaatgatgctgaacatgcagtgtctgctaggacagttcctgtttga

SEQ ID NO: 1625 - protein, 533 aa, Glycine max
MAGELGVLNALDVAKTQWYHFTAIVIAGMGFFTDAYDLFCISLVTKLLGRLYYTEPGAPKPGSLPPRVQASVTGVALCGTLAGQLFFGWLGDKMGRKRVYGLTLILMVVCSLASGLSFGSTPEGVMASLCFFRFWLGFGIGGDYPLSATIMSEYANKKTRGAFIAAVFAMQGFGILAGGVVALIVSYAYDQKYKLPSYEQNPEASLDPAFDYVWRIVLMFGAVPAALTYYWRMKMPETARYTALVAKNAKQAAADMSKVLQVELEAEEEKVKKLTENESNKYGLFTKEFVKRHGLHLLGTTTTWFLLDIAFYSQNLFQKDIFSAIGWIPPAKEMNAIHEVYKIARAQTLIALCSTVPGYWFTVALIDYMGRFAIQLLGFFFMTVFMFALAIPYDHWSEKENRIGFVVMYSFTFFFANFGPNSTTFVVPAEIFPARLRSTCHGISAAAGKAGAIVGAFGFLYAAQSKDPSKTDAGYPTGIGIKNSLIMLGVINFIGMLFTLLVPESKGKSLEELSGENGENDAEHAVSARTVPV

SEQ ID NO: 1626 - DNA, 1629 bp, Zea mays
  CDS (1)..(1629)
atggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgccgccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacttcgtgtggcgggtcatcctcatgctcggcgccgcgccggcgctgctcacctactactggcggatgaagatgcccgagacggcgcggtacacggcgctggtggccaagaacgccaagcaggccgcggccgacatgtccaaggtgctgcacacggagatcctggacgagcaggagaagctggacgggatggtcgccgccgagggcgccaacagcttcggcctcttctccagggagttcgcgcgccgccacggcctccacctcgtcggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagaccctcatcgcgctctgcggcacagtcccgggctactggttcaccgtcgcgctcatcgacgtcgtcggccgcttcgccatacagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaggagcaagacggacgccggctaccccgcgggcatcggcgtgcgcaactcgctcttcgtcctcgccgccagcaacatgctcggcttcgtcctcacgttcctcgtgccggagtccaagggcaagtcgctcgaggagatgtccggtgaggctgaagactcagaggaggagcccgtcggcgcccgtgcggtgcggccgtcggagacccagatggtgtag

SEQ ID NO: 1627 - protein, 542 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLHTEILDEQEKLDGMVAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMV

SEQ ID NO: 1628 - DNA, 1626 bp, Zea mays
  CDS (1)..(1626)
atggcgcgcggcggggacggcctgcaggtgctcagcgcgctggacgcggcgaagacgcagtggtaccacttcacggccatcatcgtcgccggcatgggcttcttcacggacgcctacgacctcttctgcatctccctcgtcaccaagctgctggggcgcatctactacacggacaccagcaaggacaacccgggctcgctcccgcccaacgtcgccgcggcggtcaacggcgtcgccttctgcggcacgctggccggccagctcttcttcggctggctcggggacaagctcgggcgcaagagcgtgtacgggatgacgctcatgctcatggtcatctgctccgtcgcgtcgggcctctcgttcggccacacgcccacgggggtcatggccacgctctgcttcttccgcttctggctcgggttcggcatcggcggggactacccgctgtcggcgaccatcatgtccgagtacgccaacaagaagacccgcggcgccttcatcgcggccgtcttcgccatgcagggcttcggcatcctcgccggcggcattgtcacgctcgtcatctccgccgccttccgcgcggggtacccggccccggcgtacagggacgaccacttcaactccaccgtgccgcaggccgactacgtgtggcgcatcatcctcatcctgggcgccgcgccggcgatgctcacctactactggcggatgaagatgcccgagacggcgcgctacaccgcgctcgtggccaagaacgccaagcaggccgcggccgacatgtccagggtgctccagacggagatcgtcgacgagcaggagaagctggacgagatggtcaccgccgagagcaacaccttcggcctcttctccagggagttcgcgcgccgccacgggctccacctcgtcggcacctccaccacgtggttcctgctcgacatcgccttctacagccagaacctgttccagaaggacatcttcaccagcatcaactggatccccaaggccaacaccatgagcgcgctggaggaggtgtcccgcatctcccgcgcccagacgctcatcgcgctctgcggcaccgtcccgggctactggttcaccgtcgcgctcatcgacgtcgtcggccgcttcgccatccagctgctcggcttcttcatgatgaccgtcttcatgctcggcctcgccatcccctaccaccactggaccacgcccggcaaccacatcggcttcgtcgtcatgtacgccttcaccttcttcttcgcaaacttcggccccaacagcaccaccttcatcgtgccggccgagatcttcccggcgcggctgcggtccacatgccacggcatctccgccgcctcggggaaggccggcgccatcatcggggcctttgggttcctgtacgcggcgcagaaccaggacaagagcaaggcggacgccgggtaccccgcgggcatcggcgtacgcaattcgctcttcgtcctcgctgcctccaacttgcttggctttatcctcaccttcctcgtgccggagtccaagggtaagtcgctcgaggagatgtccggggaggctgacgacgccgaggacgacgccgtcggcacccgcgcggtgcggccgtcggggacccagatggtgtag

SEQ ID NO: 1629 - protein, 541 aa, Zea mays
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSVASGLSFGHTPTGVMATLCFFRFWLGFGIGGDYPLSATIMSEYANKKTRGAFIAAVFAMQGFGILAGGIVTLVISAAFRAGYPAPAYRDDHFNSTVPQADYVWRIILILGAAPAMLTYYWRMKMPETARYTALVAKNAKQAAADMSRVLQTEIVDEQEKLDEMVTAESNTFGLFSREFARRHGLHLVGTSTTWFLLDIAFYSQNLFQKDIFTSINWIPKANTMSALEEVSRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKADAGYPAGIGVRNSLFVLAASNLLGFILTFLVPESKGKSLEEMSGEADDAEDDAVGTRAVRPSGTQMV

SEQ ID NO: 1630 - DNA, 1575 bp, Zea mays
  CDS (1)..(1575)
atggcgggaggccagctcaacgtgctgaccacactcgaccaggccaagacacaatggtaccatttcatggcgatcgtcatcgccggcatggggttcttcaccgacgcatacgatttgttctgtatcgcgctcgtgaccaagctcctcggccgcatctactactccgaccccacctccaaggaccccggcagcctcccgcccaacgtgtcggccgccgtgaccggcgtcgccctctgcggcacgctggcgggacagctcttcttcggctggctcggcgacaagctcggccgcaagagcgtctacggcttcaccctcatcctcatggtgctctgctccgtcgcgtccggcctctcgttcgggcatacgcccaagggcgtcatcgccacgctctgcttcttccgcttctggctcggcttcggcatcggcggcgactacccgctgagcgccaccatcatgtccgagtacgccaacaagaagacccgcggcgccttcatcgccgccgtgttcgccatgcaggggttcggcatcctcttcggcaccatcgtggcgctcgccgtctcggcggcgttccggaacgcgttcccggccccgccctacttcgtggacgcccaggcgtcgctcgtcccggaggccgactatgtctggcgcgtcatcctcatgttcggcaccgtcccggccgcgctcacctactactggcgcatgaagatgcccgagacggcgcggtacacggcgctcatcgcccgcaacacgaagcaggccacggccgacatggccaaggtgctcaagaaggagatcgagaaagaggatgagcaggtggagcgccaggtggtcggcgccgacacatggggcctcttctcggcgcagttcctccggcgccatggcctccacctgttggccaccagcagcacgtggttcctgctggacatcgccttctacagccagaacctcttccagaaggacatcttcaccaaggtcgggtggataccgccggcgaggaccatgaacgccatcgaggaggtgtaccgcatctcgcgcgcccaggcgctgatcgcgctctgcggcaccatcccgggctactggttcaccgtcggcctcatcgacatcgtgggcaggttctggatccagatcatgggcttcttcatgatgaccgtgttcatgctcgcgctcggggtgccgtacgagcactggaccaaggcgtccaaccacaccggcttcgtcgtcctctacgggctcaccttcttcttcgcaaacttcgggcccaacagcaccaccttcatcgtgccggccgagatcttcccggcgaggctccggtccacgtgccacggcatatcggcagcggccggcaaggccggcgccatcatcggcgcgttcgggttcctgtacgcggcgcaggaccccaagaagcccgaccatggctactcgccgggcatcggcatccgcaacacgctcttcgtgctcgccggaaccaacttcctgggcatgctcatgtcggtgttcgtgccggagtccaagggcatgtcgcttgaggagatctccaaggagaacgtggatgatgaagctgaggccgaagtgtag

SEQ ID NO: 1631 - protein, 524 aa, Zea mays
MAGGQLNVLTTLDQAKTQWYHFMAIVIAGMGFFTDAYDLFCIALVTKLLGRIYYSDPTSKDPGSLPPNVSAAVTGVALCGTLAGQLFFGWLGDKLGRKSVYGFTLILMVLCSVASGLSFGHTPKGVIATLCFFRFWLGFGIGGDYPLSATIMSEYANKKTRGAFIAAVFAMQGFGILFGTIVALAVSAAFRNAFPAPPYFVDAQASLVPEADYVWRVILMFGTVPAALTYYWRMKMPETARYTALIARNTKQATADMAKVLKKEIEKEDEQVERQVVGADTWGLFSAQFLRRHGLHLLATSSTWFLLDIAFYSQNLFQKDIFTKVGWIPPARTMNAIEEVYRISRAQALIALCGTIPGYWFTVGLIDIVGRFWIQIMGFFMMTVFMLALGVPYEHWTKASNHTGFVVLYGLTFFFANFGPNSTTFIVPAEIFPARLRSTCHGISAAAGKAGAIIGAFGFLYAAQDPKKPDHGYSPGIGIRNTLFVLAGTNFLGMLMSVFVPESKGMSLEEISKENVDDEAEAEV

SEQ ID NO: 1632 - DNA, 1632 bp, Zea mays
  CDS (1)..(1632)
atggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcatggccggcggcctcgtggccatcgtcgtgtccgcgtcgttcaaggccaggttcccagccccggcctacgccgtcgaccccgccgggtccacgccgccgcaggccgacttcgtgtggcggatcatcctgatgctgggcgcgatgcccgcggcgctcacctactactggcgcaccaagatgcccgagacggcgcggtacacggcgctggttgccaagaacgccaagcaggccgcggctgacatgtccaaggtgctgcaggtggagatctcagccggcgcccccgaggaggacgccgcggctgcgactgcgactgcgcctgcgccggcgtcggcgtcctttgggctcttctccggggagttcctccgccggcacgggctgcacctcctgggcacgtcctcgacgtggttcctgctggacatcgccttctactcgcagaacctgttccagaaggacatcttcagcgcggtggggtggatccccaaggcggcgacgatgaacgcgctggaggagctgttcagcatcgcgcgggcgcagtccctgatcgcgctgtgcggcacggtgcccggctactggttcacggtggcgctgatcgacgtgttggggcggttcgcgatccaggtgacggggttcctgatgatgacggtgttcatgctggggctggccgtgccgtacgagcactggacgacgccggggcaccacatcggcttcatcgtcatgtacggcctcaccttcttcttcgccaacttcgggcccaacgcgaccacgttcatcgtgcccgcggagatcttcccggccaggctgcggtcgacgtgccacggcatctcggcggcgtcggggaagctgggcgccatcatcggctccttcgggttcctgtacctggcgcaaaaccgggacccggccaagacggaccacgggtaccccgcgggcatcggcgtgcgcaactcgctgttcctcctcgccggctgcaacctgctgggcctggcattcacgttcctggtgccggagtccaagggcaaatccctggaggagatgtccggcgagaacgacgaggcggccgccgccgccgccacgccgaactacaacaaccgcacagtgcccgtgtaa

SEQ ID NO: 1633 - protein, 543 aa, Zea mays
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSEYANKKTRGAFIAAVFAMQGFGIMAGGLVAIVVSASFKARFPAPAYAVDPAGSTPPQADFVWRIILMLGAMPAALTYYWRTKMPETARYTALVAKNAKQAAADMSKVLQVEISAGAPEEDAAAATATAPAPASASFGLFSGEFLRRHGLHLLGTSSTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGENDEAAAAAATPNYNNRTVPV

SEQ ID NO: 1634 - DNA, 1620 bp, Zea mays
  CDS (1)..(1620)
atggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgccgccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacatcgtgtggcgggtcatcgtcatgctcggcgccgcgccggcgctgctcacctactactggcggatgaagatgcccgagacggcgcggtacacggcgctggtggccaagaacgccaagcaggccgccgccgacatgtccaaggtgctgcacacggagatcgtggacgagcaggagaagctggacgccgccgagggcgccaacagcttcggcctcttctccagggagttcgcgcgccgccacggcctccacctcgtcggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagaccctcatcgcgctctgcggcacagtcccgggctactggttcaccgtcgcgctcatcgacgtcgtcggccgcttcgccatacagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaggagcaagacggacgccggctaccccgcgggcatcggcgtgcgcaactcgctcttcgtcctcgccgccagcaacatgctcggcttcgtcctcacgttcctcgtgccggagtccaagggcaagtcgctcgaggagatgtccggtgaggctgaagactcagaggaggagcccgtcggcgcccgtgcggtgcggccgtcggagacccagatggtgtag

SEQ ID NO: 1635 - protein, 539 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADIVWRVIVMLGAAPALLTYYWRMKMPETARYTALVAKNAKQAAADMSKVLHTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMV

SEQ ID NO: 1636 - DNA, 26 bp, Artificial sequence
  primer
atgagttccgtcaataaagatactat

SEQ ID NO: 1637 - DNA, 26 bp, Artificial sequence
  primer
ttatgcttcatgttgaagttgagatg

SEQ ID NO: 1638 - protein, 663 aa, Artificial sequence
  consensus sequence
  Variant (2)..(4): Xaa in position 2 to 4 is any amino acid
  Variant (6)..(6): Xaa in position 6 is any amino acid
  Variant (8)..(9): Xaa in position 8 to 9 is any amino acid
  Variant (10)..(12): Xaa in position 10 to 12 is any or no amino acid
  Variant (14)..(19): Xaa in position 14 to 19 is any amino acid
  Variant (22)..(22): Xaa in position 22 is any amino acid
  Variant (33)..(33): Xaa in position 33 is any amino acid
  Variant (35)..(43): Xaa in position 35 to 43 is any amino acid
  Variant (44)..(44): Xaa in position 44 is any or no amino acid
  Variant (46)..(61): Xaa in position 46 to 61 is any amino acid
  Variant (62)..(77): Xaa in position 62 to 77 is any or no amino acid
  Variant (79)..(81): Xaa in position 79 to 81 is any amino acid
  Variant (85)..(85): Xaa in position 85 is any amino acid
  Variant (88)..(88): Xaa in position 88 is any amino acid
  Variant (90)..(90): Xaa in position 90 is any amino acid
  Variant (91)..(91): Xaa in position 91 is any or no amino acid
  Variant (93)..(93): Xaa in position 93 is any amino acid
  Variant (94)..(94): Xaa in position 94 is any or no amino acid
  Variant (98)..(99): Xaa in position 98 to 99 is any amino acid
  Variant (102)..(103): Xaa in position 102 to 103 is any amino acid
  Variant (105)..(112): Xaa in position 105 to 112 is any amino acid
  Variant (113)..(130): Xaa in position 113 to 130 is any or no amino acid
  Variant (132)..(134): Xaa in position 132 to 134 is any amino acid
  Variant (136)..(137): Xaa in position 136 to 137 is any amino acid
  Variant (140)..(140): Xaa in position 140 is any amino acid
  Variant (153)..(153): Xaa in position 153 is any amino acid
  Variant (156)..(156): Xaa in position 156 is any amino acid
  Variant (158)..(161): Xaa in position 158 to 161 is any amino acid
  Variant (164)..(167): Xaa in position 164 to 167 is any amino acid
  Variant (171)..(171): Xaa in position 171 is any amino acid
  Variant (175)..(175): Xaa in position 175 is any amino acid
  Variant (176)..(176): Xaa in position 176 is any or no amino acid
  Variant (178)..(183): Xaa in position 178 to 183 is any amino acid
  Variant (185)..(192): Xaa in position 185 to 192 is any amino acid
  Variant (193)..(218): Xaa in position 193 to 218 is any or no amino acid
  Variant (220)..(220): Xaa in position 220 is any amino acid
  Variant (221)..(221): Xaa in position 221 is any or no amino acid
  Variant (224)..(228): Xaa in position 224 to 228 is any amino acid
  Variant (230)..(231): Xaa in position 230 to 231 is any amino acid
  Variant (234)..(237): Xaa in position 234 to 237 is any amino acid
  Variant (239)..(239): Xaa in position 239 is any amino acid
  Variant (241)..(243): Xaa in position 241 to 243 is any amino acid
  Variant (247)..(247): Xaa in position 247 is any amino acid
  Variant (251)..(257): Xaa in position 251 to 257 is any amino acid
  Variant (258)..(259): Xaa in position 258 to 259 is any or no amino acid
  Variant (261)..(281): Xaa in position 261 to 281 is any amino acid
  Variant (282)..(413): Xaa in position 282 to 413 is any or no amino acid
  Variant (415)..(416): Xaa in position 415 to 416 is any amino acid
  Variant (418)..(420): Xaa in position 418 to 420 is any amino acid
  Variant (423)..(423): Xaa in position 423 is any amino acid
  Variant (426)..(426): Xaa in position 426 is any amino acid
  Variant (430)..(432): Xaa in position 430 to 432 is any amino acid
  Variant (434)..(437): Xaa in position 434 to 437 is any amino acid
  Variant (439)..(458): Xaa in position 439 to 458 is any amino acid
  Variant (459)..(485): Xaa in position 459 to 485 is any or no amino acid
  Variant (489)..(491): Xaa in position 489 to 491 is any amino acid
  Variant (493)..(495): Xaa in position 493 to 495 is any amino acid
  Variant (497)..(498): Xaa in position 497 to 498 is any amino acid
  Variant (501)..(502): Xaa in position 501 to 502 is any amino acid
  Variant (505)..(506): Xaa in position 505 to 506 is any amino acid
  Variant (509)..(510): Xaa in position 509 to 510 is any amino acid
  Variant (512)..(520): Xaa in position 512 to 520 is any amino acid
  Variant (521)..(521): Xaa in position 521 is any or no amino acid
  Variant (523)..(533): Xaa in position 523 to 533 is any amino acid
  Variant (534)..(555): Xaa in position 534 to 555 is any or no amino acid
  Variant (557)..(560): Xaa in position 557 to 560 is any amino acid
  Variant (563)..(563): Xaa in position 563 is any amino acid
  Variant (569)..(569): Xaa in position 569 is any amino acid
  Variant (570)..(571): Xaa in position 570 to 571 is any or no amino acid
  Variant (575)..(576): Xaa in position 575 to 576 is any amino acid
  Variant (578)..(578): Xaa in position 578 is any amino acid
  Variant (580)..(580): Xaa in position 580 is any amino acid
  Variant (583)..(583): Xaa in position 583 is any amino acid
  Variant (585)..(585): Xaa in position 585 is any amino acid
  Variant (587)..(587): Xaa in position 587 is any amino acid
  Variant (589)..(589): Xaa in position 589 is any amino acid
  Variant (594)..(594): Xaa in position 594 is any amino acid
  Variant (596)..(596): Xaa in position 596 is any amino acid
  Variant (599)..(599): Xaa in position 599 is any amino acid
  Variant (602)..(603): Xaa in position 602 to 603 is any amino acid
  Variant (604)..(645): Xaa in position 604 to 645 is any or no amino acid
  Variant (647)..(648): Xaa in position 647 to 648 is any amino acid
  Variant (649)..(649): Xaa in position 649 is any or no amino acid
  Variant (651)..(653): Xaa in position 651 to 653 is any amino acid
  Variant (654)..(654): Xaa in position 654 is any or no amino acid
  Variant (657)..(659): Xaa in position 657 to 659 is any amino acid
  Variant (660)..(660): Xaa in position 660 is any or no amino acid
LXXXDXAXXXXXHXXXXXXAGXGFFTDAYDLFXIXXXXXXXXXXYXXXXXXXXXXXXXXXXXXXXXXXXXXXXXXXXGXXXGQLXFGXLXXDXXGRKXXYGXXLXXXXXXXXXXXXXXXXXXXXXXXXXXLXXXRXXLGXGIGGDYPLSATIXSEXAXXXXRGXXXXAVFXMQGXXGXXXXXXVXXXXXXXXXXXXXXXXXXXXXXXXXXXXXXXXXXDXXWRXXXXXGXXPAXXXXYXRXXXPETXRYTXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXTXXXWFXLDXAFYXXXLXXXXIXXXXXXXXXXXXXXXXXXXXXXXXXXXXXXXXXXXXXXXXXXXXXXXPGYXXXVXXXDXXGRXXIQXXGFXXMXXXXXXXXXXYXXXXXXXXXXXXXXXXXXXXXXXXXXXXXXXXXYXXXXFFXNFGPNXXXTTFXXPXEXFPXRXRXTXHGISXAXGKXGAXXXXXXXXXXXXXXXXXXXXXXXXXXXXXXXXXXXXXXXXXXXXGXXXTXXXXPEXXXXSLE

SEQ ID NO: 1639 - protein, 29 aa, Artificial sequence
  protein pattern
  Variant (2)..(3): Xaa in position 2 to 3 is any amino acid
  Variant (4)..(4): Xaa in position 4 is Leu, Met or Val
  Variant (6)..(6): Xaa in position 6 is Phe, Ile, Leu or Val
  Variant (14)..(14): Xaa in position 14 is any amino acid
  Variant (16)..(16): Xaa in position 16 is Ala or Ser
  Variant (17)..(17): Xaa in position 17 is any amino acid
  Variant (18)..(18): Xaa in position 18 is Ile, Met or Val
  Variant (19)..(19): Xaa in position 19 is any amino acid
  Variant (21)..(21): Xaa in position 21 is Asp or Glu
  Variant (22)..(22): Xaa in position 22 is any amino acid
  Variant (23)..(23): Xaa in position 23 is Ala or Ser
  Variant (24)..(27): Xaa in position 24 to 27 is any amino acid
RXXXGXGIGGDYPXSXXXXSXXXXXXXRG

SEQ ID NO: 1640 - protein, 29 aa, Artificial sequence
  protein pattern
  Variant (2)..(2): Xaa in position 2 is any amino acid
  Variant (6)..(6): Xaa in position 6 is Ala, Cys, Ser, Thr or Val
  Variant (10)..(10): Xaa in position 10 is Ile, Leu or Val
  Variant (11)..(11): Xaa in position 11 is any amino acid
  Variant (13)..(13): Xaa in position 13 is Ala or Gly
  Variant (15)..(15): Xaa in position 15 is any amino acid
  Variant (16)..(16): Xaa in position 16 is Phe or Tyr
  Variant (18)..(18): Xaa in position 18 is Ala or Thr
  Variant (20)..(20): Xaa in position 20 is any amino acid
  Variant (22)..(22): Xaa in position 22 is Ala, Cys, Gly, Ser or Thr
  Variant (23)..(23): Xaa in position 23 is Ser or Thr
  Variant (24)..(24): Xaa in position 24 is Ala, Cys, Gly or Ser
  Variant (26)..(26): Xaa in position 26 is Ala or Gly
  Variant (27)..(27): Xaa in position 27 is Phe, Ile, Leu or Val
  Variant (28)..(29): Xaa in position 28 to 29 is Ala, Gly or Ser
NXGPNXTTFXXPXEXXPXRXRXXXHXXXX

SEQ ID NO: 1641 - protein, 33 aa, Artificial sequence
  protein pattern
  Variant (2)..(3): Xaa in position 2 to 3 is any amino acid
  Variant (6)..(7): Xaa in position 6 to 7 is any or no amino acid
  Variant (9)..(10): Xaa in position 9 to 10 is any amino acid
  Variant (11)..(12): Xaa in position 11 to 12 is any or no amino acid
  Variant (14)..(15): Xaa in position 14 to 15 is any amino acid
  Variant (16)..(16): Xaa in position 16 is Leu or Pro
  Variant (17)..(17): Xaa in position 17 is Ala or Gly
  Variant (18)..(19): Xaa in position 18 to 19 is any amino acid
  Variant (20)..(20): Xaa in position 20 is Ala, Cys, Gly, Thr or Val
  Variant (21)..(26): Xaa in position 21 to 26 is any amino acid
  Variant (27)..(27): Xaa in position 27 is Ile or Met
  Variant (28)..(28): Xaa in position 28 is Ala, Ile or Pro
  Variant (30)..(30): Xaa in position 30 is Ser or Thr
  Variant (31)..(31): Xaa in position 31 is any amino acid
  Variant (32)..(32): Xaa in position 32 is Lys or Arg
  Variant (33)..(33): Xaa in position 33 is Phe or Tyr
DXXWRXXIXXXXGXXXXXXXXXXXXXXXEXXXX

SEQ ID NO: 1642 - protein, 16 aa, Artificial sequence
  protein pattern
  Variant (3)..(3): Xaa in position 3 is any amino acid
  Variant (6)..(6): Xaa in position 6 is Phe, Leu or Met
  Variant (7)..(7): Xaa in position 7 is any amino acid
  Variant (9)..(9): Xaa in position 9 is Ala or Ser
  Variant (12)..(12): Xaa in position 12 is Phe, Ile or Leu
  Variant (13)..(13): Xaa in position 13 is Phe or Leu
  Variant (14)..(14): Xaa in position 14 is any amino acid
  Variant (15)..(15): Xaa in position 15 is Ala, Ile or Val
  Variant (16)..(16): Xaa in position 16 is Ala, Gly, Asn, Ser or Thr
AGXGFXXDXYDXXXXX

SEQ ID NO: 1643 - protein, 34 aa, Artificial sequence
  protein pattern
  Variant (2)..(4): Xaa in position 2 to 4 is any amino acid
  Variant (7)..(7): Xaa in position 7 is Phe, Leu or Val
  Variant (8)..(8): Xaa in position 8 is any amino acid
  Variant (11)..(12): Xaa in position 11 to 12 is any amino acid
  Variant (13)..(13): Xaa in position 13 is Ala or Gly
  Variant (15)..(16): Xaa in position 15 to 16 is any amino acid
  Variant (19)..(20): Xaa in position 19 to 20 is any amino acid
  Variant (21)..(21): Xaa in position 21 is Phe, Ile, Met or Val
  Variant (24)..(25): Xaa in position 24 to 25 is any amino acid
  Variant (26)..(26): Xaa in position 26 is Ile, Leu or Met
  Variant (27)..(29): Xaa in position 27 to 29 is any amino acid
  Variant (30)..(30): Xaa in position 30 is Ala, Ile or Val
  Variant (31)..(32): Xaa in position 31 to 32 is any amino acid
  Variant (33)..(33): Xaa in position 33 is Ala, Cys, Ser, Thr or Val
  Variant (34)..(34): Xaa in position 34 is Phe, Ile, Leu, Met or Val
GXXXGQXXFGXXXDXXGRXXXYGXXXXXXXXXXX

SEQ ID NO: 1644 - protein, 14 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (7)..(7): Xaa in position 7 is any amino acid
  Variant (9)..(9): Xaa in position 9 is any amino acid
  Variant (11)..(11): Xaa in position 11 is Gly or Ser
  Variant (12)..(12): Xaa in position 12 is any amino acid
  Variant (13)..(13): Xaa in position 13 is Gly, Asn or Ser
  Variant (14)..(14): Xaa in position 14 is Phe, Ile, Leu or Val
WXXLXDXAXYXXXX

SEQ ID NO: 1645 - protein, 17 aa, Artificial sequence
  protein pattern
  Variant (2)..(4): Xaa in position 2 to 4 is any or no amino acid
  Variant (7)..(8): Xaa in position 7 to 8 is any amino acid
  Variant (9)..(9): Xaa in position 9 is Ile or Leu
  Variant (11)..(12): Xaa in position 11 to 12 is any amino acid
  Variant (15)..(16): Xaa in position 15 to 16 is any amino acid
  Variant (17)..(17): Xaa in position 17 is Leu or Met
IXXXGRXXXQXXGFXXX

SEQ ID NO: 1646 - protein, 19 aa, Artificial sequence
  protein pattern
  Variant (2)..(2): Xaa in position 2 is any or no amino acid
  Variant (5)..(5): Xaa in position 5 is Ala, Gly or Ser
  Variant (6)..(6): Xaa in position 6 is any amino acid
  Variant (8)..(9): Xaa in position 8 to 9 is any or no amino acid
  Variant (11)..(11): Xaa in position 11 is any amino acid
  Variant (12)..(12): Xaa in position 12 is Gly, Ile or Leu
  Variant (13)..(16): Xaa in position 13 to 16 is any amino acid
  Variant (17)..(17): Xaa in position 17 is Ala, Gly, Ile or Val
  Variant (18)..(18): Xaa in position 18 is any amino acid
  Variant (19)..(19): Xaa in position 19 is Phe, Ile, Leu, Met or Val
AXVFXXQXXGXXXXXXXXX

SEQ ID NO: 1647 - protein, 10 aa, Artificial sequence
  protein pattern
  Variant (2)..(2): Xaa in position 2 is any amino acid
  Variant (5)..(5): Xaa in position 5 is Ala, Ile, Leu or Val
  Variant (8)..(8): Xaa in position 8 is any amino acid
  Variant (9)..(9): Xaa in position 9 is Ala, Ile, Leu or Val
  Variant (10)..(10): Xaa in position 10 is Ala, Gly, Ser or Thr
AXGKXGAXXX

SEQ ID NO: 1648 - DNA, 1500 bp, Saccharomyces cerevisiae
  CDS (1)..(1500)
atgtcttacaattttacaggtacgcctacaggcgaaggaacgggtggtaactcgttgacaacagatttgaatacacaatttgacttggccaacatgggatggatcggtgtggcttcagcaggtgtgtggattatggtcccaggtatcggtttattatattctggtttatccaggaaaaagcatgctttatccttgctttgggcctcgatgatggcttccgccgtgtgtattttccaatggtttttctggggatactcattagctttctcacacaacactagaggtaacggttttattggtaccttggaattctttgggtttcgtaacgttttaggagccccatctagtgtcagttctcttcccgatatactgtttgccgtttaccaaggtatgtttgccgcagtcaccggtgccctaatgctaggtggtgcctgcgagagggcaaggttgtttcctatgatggtgttcttgtttttatggatgactattgtttattgtcctattgcatgctgggtctggaatgccgagggttggttggtcaaattgggtagcttggactatgcaggtggtttatgtgtccatttaacatctggacatggtggtctagtttacgctttgatactgggtaagcgtaatgaccctgttacacgtaaagggatgcccaagtacaaaccacattccgtcacctcggtggttttaggcacagtgttcttatggtttggttggatgttctttaacggaggctctgcaggtaatgcaactatacgagcatggtactctattatgtccacaaacttagctgctgcttgcggtggcttgacatggatggttatcgattatttcagatgcggaagaaagtggactacagttggtttgtgttcaggtatcatcgctggcctagtgggtatcaccccagccgccgggttcgtgccaatctggtcagccgttgtcattggtgtggttactggtgcaggatgtaaccttgctgttgacttaaagagtctattgcgcatcgatgatggtctagattgttactctatccatggtgtgggtggttgtattggttctgtattaactggtatctttgctgcagactatgtaaatgccactgcaggctcttacattagtccaattgatggtggctggatcaatcatcactataaacaagttggttatcaattagcaggtatatgcgctgcactagcctggactgttactgtcacatctatcttgcttctaactatgaatgccattccatttttaaaactaagattaagtgctgatgaggaagaattaggtaccgacgctgctcaaattggtgaatttacatacgaggaatccactgcttacatcccagaaccaatcagatctaaaacatcggcacaaatgccacctcctcatgaaaacattgatgataagattgtgggtaacacagacgcagaaaagaattctacgccttccgacgcttcttctactaagaacactgaccatatagtataa

SEQ ID NO: 1649 - protein, 499 aa, Saccharomyces cerevisiae
MSYNFTGTPTGEGTGGNSLTTDLNTQFDLANMGWIGVASAGVWIMVPGIGLLYSGLSRKKHALSLLWASMMASAVCIFQWFFWGYSLAFSHNTRGNGFIGTLEFFGFRNVLGAPSSVSSLPDILFAVYQGMFAAVTGALMLGGACERARLFPMMVFLFLWMTIVYCPIACWVWNAEGWLVKLGSLDYAGGLCVHLTSGHGGLVYALILGKRNDPVTRKGMPKYKPHSVTSVVLGTVFLWFGWMFFNGGSAGNATIRAWYSIMSTNLAAACGGLTWMVIDYFRCGRKWTTVGLCSGIIAGLVGITPAAGFVPIWSAVVIGVVTGAGCNLAVDLKSLLRIDDGLDCYSIHGVGGCIGSVLTGIFAADYVNATAGSYISPIDGGWINHHYKQVGYQLAGICAALAWTVTVTSILLLTMNAIPFLKLRLSADEEELGTDAAQIGEFTYEESTAYIPEPIRSKTSAQMPPPHENIDDKIVGNTDAEKNSTPSDASSTKNTDHIV

SEQ ID NO: 1650 - DNA, 1959 bp, Oryza sativa
  CDS (151)..(1725)
gttcgtttctacacggatagagtttctgcttggcccggccatcgcacgccctgcccctccagctctgcttccaccagacgggcgtcgagtcttgcacgtgtaactctccagtccagtcccgggctgtctcaccaccaccaccgcgacaccatgtcgtactcgtgggtgggcgcccccgccgagttcaatggcacgaaccaggagaccggcggtgattccaccaccgagaacctgaaccaatggtaccagtcgggagaccaggccttcatcctcgtggcctcatgcatggtcctgatcatggtacctggtatcgccttcctctactccggcctctcacgaagaaagtcggctctgtctttgatctgggtcgttatgatgtccttcagcgtcgtcgtattccagtggtatttctggggttactccctggccctcagcagcacggcaaccaacgggttcatcggcgacctgcaccactttggcctccggaacaccctcgccaagccctcgccgggctccgccctcatccctgagctgctctactctttttaccagatgcaattctgtgccgtgaccgcagcgctcgtggtgggcgcgaccgccgaacgaggccgggtactccccgccatgattttcgtcttcttctgggccacgctggtctactgccccatcgcctgctgggtttggaacgtcaacggatgggccttcaaatacggcgtgctcgactacgccggtggcggccccgtcgaaatcggctccggcatgtcggcgctggcctactcctggatcctcggccgccgccacgaaaagatgatgctcaacttccggcctcacaacgtgtcactcattacgctgggaaccatcctcctgtggttcgggtggctgggcttcaacggcggctcgacctttggcgccaaccttcgtgccaccatggcttgctggaactcgtgcctgacggccatgtttgccgccatgacgtggtgtctgctcgattttcgcctggccaagaagtggtccatggtcggctggtgctctggcgtcatctcgggtcttgttgctgctacgccggcctctggattcatccctccctgggcttcgattattctgggcgtcgtgaccggcgtctgctgcaatttcggcaccaagatcaagttcctcgtcgggattgatgattctctggacgtcttcgccgagcacggaatcggcggtattgttggcctccttttcaacgccttcttcggagcaagctacattgtcgggttggatggtgtcaatacgggcgccgccatgggtggctggttggaccacacctggaagcagctgtacatccagattgccttcatcgtcgcctgcagcgcatacacgtttgtcatgtccgccatcatcgccaagctcatcgacatggtccctggtctgcacctccgggcgagcgaggaggccgagttgctcggcatggacgacaccgagctgggagagtttgcctacgactacgtcgaggttcgccgagatttcttggcctggactccggccatcgaagagcccatgacgcacggtgcgcgcatcgtcccgcaacacggcatcgaggagcacgccaacatggccaacacgaacggcacctcgctcgagtcgcaggaggagaagattggcgcctcagcgcgcgccccggcgaagcaagaggcggccgagaaggcggccggcgcggccccagacagtgaggccacgcagtagagggccggccggctgcgtgttgatgaaagtgacccaagtcaggggaagaagagattaaatcatattggaagatattggattggattgttgggatctgtactaataccccgccgttgcgcggtcctgccggtaaaccggcgtgatgctcggttttaccctcaaaaagggggtctagggagcgaggagttgacaaggagtttaccaaatcaagataccatgttttttcttctgggc

SEQ ID NO: 1651 - protein, 524 aa, Oryza sativa
MSYSWVGAPAEFNGTNQETGGDSTTENLNQWYQSGDQAFILVASCMVLIMVPGIAFLYSGLSRRKSALSLIWVVMMSFSVVVFQWYFWGYSLALSSTATNGFIGDLHHFGLRNTLAKPSPGSALIPELLYSFYQMQFCAVTAALVVGATAERGRVLPAMIFVFFWATLVYCPIACWVWNVNGWAFKYGVLDYAGGGPVEIGSGMSALAYSWILGRRHEKMMLNFRPHNVSLITLGTILLWFGWLGFNGGSTFGANLRATMACWNSCLTAMFAAMTWCLLDFRLAKKWSMVGWCSGVISGLVAATPASGFIPPWASIILGVVTGVCCNFGTKIKFLVGIDDSLDVFAEHGIGGIVGLLFNAFFGASYIVGLDGVNTGAAMGGWLDHTWKQLYIQIAFIVACSAYTFVMSAIIAKLIDMVPGLHLRASEEAELLGMDDTELGEFAYDYVEVRRDFLAWTPAIEEPMTHGARIVPQHGIEEHANMANTNGTSLESQEEKIGASARAPAKQEAAEKAAGAAPDSEATQ

SEQ ID NO: 1652 - DNA, 1431 bp, Oryza sativa
  CDS (1)..(1431)
atgaagatgcgccttctcaccgggtggcaagcccggttccacctggtgtgcctgctgatgctgctcagcgcgctggccgccggcgcctggccgggcagcgcccaggcccaggcccaggtctcgccgttgccgagcgaaagcgtggcggtcgagccgctgcacgacgcggccgccaccgccgctgcgccggccgtggccgaagccgccgccgcctatgatcgtggcgacgtcgcctggatgcttacctccacgttgctggtgctgctgatggtggtgcccggtctggccctgttctacggcggactggtgcgttcgaagaatgtgctgtcggtgctcagccagatcctggtggtgttctcgctggtgctgctgctgtgggtggcctatggctacagcgcggtgttcagcgcgggcaatccattcttcggttcgttcaccgagttcgccttcctcaagggcttcaccccggattcggtgggcaacacgccgatcaagggcctgccggattacctgttcgtcgccttccagtcgaccttcgctggcatcaccaccgcgctgatcgtcggtgccttcgccgagcgcatcaagttccgcgcggtgctgctgttctcggcactgtggttcaccctcagctacatcccgatggcacacatcgtctggggcggcggctacctgggtgaactgggcgcgatcgacttcgccggcggcaccgtggtgcacatcaatgcgggcgtggccggcctggtcggcgcgtggttcgtcggcaagcgcctgggctacggccagaccgcgctgaagccgcacaatgtgccgtttacctacatcggcgcgatgctgctgtgggtgggctggttcggcttcaatgccggttccgccgccgccgccgatacggtggcctcgctggccttcctcaacaccgtgctggccaccgctgctgccgtgcttggctggaccctggtggaggcgatcggcaagggcaagccgtcggcgctgggtgcggcctcgggtgcggtggccgggctggtcggcatcaccccggcctgtggcaccgtcgggccgcttggcgcgatcgtgatcggctttgtcgccggcgtggtctgcgtgtggggcgtgaccggtctcaagcgcctgctgaaagtggacgacacggccgacgtgttcggtgtgcatggtgtcggcggcatcgtcggcgcgatcctcaccggcgtgttcagtgcacagtcgttgggcggtaccaaggccgatctggatattgcccatcaggtgtgggtgcaggtggtcagcgtcggcttgaccgtactgtggtcggcggtggtgaccgcggtcatcctgctggtggtcaaggtcgtggtcggcctgcgcgtgaccgaagaggccgaacgcaccggcctggatgtgacttcgcacggcgagtctgcctacgaggcctga

SEQ ID NO: 1653 - protein, 476 aa, Oryza sativa
MKMRLLTGWQARFHLVCLLMLLSALAAGAWPGSAQAQAQVSPLPSESVAVEPLHDAAATAAAPAVAEAAAAYDRGDVAWMLTSTLLVLLMVVPGLALFYGGLVRSKNVLSVLSQILVVFSLVLLLWVAYGYSAVFSAGNPFFGSFTEFAFLKGFTPDSVGNTPIKGLPDYLFVAFQSTFAGITTALIVGAFAERIKFRAVLLFSALWFTLSYIPMAHIVWGGGYLGELGAIDFAGGTVVHINAGVAGLVGAWFVGKRLGYGQTALKPHNVPFTYIGAMLLWVGWFGFNAGSAAAADTVASLAFLNTVLATAAAVLGWTLVEAIGKGKPSALGAASGAVAGLVGITPACGTVGPLGAIVIGFVAGVVCVWGVTGLKRLLKVDDTADVFGVHGVGGIVGAILTGVFSAQSLGGTKADLDIAHQVWVQVVSVGLTVLWSAVVTAVILLVVKVVVGLRVTEEAERTGLDVTSHGESAYEA

SEQ ID NO: 1654 - DNA, 1458 bp, Medicago truncatula
  CDS (1)..(1458)
atggctgctccaccggtaaacacattaccggtagcataccaagcatggacaagtctagcagtaccagactggttaaacaaaggagacaactcatggcaaatgatatcagctacccttgttggaattcaaagcatgccaggactagttatcctctatggcagcatagtgaaaaagaaatgggctgtaaactctgctttcatggctctctacgctttcgcggcggttataatctgttgggttacatgggcttataagatgtcatttggtgaaaaacttttacccttttggggtaaagctggccctgctttaggccagaaatttctaatcagacaggcagggctacccgcgacggtgcattatcatcatgacggtagtttggagactgctgagattgaaccattttatccaatggctactatggtttggtttcagtgtgtttttgctgctatttcacttgttatattggctggttctgttttggctaggatgaattttaaggcttggatgatgtttgtgccactttggttaactttttcttatactattggtgcttttagtttgtggggtggtggtttcttgtttcaatggggtgttatggattattctggtggttatgttattcatctttcttctgggattgctggtttcaccgctgcttattgggtggggcctagatcgaagaaggacagggagagattcccaccaaacaatgtgttactaacgttggcaggggcagggttactatggatgggatgggcaggtttcaacggtggagatccctactctgccaacattgattcatcaatggctgttctcaacacaaacatttgtgctgctacaagcctccttgtatggacatggcttgatgtcatattcttcaaaaaaccatcagttattggagctgttcaaggcatgattactggtcttgtttgcattactcccggagctggtttggttcaaggatgggctgccatagtaatgggagtgctatcaggaagtgtgccatggtacacaatgatggtacttggaaagaagatatcaatatttcaaaaggttgatgacaccctcgccgtgttccacactcatgccgtggctggcctactaggcggtgtactcaccggcctattcgccgagccacaattaagtactctctttctccccgtcaccaattccaaaggaggtgtctatggaggctctggtggtgtccaaattttaaaacaaatagttggagctttattcatcgttggatggaacattgttgctacttcaataatttgtctagttataagtttcattgttcctttaagaatgacggaggaagagttgctcattggggatgatgcagttcatggggaagaagcttatgctttatggggtgatggagagaaacttagtctctacaaagatgatactacacaacatggcatggcttcaagtggtgtcactcaagttgtctag

SEQ ID NO: 1655 - protein, 485 aa, Medicago truncatula
MAAPPVNTLPVAYQAWTSLAVPDWLNKGDNSWQMISATLVGIQSMPGLVILYGSIVKKKWAVNSAFMALYAFAAVIICWVTWAYKMSFGEKLLPFWGKAGPALGQKFLIRQAGLPATVHYHHDGSLETAEIEPFYPMATMVWFQCVFAAISLVILAGSVLARMNFKAWMMFVPLWLTFSYTIGAFSLWGGGFLFQWGVMDYSGGYVIHLSSGIAGFTAAYWVGPRSKKDRERFPPNNVLLTLAGAGLLWMGWAGFNGGDPYSANIDSSMAVLNTNICAATSLLVWTWLDVIFFKKPSVIGAVQGMITGLVCITPGAGLVQGWAAIVMGVLSGSVPWYTMMVLGKKISIFQKVDDTLAVFHTHAVAGLLGGVLTGLFAEPQLSTLFLPVTNSKGGVYGGSGGVQILKQIVGALFIVGWNIVATSIICLVISFIVPLRMTEEELLIGDDAVHGEEAYALWGDGEKLSLYKDDTTQHGMASSGVTQVV

SEQ ID NO: 1656 - DNA, 1464 bp, Medicago truncatula
  CDS (1)..(1464)
atggcagcatcaccagcataccaagcacatcttccaacatcaccagaatggttaaacaaaggagacaacgcatggcaaatgacagcagcaacactagttggtttacaaagcatgccaggactagtaattctctatgcaagcatagtgaaaaagaaatgggcagtgaattcagctttcatggcactatatgcttttgcagcagtattaatctgttgggttcttgttgcttatagaatggcttttggtgatgaacttttacctttctggggtaaaggtgcaccggctttaggacaaaaatttcttgttgctagagcaaaagtacctgcaagtactcactattacaagaatggtgttgatattgaaacacctatggaagaacctttttttcctatggcttcacttgtttattttcagtttacttttgctgctattactatgattttgttggctggttctgttcttggaagaatgaatattaaagcttggatggcttttgttcctctttggcttattttttcttatactgttggtgcttttagtctttggggtggtggatttctttatcattggggtgtgattgattattctggtggttatgttattcatctttcttctggaattgctggtttcactgctgcttattgggttggaccaaggataaagagtgatagggaaaggtttccaccaaacaatgtgttgctgatgcttgcaggtgctggattgttatggatgggttggtcagggtttaatggtggagcaccatatgcagcaaatgttgcatcttcaattgctgtattgaacacaaacatttgtgcagcaactagtcttcttgtgtggacctctcttgatgttgttttctttggcaaaccttctgtgattggagctgttcagggtatgatgactggacttgtatgtatcacaccaggagcagggcttgtgcaatcgtgggcggctattgtgatgggaattctatctggtagcattccttgggtctccatgatgatcttgcataaaaagtcgagtcttctacaaaaggttgatgacactcttggagtatttcacacacatgctgtggcaggcctattgggtggcctactaacaggactctttgcagagccagccctatgtagattactattgccagtgacaaattcaagaggtgcattctatggtggaagtggtggtatgcaattgctaaagcaattagtggcagcaatgtttgttattggatggaacatagtctccaccacaatcattctccttgttatacaactattcatacccttgaggatgcccgacgagcagctcgaaatcggtgacgatgcggctcacggagaggaggcttatgccctttggggtgatggagaaaaatatgatccaactaggcatggttcgttgaatactggtaacactggagtgtcaccttatgttaatggtgcaagaggtgtgactataaatttatga

SEQ ID NO: 1657 - protein, 487 aa, Medicago truncatula
MAASPAYQAHLPTSPEWLNKGDNAWQMTAATLVGLQSMPGLVILYASIVKKKWAVNSAFMALYAFAAVLICWVLVAYRMAFGDELLPFWGKGAPALGQKFLVARAKVPASTHYYKNGVDIETPMEEPFFPMASLVYFQFTFAAITMILLAGSVLGRMNIKAWMAFVPLWLIFSYTVGAFSLWGGGFLYHWGVIDYSGGYVIHLSSGIAGFTAAYWVGPRIKSDRERFPPNNVLLMLAGAGLLWMGWSGFNGGAPYAANVASSIAVLNTNICAATSLLVWTSLDVVFFGKPSVIGAVQGMMTGLVCITPGAGLVQSWAAIVMGILSGSIPWVSMMILHKKSSLLQKVDDTLGVFHTHAVAGLLGGLLTGLFAEPALCRLLLPVTNSRGAFYGGSGGMQLLKQLVAAMFVIGWNIVSTTIILLVIQLFIPLRMPDEQLEIGDDAAHGEEAYALWGDGEKYDPTRHGSLNTGNTGVSPYVNGARGVTINL

SEQ ID NO: 1658 - DNA, 1470 bp, Medicago truncatula
  CDS (1)..(1470)
atggctactttcacctgttccgcctccgacctccacgctctcctcggcggaagcgcaaactccacagccgctgccgaatacatctgtggcggcttcaatgccgtcgcaaacaaattcatcgacacttcctatgctgtcgacaacacttaccttctattctcagcttaccttgtttttgccatgcaactaggttttgctatgctttgtgccggttctgttcgtgccaaaaacactatgaacattatgttaaccaatgttcttgatgccgcaataggtggtatttttttctatgtttttggttttgccctagcttttggaacaccttcaaacggtttcataggaaaacatttttttggtcttactgatttcccttcacaatcttttgattacggttttttcctctttcaatgggcttttgccattgctgcagcagggatcacaagtggatcaattgctgagagaacacagttcgtttcttatttgatttattcgtcgtttttaaccggtttagtttatccaattgttgctcattggttttggtctgctgatggttggggtagtccggttcggtctgaaaatcttttgtttggttctggtgttattgattttgctggttgtggtgttgttcatttagttggtgcagttgctggtttttggggtgcttttattgaaggaccgagaattggtagatttgatcatgagggtaaaagttctccaattagaggacatagtggtactttagttgttatgggaacttttttactttggtttggttggtatggttttaaccctggttcttttcttaatattgtgaaagcttatggtgaaagtggtcattactatggtcaatggagtgctattgggaggacagctgtcacaactacattggctggatgtactgcagctctcactactttgtttggtaaacgtatgcaaacaggtcattggagtgttagtgatgtgtgcaatggtttgcttggtggttttgctgctataactgcagggtgttctgttgtggatccatgggctgctattatttgtggttttgttgctgcttgggtgttgattggatgcaatttgttagctgagaaatttcactatgatgatcctcttgaagctgcacaacttcatggtggttgtggtacttgggggattattttcactgctttgtttgctaagaaacagtatgtgaatgaggtttattctggttcacctgatagaacttatggtttgttgttgggaggtggtggaagattattggctgcacatgttgttcagattttggctattgttgcttgggtgagtattactatgggaacaatgttttttcttcttcataaattgaatttgcttaggtcttcacccgaggaagagatggaaggtctggatttaactagccatggtggattggcttatgagtatcaccaagaggctgaagaacatgccaaaagacgtgcatttgaagtatga

SEQ ID NO: 1659 - protein, 489 aa, Medicago truncatula
MATFTCSASDLHALLGGSANSTAAAEYICGGFNAVANKFIDTSYAVDNTYLLFSAYLVFAMQLGFAMLCAGSVRAKNTMNIMLTNVLDAAIGGIFFYVFGFALAFGTPSNGFIGKHFFGLTDFPSQSFDYGFFLFQWAFAIAAAGITSGSIAERTQFVSYLIYSSFLTGLVYPIVAHWFWSADGWGSPVRSENLLFGSGVIDFAGCGVVHLVGAVAGFWGAFIEGPRIGRFDHEGKSSPIRGHSGTLVVMGTFLLWFGWYGFNPGSFLNIVKAYGESGHYYGQWSAIGRTAVTTTLAGCTAALTTLFGKRMQTGHWSVSDVCNGLLGGFAAITAGCSVVDPWAAIICGFVAAWVLIGCNLLAEKFHYDDPLEAAQLHGGCGTWGIIFTALFAKKQYVNEVYSGSPDRTYGLLLGGGGRLLAAHVVQILAIVAWVSITMGTMFFLLHKLNLLRSSPEEEMEGLDLTSHGGLAYEYHQEAEEHAKRRAFEV

SEQ ID NO: 1660 - DNA, 1473 bp, Medicago truncatula
  CDS (1)..(1473)
atggcttctttcacctgctccgcctccgacctcaacactctcctcggcagtggtgcaaattccacagccgctgccgaatacatctgcaacggctttaatgccgttgcaaacaaattcattgacacaacctatgccgttgacaacacctaccttctcttctcttcttaccttgtttttgccatgcaactcggttttgccatgctttgtgcaggttccgttcgtgccaaaaacaccatgaatattatgttaaccaatgttcttgatgcagccacaggcggcatctttttctatattttcgggtttgcctttgctttcggcacaccttctaatggtttcattggaaaacattttttcggtcttagtgattttccttctcagtcttttgattatggatattttctatatcaatgggcttttgcaattgcttcagcaggaatcactagtggttcaattgctgagagaacacaatttgtttcttatttgatttattcgtcttttctaacaggtttagtttatccgattgttgctcattggttttggtctgctgatggttggggtagtccggttcggtctgaaaatcttttgtttggttccggtgttattgattttgctggttgtggtgtcgttcatttagttggtgcagttgctggtttttggggtgctttgattgaaggaccaagaattggtagatttgatcatgaaggtaagggtgtttcaatgagaggacatagtggtactttagttgttatgggaacatttttactttggtttggttggtatggttttaaccctggttcttttctcaacatcttgaaaatttatggtgaaagtggtaattactatggtcaatggagtgctattgggagaacagctgtgacaactacattggctggatgcacagcagcactcactactttgtttgggaaacgtttgcaaacaggtcattggaatgttactgatgtttgtaatggtttgttaggtggttttgctgctataactgcaggttgttctgttgttgatccttgggctgcaattatttgtggattcattgccgcttgggttttgattggatgcaatatgttagctgagaagtttcaatatgatgatcctcttgaagctgcacaacttcatggtgggtgtggtacttgggggattattttcactgctttgtttgctaagaaacaatatgttaaggaagtttatggcggttctcctgataggccttatggtttgttgttgggaggtggtggaagattattggctgcacatttggttcaaattttggccattgttgtttgggtgagtgttactatgggaaccttgttttttattcttcataaattgaatttgcttaggagttcacatgaggaagagatgtctggattggatttaactagccatggtggattggcttatgagtatcatgaggagcttgaagaacggcgtcccaagaaacgtggaattgaaatatga

SEQ ID NO: 1661 - protein, 490 aa, Medicago truncatula
MASFTCSASDLNTLLGSGANSTAAAEYICNGFNAVANKFIDTTYAVDNTYLLFSSYLVFAMQLGFAMLCAGSVRAKNTMNIMLTNVLDAATGGIFFYIFGFAFAFGTPSNGFIGKHFFGLSDFPSQSFDYGYFLYQWAFAIASAGITSGSIAERTQFVSYLIYSSFLTGLVYPIVAHWFWSADGWGSPVRSENLLFGSGVIDFAGCGVVHLVGAVAGFWGALIEGPRIGRFDHEGKGVSMRGHSGTLVVMGTFLLWFGWYGFNPGSFLNILKIYGESGNYYGQWSAIGRTAVTTTLAGCTAALTTLFGKRLQTGHWNVTDVCNGLLGGFAAITAGCSVVDPWAAIICGFIAAWVLIGCNMLAEKFQYDDPLEAAQLHGGCGTWGIIFTALFAKKQYVKEVYGGSPDRPYGLLLGGGGRLLAAHLVQILAIVVWVSVTMGTLFFILHKLNLLRSSHEEEMSGLDLTSHGGLAYEYHEELEERRPKKRGIEI

SEQ ID NO: 1662 - DNA, 1176 bp, Archaeoglobus fulgidus DSM 4304
  CDS (1)..(1176): transl_table=11
atgagtgacggaaatgtcgcatggatactcgcatccacggcccttgtaatgctgatggtgccgggagtggggttcttttacgcaggaatggtaaggagaaagaatgcagttaacatgattgcgctgagcttcatatcactcataatcacggttttgctgtggatattctacggctactcggtgagcttcggaaatgacatctctggaatcattggagggctgaattatgcactgctaagcggagttaagggggaggatttgctgttcatgatgtaccagatgatgttcgccgctgtcacaattgcaatcctcacctccgcaattgctgagagagcaaaagtttcatcgttcattctcctcagcgctctgtggcttacgttcgtttacgcccccttcgcacactggctttggggtggggggtggctggcaaagctcggcgccctcgactttgctggaggtatggttgttcacataagctcgggatttgctgcacttgcagtcgcgatgacgataggtaagagggcgggattcgaggagtactcgatagagccacacagcattccgctgacgctcattggcgctgccctgctttggtttgggtggttcggattcaacggcggaagtgcattggctgcaaacgatgtggccatcaacgccgtggtggtcacaaacacctcagcagcagtagcagggtttgtctggatggtaattggatggattaagggaaagccggggagtcttgggatagtgagcggtgcaattgctgggcttgccgccataacccccgcagcaggctttgtggatgtaaagggagcgattgtcataggtcttgtggctggaatagtatgctaccttgctatggacttcagaataaagaagaagatagacgagagccttgatgcttgggcgattcacggaataggcggtttatggggaagtgttgcagttggcattcttgcaaatccggaggttaacggatatgcaggcctactgttcggaaatccgcaactgctagtttcacaactgattgcggttgcatccacaacagcctacgccttcctcgtgacgctgatactggcaaaggctgttgatgccgctgtggggctgagggttagctcgcaggaggagtacgtcggtctcgacctgtcgcagcatgaggaggttgcctacacgtga

SEQ ID NO: 1663 - protein, 391 aa, Archaeoglobus fulgidus DSM 4304
MSDGNVAWILASTALVMLMVPGVGFFYAGMVRRKNAVNMIALSFISLIITVLLWIFYGYSVSFGNDISGIIGGLNYALLSGVKGEDLLFMMYQMMFAAVTIAILTSAIAERAKVSSFILLSALWLTFVYAPFAHWLWGGGWLAKLGALDFAGGMVVHISSGFAALAVAMTIGKRAGFEEYSIEPHSIPLTLIGAALLWFGWFGFNGGSALAANDVAINAVVVTNTSAAVAGFVWMVIGWIKGKPGSLGIVSGAIAGLAAITPAAGFVDVKGAIVIGLVAGIVCYLAMDFRIKKKIDESLDAWAIHGIGGLWGSVAVGILANPEVNGYAGLLFGNPQLLVSQLIAVASTTAYAFLVTLILAKAVDAAVGLRVSSQEEYVGLDLSQHEEVAYT

SEQ ID NO: 1664 - DNA, 1167 bp, Archaeoglobus fulgidus DSM 4304
  CDS (1)..(1167): transl_table=11
atgcagagtggagatatatcttggttgctgatttcgacggccctggtcgttctgatgactccagcgctgggattgttttacggtggtatggtgcgagctaagaatgtcctttccacgataacgatgtgctttgtcgcactggcgattgtgagcgtacagtggatactccttggctacactattgcatttggtgacgatgtcagtggtttaactggcaacttagtgttcatcggactcaggaacgttagcatgtccgattacggatttgttgcttttcagatggcgtttgcagcgattacactggccataattgtatcagcacttgcagaaagggtaaagctgtcggcattcctgctgttcggcattctgtggacaaccttcgtttacgacccgatagctcactgggtgtggggaggcggctggctcgctggaataggggcgctggactttgcaggcggaacggtggtgcacataagctcgggtttcagtgctttagctctagcacttcttgtaggcaggagaaccggctacggggaatacaacattgaaccgcacaacattcctatgaccttgctcggtacagcactgctgtggttcggatggttcggtttcaacgctggtagtgcactggaagcgaacgatgtggctttgaacgcattcctagttacgaacacttcggcagcgatgggtgccttaagctggatgtttgcctcctggctaaagggaaaacccggaagtttgggagtggcaagcggtgctatagccgggcttgtggcaattactcctgcagctggctacgttgacccgctttctgcacttgtaataggaggtgttgcaggagtggtgtgctatgcagcgatgctcctcagagtcagagcaggagtagatgagagtcttgatgcctgggctgttcatggcgtcggaggcctgtggggagccattgccaccggcatcttcgcctctgttggtgctaccggcctggtggcagggaatgcacagcaactgctccttcagataattgcggccctagtcgcaacagcctacgccttcctcgtgacgctgatactggcaaaggctgttgatgccgctgtggggctgagggttagctcccaggaggagtacgtcggtctcgacctgtcgcagcatgaggaggttgcctacacgtga

SEQ ID NO: 1665 - protein, 388 aa, Archaeoglobus fulgidus DSM 4304
MQSGDISWLLISTALVVLMTPALGLFYGGMVRAKNVLSTITMCFVALAIVSVQWILLGYTIAFGDDVSGLTGNLVFIGLRNVSMSDYGFVAFQMAFAAITLAIIVSALAERVKLSAFLLFGILWTTFVYDPIAHWVWGGGWLAGIGALDFAGGTVVHISSGFSALALALLVGRRTGYGEYNIEPHNIPMTLLGTALLWFGWFGFNAGSALEANDVALNAFLVTNTSAAMGALSWMFASWLKGKPGSLGVASGAIAGLVAITPAAGYVDPLSALVIGGVAGVVCYAAMLLRVRAGVDESLDAWAVHGVGGLWGAIATGIFASVGATGLVAGNAQQLLLQIIAALVATAYAFLVTLILAKAVDAAVGLRVSSQEEYVGLDLSQHEEVAYT

SEQ ID NO: 1666 - DNA, 1533 bp, Ureaplasma parvum serovar 3 str. ATCC 700970
  CDS (1)..(1533): transl_table=4
gtgagaattgtgtcaacaattataactacatcttgaggagtagatccaaatatttacttttcaaagcatgagttaacatgagtgccagcaacagctgatgctaatacattagcattaactaattttaatccgactagcactttattagttgcattagcaattgcctttgtcttattgatgactccaggtttagcattattttatggtgggctaacacgtcgaaaatctacattaacgattattaatcaatgtgtagcttcacttggaatcacaacactgatttgaatttttggagggttctcacttgcttttggaccttctgttggtaaaggaataattggtgatatttcaacttattttgcatttagaaatctattatttgctgatggttgaagtggagatgtaggaattgtttttgcaaactttactaatggtgtaccattaattttattctttgcttatcaattagcttttgcaattattacaccaccattaatggttggtgcatttgcagatcgaatgaaatttaaaaattatctagtattcttagtactatgacaatatttaatttacattccttttgcacattgaatttgaggtcaaggattcttagctgctgctggagtaattgactttgctggtggtattgtaattcatacaactgctggttttggagcattagctgcttcattagtattaggtaaacgtgttttacttaagaatgataaaagtcgtccacacaatattccaatgactattattggagcaacattgttattctttggttgatttggatttaatgttggtggatcaggatttgtagctggtgggaatgctgctacttgatcagctgctacaagtgcttggattaatacaattattgctttagctattggaatggttggttgagcagttcttgaaacaatctttaataaaaatcataaagccacaggtgttggtttagtaacaggtgcaattgctggattagcaacaattactcctgcagcaggttatgttccaatttgagcatctgttcctattggtgtagctgctgtgctagtttgttatactagtgctaaaactttacatcatttccacaaaattgatgatactctagaagtatgaggcgtacatggaatgggtggtgttactggttcattattaattggtgcgtttgcatctaaatctgtaaacccatcaattatgtatgaagcaattggtccaacaacaactggtgttttatttggtgtccaattaggagcggttttattagctgcggtttatggatttgtatttactattttattagtatatattactcgtccaagattatcagcacgccaacaattaggtcatatagactatattaatcatggcgaagatgcatattcattcgatattgaaattccatctgaaaaagaaatggagcaatatgaattagcagatagtacatgacactcaagcacaggtgttaagtattcattgcttaataataaaaaccagcaaaatcataaagtagcaaacgaccattaa

SEQ ID NO: 1667 - protein, 510 aa, Ureaplasma parvum serovar 3 str. ATCC 700970
MRIVSTIITTSWGVDPNIYFSKHELTWVPATADANTLALTNFNPTSTLLVALAIAFVLLMTPGLALFYGGLTRRKSTLTIINQCVASLGITTLIWIFGGFSLAFGPSVGKGIIGDISTYFAFRNLLFADGWSGDVGIVFANFTNGVPLILFFAYQLAFAIITPPLMVGAFADRMKFKNYLVFLVLWQYLIYIPFAHWIWGQGFLAAAGVIDFAGGIVIHTTAGFGALAASLVLGKRVLLKNDKSRPHNIPMTIIGATLLFFGWFGFNVGGSGFVAGGNAATWSAATSAWINTIIALAIGMVGWAVLETIFNKNHKATGVGLVTGAIAGLATITPAAGYVPIWASVPIGVAAVLVCYTSAKTLHHFHKIDDTLEVWGVHGMGGVTGSLLIGAFASKSVNPSIMYEAIGPTTTGVLFGVQLGAVLLAAVYGFVFTILLVYITRPRLSARQQLGHIDYINHGEDAYSFDIEIPSEKEMEQYELADSTWHSSTGVKYSLLNNKNQQNHKVANDH

SEQ ID NO: 1668 - DNA, 1566 bp, Ureaplasma parvum serovar 3 str. ATCC 700970
  CDS (1)..(1566): transl_table=4
gtgaaaattgtgtcaacttgaggcctaaataaagatatttatttctcaactcatgaattaacatgagtgcccgcagatgcaagtcaatcaacacttaatgcaataggttttaatcctactaatacactactagtagctttagcaattgcttttgttttactaatgacaccagggttagcattattttatggtggtttagtaagacgtaaatcagctttaacaattattaatcaatgtgtagcttcacttggaattacaacattgatttgaatttttggaggtttctcacttgcttttggaccttctgttggtaaaggaataattggtgatatttcaacttattttgcatttagaaatctactatttgctgatggttgaagtggaggagcagttttagtttttgctaattttactaacggcgtaccattaattttattctttgcttatcaattagcttttgcaattattacaccaccattaatggttggtgcatttgcagaccgaatgaaatttaaaaattatctagtattcttagtactatgacaatatttaatttatattccttttgcacattgaatttgaggtcaaggattcttagctgctgctggagtaattgactttgctggtggtattgtaattcatacaactgctggttttggagctttggctgcttcatttatgttaggaaaacgtacaacattaattacagataaaaagcgagctaataatttaccaatggttgtattaggtgcagcattactattttttggttgatttggatttaatgttggtggtgcaggttttgttaaagaaaatacaaatcacatttcacaagctatatcatcatgattaaatacaattattgccttagcaataggtatgataggttgagttacacttgaaactattgttaacaaaaaccacaaaccaacaacagtaggtttagtgactggtgcagtcgctggattagcaacaattactcccgcagcaggttttgttccagtttgagcctctgttcctattgccattatgggtgttttagtatgttattcagtttctagattattagattacttccgttttgatgattctttagaagttctaccagttcatggaatgggtggtgttataggttctttattaattggagcatttgctactaacacggttgcacatggaattaaatatgacgccgtcggattagataataatggaaatccaatttatggtattttatttggactacaattaggtgctgtattattagcagcaacatgggcatttgcctttacatgtttaatagtttatattactaaacctcgtttatcagtgcgtcaacaattaggccatatagactacatcaatcatggtgaagatgcatacaagtttgattttattattccttcagaaagtgaaatgtttgaatatgaaagttttgatcaaacttgagaatgtaaagctagtggttgtaaaaaaagcaacttagctgccaagaaaaaccctgtttttatagagaatgagaatgattgtacatgacaatctaaatctcgtgagtgtacaaaatag

SEQ ID NO: 1669 - protein, 521 aa, Ureaplasma parvum serovar 3 str. ATCC 700970
MKIVSTWGLNKDIYFSTHELTWVPADASQSTLNAIGFNPTNTLLVALAIAFVLLMTPGLALFYGGLVRRKSALTIINQCVASLGITTLIWIFGGFSLAFGPSVGKGIIGDISTYFAFRNLLFADGWSGGAVLVFANFTNGVPLILFFAYQLAFAIITPPLMVGAFADRMKFKNYLVFLVLWQYLIYIPFAHWIWGQGFLAAAGVIDFAGGIVIHTTAGFGALAASFMLGKRTTLITDKKRANNLPMVVLGAALLFFGWFGFNVGGAGFVKENTNHISQAISSWLNTIIALAIGMIGWVTLETIVNKNHKPTTVGLVTGAVAGLATITPAAGFVPVWASVPIAIMGVLVCYSVSRLLDYFRFDDSLEVLPVHGMGGVIGSLLIGAFATNTVAHGIKYDAVGLDNNGNPIYGILFGLQLGAVLLAATWAFAFTCLIVYITKPRLSVRQQLGHIDYINHGEDAYKFDFIIPSESEMFEYESFDQTWECKASGCKKSNLAAKKNPVFIENENDCTWQSKSRECTK

SEQ ID NO: 1670 - DNA, 1356 bp, Mesorhizobium loti MAFF303099
  CDS (1)..(1356): transl_table=11
atgaatatttcttccaccttgaagacaacgggacgggcggccctgctgggctcgcttgctctggcagcattgggcagcgtcgccgcctttgcgcaggaagccgctccggccgctgccgcagccgccccggctgccgctcccaccccggtgctcgacaccggcaacaccgcctggatgctgacctcgacggccctggtgctgatgatgaccattccgggcctggcgctgttctacggcggcatggtgcgcaagaagaacgtgctcgccaccatcatgcagagcttcgccatcacctgcctggtgacggtgctgtggttcatgttcggctattcgctggccttctccgacggcggcggcatgaatgcctatctcggcggcttctcgaaattcttccatcacggcatcacggtctcgacgctctggctgccgggggtctcgaacattcctgaattcgtcttctcgatgttccagatgaccttcgccatcatcacacctgccctcatcgccggcgccttcgccgagcgcatgaagttctcggcgctgctgctgttcatggcgctgtggttgatcgtggtctattgcccgatcgcacattgggtctggggtggcggcttcctcggcacggctggcgtgctcgacttcgccggcggtacggtcgtccacatcaacgccggtgtcgcgggcctggtctgcgcgctggttcttggcaagcgcgaaggctacggcaccaccaacatggcgccgcacaacctggtctattcggtgatcggcgcttcgctgctgtgggtcggctggttcggcttcaacgccggttcggaactggcggcggacggtcttgccggcgctgcgatgatgaacacgcaggtcgccaccgctgccgccgcgctcgcctggatgttcgctgaatggatcgtcgccaagaagccctcggtgctcggcatcatctcgggtgccgtcgccggcctcgtcgcggtgacgccggcttccggcttcgtcaacccgaccggcgctttcatcatcggcatcgttgccggcgtgctctgctacatctcggcggtcaaggtgaagcacatgttcggctatgacgactcgctcgatgccttcggcgtgcacggcgtcggcggcatcatcggtgcgctgctcaccggcgcgctggccgatccggcgatcaacgcgctcggcaagggcggctctgtggtcacccagctctacggcatcgtcttcaccatcctgtggacggcgatcgccaccttcgtgatcctctacatcgtcaaggcgctggtcggcctgcgtccgacgacccaggaagaggtcgaaggcctcgacatctcccagcatggcgaagtggtgccgtaa

SEQ ID NO: 1671 - protein, 451 aa, Mesorhizobium loti MAFF303099
MNISSTLKTTGRAALLGSLALAALGSVAAFAQEAAPAAAAAAPAAAPTPVLDTGNTAWMLTSTALVLMMTIPGLALFYGGMVRKKNVLATIMQSFAITCLVTVLWFMFGYSLAFSDGGGMNAYLGGFSKFFHHGITVSTLWLPGVSNIPEFVFSMFQMTFAIITPALIAGAFAERMKFSALLLFMALWLIVVYCPIAHWVWGGGFLGTAGVLDFAGGTVVHINAGVAGLVCALVLGKREGYGTTNMAPHNLVYSVIGASLLWVGWFGFNAGSELAADGLAGAAMMNTQVATAAAALAWMFAEWIVAKKPSVLGIISGAVAGLVAVTPASGFVNPTGAFIIGIVAGVLCYISAVKVKHMFGYDDSLDAFGVHGVGGIIGALLTGALADPAINALGKGGSVVTQLYGIVFTILWTAIATFVILYIVKALVGLRPTTQEEVEGLDISQHGEVVP

SEQ ID NO: 1672 - DNA, 1320 bp, Deinococcus radiodurans R1
  CDS (1)..(1320): transl_table=11
gtgaaacgcgccccctacactgccgctgctactactgccgccctgctgctcttgcccctgctctcgacggccttcgctgccgacgccaagccgcacctcgacaccggcgacaccgcctggatgctgatgtcggcggcgctggtgttcctgatgacgcccggcctcgccttcttttacggcggcctgacccgcgcccagagcgtgctgaacaccatgatgatgagcatggtcagcatcggcctggtcggggtgctgtggatgctcgccgggtactcgctcgccttcggggatggcggcgcgtggctgggggacttcgcgcacctcggtctgaatgggttggcggggcagctcaccggcaccattcccacttacgtcttcgcctcgtttcaggccatgttcgccatcatcgccgtcgcgctgatttcgggcgcggtggtcgagcggatgcgcttcggcgcctttatcctcttcgccgcgctgtggactctgatcatctactcgccgctcgcccactgggtctggggcgccaacggctggctgttcaaggatggcgcgctcgattttgcgggcggcaccgtcattcacatctccgccggggtgtccgcgctggtggcggcctggctgctggggccgcgcctgggctacccgcgcaacgcccacgtgccgcacaacgtcccgctggtgttgctcggcgccgggctgctgtggttcggctggatgggctttaacgcgggctcggcgctgggggccaatcagacggcggcccttgccttcatcaccaccctgattgcgcccgccgccgccatgctgacctggctgggctgggaaagcctgagcagcaagccgaccgccgtgggcgccgccaccgggctggtcgtggggctggtcgccatcaccccagcgtgcgccttcgtgtcgccctgggccgccgtgctgctgggcatcctgggtgccaccgcgagctactggaccgtgcaggccaagcaccgcctgatggccgacgacgcgctggacgtgttcgcctgccacggggtcgcgggcatcgtgggggcgctgctcaccggtctgctcgcctggaccaccggcagcggcaagccgattggcgcgcagttcatgactcagctcatcagcgtggtcgcctcgctgctctacgcgggggtcggcagcttcatcctgctcaagctggtgtcgctggttattccactgcgggtgccggcagggcaggaaatcgcaggcatcgacctcagcgcccaccaggagcagggctacagcgaaaacgaactcggcatcggggcgccagtgttcctgggcggtgactga

SEQ ID NO: 1673 - protein, 439 aa, Deinococcus radiodurans R1
MKRAPYTAAATTAALLLLPLLSTAFAADAKPHLDTGDTAWMLMSAALVFLMTPGLAFFYGGLTRAQSVLNTMMMSMVSIGLVGVLWMLAGYSLAFGDGGAWLGDFAHLGLNGLAGQLTGTIPTYVFASFQAMFAIIAVALISGAVVERMRFGAFILFAALWTLIIYSPLAHWVWGANGWLFKDGALDFAGGTVIHISAGVSALVAAWLLGPRLGYPRNAHVPHNVPLVLLGAGLLWFGWMGFNAGSALGANQTAALAFITTLIAPAAAMLTWLGWESLSSKPTAVGAATGLVVGLVAITPACAFVSPWAAVLLGILGATASYWTVQAKHRLMADDALDVFACHGVAGIVGALLTGLLAWTTGSGKPIGAQFMTQLISVVASLLYAGVGSFILLKLVSLVIPLRVPAGQEIAGIDLSAHQEQGYSENELGIGAPVFLGGD

SEQ ID NO: 1674 - DNA, 1530 bp, Sulfolobus solfataricus P2
  CDS (1)..(1530): transl_table=11
atgaaatcgtggaaattcaaggcactgttaattggccaagtaatattggtaatgcttttattttcaaatattttagcacattctcaaactacaacaaattcatctgcacttcaacaactaaatcaatcagtgcaatcaattcttaacagaacgtctagctatccagctgcagcagtaccatcttggcttgatactggaagtaatgcgtggatgttaactgcagcgacttttgtaggattgcaaagcgttcctggtgttgcgttatattatgctggattgtctaaaaagaaatatgcagtgaactctgcattaatgatattttatgcatttgcggcagtgttagttatatggataatagccggatacagttttggtttcggttatcccgcactggtttccattcacggttatggaatattcggatatcctattcccgcatggggagggctttttgaagcttcacaaaccacctatggtcctagtggtgctcacgctaatataccaaccgctacctttatattcttccaattcgtctttgctgcaataacgccaatattattagccggaggagtattagaaagaatgaactttaaagcttggatggtttttgtacctttctggtctctcctagtgtatagtccagttgcatactggttatttgcaggaggatggttaaatcaattaggtgctgtagacttctctggaggttatgtaatacatgtagatgcaggagtaggagctctagctgcagcgttggctataggtcctagattagcttctgaaagaaaattagaggcgcatagcttacctttagttttagttggagctggcttaatttggttggggtgggatgggttcaatggcggtgatccattaggagctacagtggatgctgcaatcgcagtgctgaatacgaatattgctaccgcagttagtgctgtagtatggatgttgatggatatgaaattctttggaaaaccaacattaattggagctactagtggcgctataactggcctagttgcaattactccagctgcaggttatgtaaacggatgggaagccgcattaattggaatattttctggaagtataccatggatggcattatattggttagagccaaagcttagagttgatgatactttaggtgtgttctctactcacggtatagctggaatagtaggtggtttattaactggagtttttgcaaatcccgcagtcacacagtttgtggctccgggattaacaggagctctctatgggaattggtatcaactaggaattcaagcacttgcagcagtaatagtattcgtatatgacttcgcaataacttttggccttctaaagtttataggattatttataccattacaagcgccacctcaagaactagcaataggagattacgctatgcacggagaggtagcatattcagaattattagctacaattccagaaagcgctaaatctaaggaacagtcagtcgttttacctaagaaagaaaaggaggagaatagtgaagaataa

SEQ ID NO: 1675 - protein, 509 aa, Sulfolobus solfataricus P2
MKSWKFKALLIGQVILVMLLFSNILAHSQTTTNSSALQQLNQSVQSILNRTSSYPAAAVPSWLDTGSNAWMLTAATFVGLQSVPGVALYYAGLSKKKYAVNSALMIFYAFAAVLVIWIIAGYSFGFGYPALVSIHGYGIFGYPIPAWGGLFEASQTTYGPSGAHANIPTATFIFFQFVFAAITPILLAGGVLERMNFKAWMVFVPFWSLLVYSPVAYWLFAGGWLNQLGAVDFSGGYVIHVDAGVGALAAALAIGPRLASERKLEAHSLPLVLVGAGLIWLGWDGFNGGDPLGATVDAAIAVLNTNIATAVSAVVWMLMDMKFFGKPTLIGATSGAITGLVAITPAAGYVNGWEAALIGIFSGSIPWMALYWLEPKLRVDDTLGVFSTHGIAGIVGGLLTGVFANPAVTQFVAPGLTGALYGNWYQLGIQALAAVIVFVYDFAITFGLLKFIGLFIPLQAPPQELAIGDYAMHGEVAYSELLATIPESAKSKEQSVVLPKKEKEENSEE

SEQ ID NO: 1676 - DNA, 1218 bp, Clostridium acetobutylicum ATCC 824
  CDS (1)..(1218): transl_table=11
atgaatttcgcagatactacttttgtatttctttctacagtcttagtaatgataatgacacctgctcttgcaatgttttacggaggtatggttaaaaccaagaacactttaggtactatgatgcacagttatgcctgtatgattatagtatcccttcaatggattttaataggatattctattgcatttggccctgatatttcaggccttataggaaatttccaatatgcacttttacatcatgtaggttttaaaccttttgcaccatattcaagcactattcctcatagcctatttatgatgttccaattaatgttcgcaattataactccaggattaattacaggtgcttttgctgaaagaataaaatttcccgcatttatactttttatacttctttggacaactataatatacgatccacttgcacactgggtatggggtaacggtggctggattaaaaatttaggtgctttagactttgctggaggaactgtagttcatataagttccggagcctctggtcttgttgctgcaataatgattggaaagagaaaatatataaaaacctctccaaacaatcttactttaacctttataggtggtacgcttttatggtttggttggtttggtttcaacgcaggaagtgccttagctataaacgatgtagctatgaatgcctttataactacaaataccgctgctgctgcggctgctgctgcttggattacctgtgaatggtttattacaaaacgtccaacggttttaggtgccctaacaggtactttagctggtctcgtttctataacacctgcctgcggttttgtaacagttggctcttcattagttataggtattattggcggaattatatgcttcttctcagttagcttccttaaaaagaaatttaactatgacgatgcattagatgcctttggctgtcatggtattggtggtacctggggtgctatagcaaccggaatatttgctacaaaagctgttaattcagctggtgcaaatggacttctttatggcaatgcttctcttgttttgaaacaacttgaagcaactgctgctacctatgcttattctataattgggacaataataattattaaagtggtgtctctaatattcaaaatacgttctactgacgaagaagaacttcaaggccttgatatctctatacatggagaaagagcttatcacatagattaa

SEQ ID NO: 1677 - protein, 405 aa, Clostridium acetobutylicum ATCC 824
MNFADTTFVFLSTVLVMIMTPALAMFYGGMVKTKNTLGTMMHSYACMIIVSLQWILIGYSIAFGPDISGLIGNFQYALLHHVGFKPFAPYSSTIPHSLFMMFQLMFAIITPGLITGAFAERIKFPAFILFILLWTTIIYDPLAHWVWGNGGWIKNLGALDFAGGTVVHISSGASGLVAAIMIGKRKYIKTSPNNLTLTFIGGTLLWFGWFGFNAGSALAINDVAMNAFITTNTAAAAAAAAWITCEWFITKRPTVLGALTGTLAGLVSITPACGFVTVGSSLVIGIIGGIICFFSVSFLKKKFNYDDALDAFGCHGIGGTWGAIATGIFATKAVNSAGANGLLYGNASLVLKQLEATAATYAYSIIGTIIIIKVVSLIFKIRSTDEEELQGLDISIHGERAYHID

SEQ ID NO: 1678 - DNA, 1557 bp, Sulfolobus tokodaii str. 7
  CDS (1)..(1557): transl_table=11
atggaaattcaaaaaacctttccccaaaataatcttataaagttattaataatactaattagtttttcaatcattctattatcattacactcatttggacagacatcatcaaatactacagcagaaatacagagtttaaatcaaagtattttggctttagaaaatcatacagcagattacccatctgcagcagttcctagctggttagatacgggtagtaatgcatggatgcttacggctgcaacgtttgtaggacttcaaagtgtacctggtgtagcactatattatgctggattatccaaaaagaaatatgctgtaaattccgcattaatggtattttatgcttttgctgcagttttagttgtttggatgatagctggttataatgctggttttggtcatcctgcattacttagtattaacggttatggaattttaggttatccattaccagcatggttaggtcactatgaagctagtcaaaccgtatttggtccaactggaacaccggtagatattccaacatctacttacatattcttccaatttgtctttgccgcaataactccagtattattagctggaggagtattagagagaatgaatttcaaagcatggatgatatttgtacccttctggagtttattagtatatagcccagtagcttattggttatttgctggtggatggttaaatcaactaggagctgtagactttagcggaggatatgttatccatgtagatgccggagtcggtgcgttagctgctgcattagcaataggtcctagattagcatctgaaagaaaattagaagctcatagcttaccattagttcttgcaggagctggtttaatttggttaggatgggatggatttaacggtggtgatcccggtggtgcaacaatcgatgctgcaatagcagtattaaatacaaatattgcaacagctgttagtgcaataacttggatgttaatggatatggcattctttaagaaaccaacattagtgggtgcaacaagtggtgcaataactggacttgtagctattacgccagctgcaggatatgtaaatggttgggaagcaatgcttattggaattgcatctggaagtataccatggttatctctgtataaatttgagcctagactgaaagttgatgatacattaggagtattctctactcacggtattgcaggaatagtgggaggattgttaactggtgtgttcgcagatccaaatgtgacacaatatgtggatccaacgttaaaaggtgctttatatggtaacttatatcaactaggaatacaagctgccgctgcagcagtagtatttgtttatgattttgcaataacttttggtctgttaaagttaataggactattcataccattgcaagcaccacctgatacattagctatcggtgattatgcaatgcatggagaagtagcatattctgaactactagctactttaccagaatcgcagataaagaaagaagaaattagagaagaggcacaagaagagaaagaagatccagatgagaaaaaatctaaataa

SEQ ID NO: 1679 - protein, 518 aa, Sulfolobus tokodaii str. 7
MEIQKTFPQNNLIKLLIILISFSIILLSLHSFGQTSSNTTAEIQSLNQSILALENHTADYPSAAVPSWLDTGSNAWMLTAATFVGLQSVPGVALYYAGLSKKKYAVNSALMVFYAFAAVLVVWMIAGYNAGFGHPALLSINGYGILGYPLPAWLGHYEASQTVFGPTGTPVDIPTSTYIFFQFVFAAITPVLLAGGVLERMNFKAWMIFVPFWSLLVYSPVAYWLFAGGWLNQLGAVDFSGGYVIHVDAGVGALAAALAIGPRLASERKLEAHSLPLVLAGAGLIWLGWDGFNGGDPGGATIDAAIAVLNTNIATAVSAITWMLMDMAFFKKPTLVGATSGAITGLVAITPAAGYVNGWEAMLIGIASGSIPWLSLYKFEPRLKVDDTLGVFSTHGIAGIVGGLLTGVFADPNVTQYVDPTLKGALYGNLYQLGIQAAAAAVVFVYDFAITFGLLKLIGLFIPLQAPPDTLAIGDYAMHGEVAYSELLATLPESQIKKEEIREEAQEEKEDPDEKKSK

SEQ ID NO: 1680 - DNA, 1296 bp, Yersinia pestis CO92
  CDS (1)..(1296): transl_table=11
ttgatgatgaaaaaacttttatccgtgttgggcctgggtacggtagcgctgttaccttcttgggcaatggcggcggcaccggcagtcgctgacaaagcagataatgcttttatgatgatttgcactgcgttagtactgtttatgacgatacccggtattgccctgttctacggtggcctgttgcgctccaaaaacgtattgtcaatgatgactcaggtcatggtgagttttgcgctggtatgtgttttgtggattctctacggctacagcctggcgtttagtgcgggtaatgcgttcttcggcagttttgatatggccatgctgaaaggtattgagctgactagcctgagtggctcgttctatcaatatattcatgtcgtgttccaagcctcatttgcctgtatcaccgtcgctctgattgtgggttcattcgcagagcgtattcgtttctcagcagtattaattttcgccgcgctgtggttcaccttctcttacctaccaatagcgcacatggtatggggtggtggtttcctggcaatggacggagcgctggattttgctggtggtacagtggtgcacattaacgccgctgttgctggtttggtcggggcttatctgttgggtaaacgtgccggattcggtaaagaggccttcaaaccccataacttaccgatggtctttaccggtacggcgattctgtatattggctggtttggcttcaatgctggttcagccagtgctgcgaacgaaattgcagcgctagcgttcttgaataccgtcgttgcaacggcgggcgccatcctctcgtgggtatttgctgagtgggctttacgaggtaaaccttcgctgttgggggcatgttccggttgtatcgcaggcttggttgcgattactccggcagcaggtacggtaggggttggcggtgcattgattatcggtttggttggtggtgttgctggcctgtggggggtcgtgctactgaaaaaatggctgcgggtcgatgatacctgtgatgtcttcggtgttcatggtgtgtgtggcatcgtcggttgtattctgacgggtgtcttcacctcggcgtcgctgggcggcactggttatgctgctggcgtaaccatggggcatcaggtcggcgttcagttattcagtgttggtgtgactgttgtctggtcgggtgttgttgccttcgttgcctttaaaattgcgggcttgattgtgggcctacgggtacccgaagagcaagagcgtgaaggtctggatgttaacagtcacggtgaaaacgcatataatcaataa

SEQ ID NO: 1681 - protein, 431 aa, Yersinia pestis CO92
MMMKKLLSVLGLGTVALLPSWAMAAAPAVADKADNAFMMICTALVLFMTIPGIALFYGGLLRSKNVLSMMTQVMVSFALVCVLWILYGYSLAFSAGNAFFGSFDMAMLKGIELTSLSGSFYQYIHVVFQASFACITVALIVGSFAERIRFSAVLIFAALWFTFSYLPIAHMVWGGGFLAMDGALDFAGGTVVHINAAVAGLVGAYLLGKRAGFGKEAFKPHNLPMVFTGTAILYIGWFGFNAGSASAANEIAALAFLNTVVATAGAILSWVFAEWALRGKPSLLGACSGCIAGLVAITPAAGTVGVGGALIIGLVGGVAGLWGVVLLKKWLRVDDTCDVFGVHGVCGIVGCILTGVFTSASLGGTGYAAGVTMGHQVGVQLFSVGVTVVWSGVVAFVAFKIAGLIVGLRVPEEQEREGLDVNSHGENAYNQ

SEQ ID NO: 1682 - DNA, 1287 bp, Salmonella typhimurium LT2
  CDS (1)..(1287): transl_table=11
atgaagatagcgatgataaaaaccacactggcttcactggcgctgctgcctgggctaacgatagccgcgccggcggttgccgataaagcggatagtgcttttatgatgatttgcaccgcgctggtgctgttcatgacgataccgggtatcgcgctgttttacggcggattaattcgcgccaagaacgtgctgtcaatgttaacgcaagtgaccgtcacctttgcgctggtctgtattttatgggtggtgtacggctattcgctggcttttggcgaagggaatcattttttcggtaatgccgatggggcgatgttgaagaatatcgcgttgacggcggtaacgggtacgatttatcagtatattcatgtcgcgtttcagggatctttcgcctgtattaccgtcgggctgattgtcggcgcgctggcggagcgtattcgtttttcggcggtactgatttttgtcgtggtgtggttcacgctctcttatatcccgattgcgcacatggtgtggggcggcggcctgctggctgctcacggcgcgctggattttgctggtggtacagtggtgcatattaacgccgctatcgctgggctggtgggggcttatttaattggcaaacgcgtcggctttgggaaggaagcatttaaaccccataacctgccgatggtctttaccggtactgcgattctgtatatcggctggtttggatttaacgcgggttctgccggtagcgcaaacgagatagcagcgctggcctttgtgaacaccgtggtggcgaccgccgccgcgattctggggtggattatcggcgagtggacgctacgcggtaagccttccctgctgggagcgtgttccggcgcgattgccggtctggtcggcgtgacgccagcctgtggctatgttggcgttggcggcgcgctggttatcggcgttattgcgggtctggcgggattgtggggagtcaccatgcttaaacgtctgctacgggtagatgatccgtgcgacgtatttggcgttcacggcgtttgcggaatagtcggctgtatcctgaccggcgtttttgccgccagttcgctgggcggcgttggctttgtcgacggcgttacgatgggacatcaggtgatggtacagctggaaagtattgctattacggtcgtctggtccggcgttgtcgcgtttgttggttacaaactggcggatatccttgttggactgcgtgtaccggaagagcaggagcgcgaggggctggatgtgaacagtcacggcgagaatgcgtataacgcgtga

SEQ ID NO: 1683 - protein, 428 aa, Salmonella typhimurium LT2
MKIAMIKTTLASLALLPGLTIAAPAVADKADSAFMMICTALVLFMTIPGIALFYGGLIRAKNVLSMLTQVTVTFALVCILWVVYGYSLAFGEGNHFFGNADGAMLKNIALTAVTGTIYQYIHVAFQGSFACITVGLIVGALAERIRFSAVLIFVVVWFTLSYIPIAHMVWGGGLLAAHGALDFAGGTVVHINAAIAGLVGAYLIGKRVGFGKEAFKPHNLPMVFTGTAILYIGWFGFNAGSAGSANEIAALAFVNTVVATAAAILGWIIGEWTLRGKPSLLGACSGAIAGLVGVTPACGYVGVGGALVIGVIAGLAGLWGVTMLKRLLRVDDPCDVFGVHGVCGIVGCILTGVFAASSLGGVGFVDGVTMGHQVMVQLESIAITVVWSGVVAFVGYKLADILVGLRVPEEQEREGLDVNSHGENAYNA

SEQ ID NO: 1684 - DNA, 1206 bp, Listeria monocytogenes EGD-e
  CDS (1)..(1206): transl_table=11
atggaatcagtatttatgttcttttgtactttattggtttggttgatgacaccaggaatcgcattattttacggcggtatggttcgacgcaaaaatgtgttgagtactgcaatgtatagttttagttcgatggcaattatttctattctttgggtgattgttggttattcgttagctttcgcccctgggaacggctttataggtagttttgattggaccttccttcataatgtcggttttgcggcaaatgctacttactcagacgccattccacatgttctattcatgatgtttcaaatgacttttgctattttgactgtagctatcatttctggggcatttgcagaacggatgaatttctccgcttacttgattttcattatcttatggtcattacttgtttattcccctgtcgctcattgggtttggggtgatggcggttggttacgtaatcttggagcacttgattttgctggtggaaatgtggttcatattagttccggtgtaacaggattagtacttgcgattatgattggacgaagaaaagaagccgactctgcttctccgcacaatttaccacttgcgcttattggtgggattctagtttggtttggttggtatggttttaatgttggtagcgcccttacaattgataatgtggctatgacagcttttgttaatacgaatacggcagctgctgcaggtattatcggttggggtttggttgaatggttgacgaataaaaagccaactatgcttggaaccatttccggagcaattgctggtttagtatccattacccctgccgctggatttgttaccgttccaagttcacttatcattggtttcttcggcggagcactatgtttctgggctgtgttctggttgaaaggaaaagtaaaatatgatgatgcacttgatgcattcggtcttcacggaatcggaggtatttggggaggtattgcaactggactttttgctacaacaaaagtaaatgaagctggagcagatggattattttatgggaatgcttctctagtagtaaaacaattaattgcaatcggctcaacagtggcatatgtagctgtagtaacagctctaatcgtcgtaattatcaaactatttttaccaatccgtgtaaatgaagaacaagagtacaaaggacttgatttgacactgcacggcgaaaaagcatatcaagaataa

SEQ ID NO: 1685 - protein, 401 aa, Listeria monocytogenes EGD-e
MESVFMFFCTLLVWLMTPGIALFYGGMVRRKNVLSTAMYSFSSMAIISILWVIVGYSLAFAPGNGFIGSFDWTFLHNVGFAANATYSDAIPHVLFMMFQMTFAILTVAIISGAFAERMNFSAYLIFIILWSLLVYSPVAHWVWGDGGWLRNLGALDFAGGNVVHISSGVTGLVLAIMIGRRKEADSASPHNLPLALIGGILVWFGWYGFNVGSALTIDNVAMTAFVNTNTAAAAGIIGWGLVEWLTNKKPTMLGTISGAIAGLVSITPAAGFVTVPSSLIIGFFGGALCFWAVFWLKGKVKYDDALDAFGLHGIGGIWGGIATGLFATTKVNEAGADGLFYGNASLVVKQLIAIGSTVAYVAVVTALIVVIIKLFLPIRVNEEQEYKGLDLTLHGEKAYQE

SEQ ID NO: 1686 - DNA, 1206 bp, Listeria innocua Clip11262
  CDS (1)..(1206): transl_table=11
atggaatcagtatttatgttcttttgtactttattggtttggttgatgacaccagggattgcattattttatggtggtatggttcgccgcaaaaacgtgttaagtacagcaatgtatagttttagctctatggcaattatttctattctttgggtgattgttggctactcgttagcttttgcacctggaaatggctttatcggcagtttcgactggactttccttcataatgtcggttttgcggcaaatgacacttactcagatgcaattccacacattctgtttatgatgttccaaatgactttcgctattttaacagtagctatcatttctggggcatttgctgaacggatgaacttctctgcttacttgatttttattattttatggtcgttactagtatattcccctgttgcacactgggtttggggcgacggtggttggttacgcgagctaggagcacttgatttcgctggtggaaatgttgttcatatcagttcaggtgtaacgggtcttgtcttagctataatgattggccgcagaaaagaagctgattctgcttcacctcataacctcccgcttgctcttattggtgggattctagtctggtttggttggtatgggtttaatgtcggtagcgccctcacgattgataatgtagcgatgactgcatttgttaatacgaatacagcggctgcagctggaattattggctggggattggttgaatggttaatcaataaaaaaccgactatgcttggaacaatttctggcgctatcgctggtttagtgtccattacacctgctgccggtttcgttacagtacctagctctttgattatcggctttcttggcggagcactttgcttctgggcagtattctggttgaaaggaaaagtgaaatatgatgatgcgcttgacgcgtttggcttacacggaattggcggaatttggggcggcatcgctactggactttttgccacaacgaaggtaaatgaagctggagcagatggtctcttttacggtaatgcttccttagttgtaaaacaattaatcgcaattggctctactgtcgcatatgttgcagtagtcacagctctaattgtcgtagtaatcaaactatttttaccaattcgcgtaaacgaagaacaagaatacaaaggacttgatttgacgctacacggcgaaaaagcatatcaagaataa

SEQ ID NO: 1687 - protein, 401 aa, Listeria innocua Clip11262
MESVFMFFCTLLVWLMTPGIALFYGGMVRRKNVLSTAMYSFSSMAIISILWVIVGYSLAFAPGNGFIGSFDWTFLHNVGFAANDTYSDAIPHILFMMFQMTFAILTVAIISGAFAERMNFSAYLIFIILWSLLVYSPVAHWVWGDGGWLRELGALDFAGGNVVHISSGVTGLVLAIMIGRRKEADSASPHNLPLALIGGILVWFGWYGFNVGSALTIDNVAMTAFVNTNTAAAAGIIGWGLVEWLINKKPTMLGTISGAIAGLVSITPAAGFVTVPSSLIIGFLGGALCFWAVFWLKGKVKYDDALDAFGLHGIGGIWGGIATGLFATTKVNEAGADGLFYGNASLVVKQLIAIGSTVAYVAVVTALIVVVIKLFLPIRVNEEQEYKGLDLTLHGEKAYQE

SEQ ID NO: 1688 - DNA, 1413 bp, Nostoc sp. PCC 7120
  CDS (1)..(1413): transl_table=11
gtgtttcagaaaattttgataattggggtgagtaccctactactgctgacaagtcccatcatgggtaatgcttgggcgcaagtcccagggacgactccacctgctgatacgggagatacggcatttatgctgatttcagcagccctagtcttgctgatgacaccaggattagcatttttttatggtggtttcgtccgatcgcgcaatattctcaatacattgatgatgagctttgtattgatggcgattgtgggcgttacctgggttttatggggttatagtctgtcgtttgccccagggctgccatttattggtggtttacagtggtttgggttaaacggtgtggggctagaaaccacaggttatctgcaaggttccgagcctgcgaatgtggtttcctatgccgggacgattccccatcaggcatacatgatatatcaagccatgtttgccattatcaccccagctttaatttctggtgcgatcgccgaacgaatgagtttccgtgcctattgcctatttgtgctactgtggtcaacctttatttacacgcctctagcccacatggtttgggcaaaaggtggattcttaggtttgtatggcggcttaggtgcgctcgacttcgccggcggtacagtagttcatattagctctggggtttctgccctcgtcgccgcaatagtcctggggccaaggaaaacccatcccgatcgcctcagccctccccacaacgtaacatttattttgttgggtgctggcttgctatggtttggctggttcggttttaacgctgggagtgccttatcagttgctagcagcacttctggcagtttcatcactaatccagctacaactgcctttgttgccaccaacacctcagccgcagccggagctttaatgtggctaattctagaaggagtattacgcggtaaacccaccgccgtaggtgcagctacaggcgcagttgccggtttagtaggtataaccccagccgccggctttgtcacccctctagcgtcaattttgataggttttatcacagcttttgtttgcttttatgccgtaagtttcaaacacaagctaaatgttgatgatgccttagatacctacccggtgcatggtgttggtggaacagttggcgcaattctcacagctttctttgccaccgccgaagttaactcaggtggtaaaaacggcgtactcaagggtaattttggtgaactaggtgtggaactagccgccattgtcatcgcctatgtaattgcagcagttggtacttggataatcttgaagattattgatgctaccgttggcttacgggtgaaagaagaagcagaataccaaggtttggatatcagcgaacacggagaagaagcatataactccgagtttagcgatcgcatcgtaccgtaa

SEQ ID NO: 1689 - protein, 470 aa, Nostoc sp. PCC 7120
MFQKILIIGVSTLLLLTSPIMGNAWAQVPGTTPPADTGDTAFMLISAALVLLMTPGLAFFYGGFVRSRNILNTLMMSFVLMAIVGVTWVLWGYSLSFAPGLPFIGGLQWFGLNGVGLETTGYLQGSEPANVVSYAGTIPHQAYMIYQAMFAIITPALISGAIAERMSFRAYCLFVLLWSTFIYTPLAHMVWAKGGFLGLYGGLGALDFAGGTVVHISSGVSALVAAIVLGPRKTHPDRLSPPHNVTFILLGAGLLWFGWFGFNAGSALSVASSTSGSFITNPATTAFVATNTSAAAGALMWLILEGVLRGKPTAVGAATGAVAGLVGITPAAGFVTPLASILIGFITAFVCFYAVSFKHKLNVDDALDTYPVHGVGGTVGAILTAFFATAEVNSGGKNGVLKGNFGELGVELAAIVIAYVIAAVGTWIILKIIDATVGLRVKEEAEYQGLDISEHGEEAYNSEFSDRIVP

SEQ ID NO: 1690 - DNA, 1311 bp, Ralstonia solanacearum GMI1000
  CDS (1)..(1311): transl_table=11
gtgcccaacaagggcgacacggcgtggctgctggtttcgaccgccttcgtgatcctgatgacgctgccgggcctggcgctgttctacggcggcctggtgcgcaagaagaacatgctgtcggtcctgatgcaatgtaccggcatcttctcgctcatcatgatcctgtgggccatctacggctacagcatcgccttcaccgagggcaatgccttcttcggcgggctcgaccggctgttcctgaagggtctgacgccggattcggttgccgctacgttcagcaagggcgtggtagtgccggagtatgcgtacttcgccttccagggcgcatttgccgcgatcacctgcgcgctgatcatcggtgccttcgccgagcgcgccaagttctcggccgtgctggtcttcgtggtgctgtggttcacctttgcctacctgccgatcgcccacatggtctggttctggccggggccggacggcttcaccgacgccaaggcggccgaagtgatgacggccaagggcggctggctgttccagaagggcgcgctggacttcgccggcggcaccgtggtgcacatcaacgccgccgtggcgggcctggtgggtgccttcctgttcggcaagcggatcggcttcggccgcgaagcgctcaagccgcatagcctgacgctgaccatggtcggtgcctcgctgctgtggttcggctggttcggcttcaacgccggttcggccctggaagccaacggcagcgccgcgctggccttcgtcaacacgctgctcgccaccgccgccgccgtgttgtcgtggagcttcggcgagtggatcggcaagagcaagccgtcaatgctgggtgccgcgtcgggcgccgtcgccggcctggtggcgatcaccccggcagccggcttcgtcggcccgatgggcgccatcgcgatgggcatcctcgccggcgtgctgtgcctgtggggcgtcaacggcctcaagcgcatgctgggcatggacgacacgctggacgtgttcggcgtgcacggcgtgggcggcatcatgggcgcgctgctgaccggcgtgttcgcctcgccgagcctgggcggcaccggcatctacgactatgtcgccaacaaggtggccgatggctactcgatcggcggtcagctgtggattcagctgcagggcgtgctgaccaccatcgtgtggtctgccgtggtggctttcgttgcctacaagatcgtggacgcgatcatcggtctgcgcgtgccggaagaagaggagcgcgaaggtctggacatcacgtctcacggcgaaaccgcttacgaagactga

SEQ ID NO: 1691 - protein, 436 aa, Ralstonia solanacearum GMI1000
MPNKGDTAWLLVSTAFVILMTLPGLALFYGGLVRKKNMLSVLMQCTGIFSLIMILWAIYGYSIAFTEGNAFFGGLDRLFLKGLTPDSVAATFSKGVVVPEYAYFAFQGAFAAITCALIIGAFAERAKFSAVLVFVVLWFTFAYLPIAHMVWFWPGPDGFTDAKAAEVMTAKGGWLFQKGALDFAGGTVVHINAAVAGLVGAFLFGKRIGFGREALKPHSLTLTMVGASLLWFGWFGFNAGSALEANGSAALAFVNTLLATAAAVLSWSFGEWIGKSKPSMLGAASGAVAGLVAITPAAGFVGPMGAIAMGILAGVLCLWGVNGLKRMLGMDDTLDVFGVHGVGGIMGALLTGVFASPSLGGTGIYDYVANKVADGYSIGGQLWIQLQGVLTTIVWSAVVAFVAYKIVDAIIGLRVPEEEEREGLDITSHGETAYED

SEQ ID NO: 1692 - DNA, 1350 bp, Agrobacterium tumefaciens str. C58
  CDS (1)..(1350): transl_table=11
atgcaactcaacaagtttttgacgctcggcaagctgggcgccgcagcaacggccctgatggccccggccatcgcctttgcccaggatgcagcgccagcagtagcggcagcggctcctgttccggaaaaagccgataccgccttcatgtatatcgcaacgatcctcgtgctgttcatgatcattcctggtctggcgctgttttacggcggtctggtccgcaccaagaacatgctctccgttctcatgcagtgcacggtcatcggcgcagtcatgatgctggtgtgggtcatctacggttactccttcgccttcggcggcggcaccggtccttatttcggcggcttcggcaagctgttcctgtcgggcgtttcgcttgacagcacgtctgccaccttctcgcagggtgtcgtgatctacgaatacaccttcatcgccttccagatgacttttgcggccatcacgccggcgctgatcatcggtgcttttgcagaacgcgtgaagttctccgccgttatccttttcaccatcctctgggccaccttcgtttatttcccgatcgcgcacatggtctgggacgcgaacggcctgatcttcggcatgggcgctctcgacttcgccggcggcaccgtcgttcacatcaatgccggtatcgctggcctgatcggcgctatcatggttggcaaacgcaccggcttcggcaaggacatgatggctccccactccatgacgctgacgctggttggcgccgccatgctgtggttcggctggttcggctttaacgccggctccaacctcgaggcatcgggcggtgcggttctcgcaaccatgaacaccttcctcgccactgctgcggccatcgtttcctggtcgctggttgagagcttcacccgcggcaaggcttccatgctgggtgctgcttcgggcatgatcgccggcctcgttgccgtcacgcctgctgccggctccgtcggcccgatgggtgcgatcgttctcggtctcatcgtttcgccgatctgctacttcttcgtctccgtggtgaagaacaagttcggttatgacgatactgccgacgtcttcggcgtccacggcatcggtggcatcattggcgccctcggcaccggcatcttcacctcgccgctgcttggcggcaccggcaaggccgatttctccatctcctcgcagctctggacccagttcgttgccgtcgccatcaccatcgtctggtgcgcggtcgtttcggctatcctctacaagatcgtcgacgtgatcgttggtcttcgggttccggtcgaagccgaacgcgaaggtctcgacctcgcgacccacggcgaagccgcttaccactcctga

SEQ ID NO: 1693 - protein, 449 aa, Agrobacterium tumefaciens str. C58
MQLNKFLTLGKLGAAATALMAPAIAFAQDAAPAVAAAAPVPEKADTAFMYIATILVLFMIIPGLALFYGGLVRTKNMLSVLMQCTVIGAVMMLVWVIYGYSFAFGGGTGPYFGGFGKLFLSGVSLDSTSATFSQGVVIYEYTFIAFQMTFAAITPALIIGAFAERVKFSAVILFTILWATFVYFPIAHMVWDANGLIFGMGALDFAGGTVVHINAGIAGLIGAIMVGKRTGFGKDMMAPHSMTLTLVGAAMLWFGWFGFNAGSNLEASGGAVLATMNTFLATAAAIVSWSLVESFTRGKASMLGAASGMIAGLVAVTPAAGSVGPMGAIVLGLIVSPICYFFVSVVKNKFGYDDTADVFGVHGIGGIIGALGTGIFTSPLLGGTGKADFSISSQLWTQFVAVAITIVWCAVVSAILYKIVDVIVGLRVPVEAEREGLDLATHGEAAYHS

SEQ ID NO: 1694 - DNA, 1302 bp, Brucella melitensis 16M
  CDS (1)..(1302): transl_table=11
atgctcataacaggaagaaacaagcaaacggccctcatggccagcctgcccgcacttttcgccctggcggggacggcaatggcgcaggacaccgcaccggcaccaaccctcgatacgggcgatacggcctggatgctgacttcaaccgcgcttgtgttgatgatgaccatacccggtctggcgctgttttatggcggcatggtgcgcaagaagaacgtgctgtccacggtgatgcaaagctttgccatcacctgcctcatgtccatcctgtggatgatcgcaggctattcgctggcctttaccgatggcggctcgctccattcctatattggcggcttctcgaaggttttcttctccggagtgacgatggaatcgctcaccggaaccatccctgaatatctcttcatcaccttccagatgacgtttgcgatcatcacgcccgcgctgattaccggctcgtttgcagagcgcatgaagttttcctccatgctggttttcctgacgctgtggctgttcatcgtttatgttccggttgcccattgggtctggggcgggggcttcatggcttccgatggcgtgcttgattttgccggtggcacggtcgttcatatcaatgccggtgttgccggtctggtggcagccctcgttatcggcaagcgcgatggttatggccacactaacatggcgccgcacaatctcgtgctctcggtcatcggtgctgcccttctgtgggtgggctggttcggcttcaatgccggttctgccgccggtgccaatgcgcttgccggtgtcgccatgctcaacacgcaggtcgcaaccgccggtgctgctcttgcgtggatgtttgtggaatgggctatttccggcaagccaagtgtgctcggcattatttccggcgctgttgcgggccttgtcgcggtcacgcccgctgccggttttgtcaatccgaccggcgcgcttatcatcggcatcgttgccggtgcggtctgctatgtggcggctgtgaagatcaagcatgtgctgggctatgacgattcgctcgatgcgttcggcgtccatggcgtcggtggttttgtcggcgcggtgctgaccggcttttttgccgatgctacgatcaatccggccagcgaaggggcaaccatcggcaagcagttcttcggcgccgccatcacgatcatttatacggcgattgccaccgtgatcatcctttacgtggtcaaggccatcatgggcttgcggcccggcaagcaggccgagatcgaggggctggatatcgccttgcatggggaggcggtgcagtga

SEQ ID NO: 1695 - protein, 433 aa, Brucella melitensis 16M
MLITGRNKQTALMASLPALFALAGTAMAQDTAPAPTLDTGDTAWMLTSTALVLMMTIPGLALFYGGMVRKKNVLSTVMQSFAITCLMSILWMIAGYSLAFTDGGSLHSYIGGFSKVFFSGVTMESLTGTIPEYLFITFQMTFAIITPALITGSFAERMKFSSMLVFLTLWLFIVYVPVAHWVWGGGFMASDGVLDFAGGTVVHINAGVAGLVAALVIGKRDGYGHTNMAPHNLVLSVIGAALLWVGWFGFNAGSAAGANALAGVAMLNTQVATAGAALAWMFVEWAISGKPSVLGIISGAVAGLVAVTPAAGFVNPTGALIIGIVAGAVCYVAAVKIKHVLGYDDSLDAFGVHGVGGFVGAVLTGFFADATINPASEGATIGKQFFGAAITIIYTAIATVIILYVVKAIMGLRPGKQAEIEGLDIALHGEAVQ

SEQ ID NO: 1696 - DNA, 1494 bp, Schizosaccharomyces pombe 972h-
  CDS (1)..(1494)
atgtcttccactaccgatgccactcccaccccttcgggtgtcaatggcggtgattccatgaccgtcaatcttaatcaattttacaataatggtgatgttgcctggattctcacaagtaccgctttggtgtttatcatgattcccggtgtcggtttcttttactccggcttggctcgtcgtagaagtgccatttctatgctgtttttgtcaatgatgtctgtcgccattgttgcctttcagtggttcttttggggttattcgcttactttctctcacgagggtggtccatacatcggatccctcgccaatttcggtcttcgccaaacgttgggtagaccttcttccggtgcttccagtgtacccgacatcttgttttgcgtgttccaaggtatgtttgccgccattactcccgctttggctatcggtgctgccgctgatcgcggtcgcatgtttccctgtatggtcttcatgtttctctggacttccatcgtctacgacccaatcgccttttggacttggaatcctaatggttggttgaacaagttgggctcttacgatttcgctggtggctctcccgttcacatctcctccggtatggctgctttggcttattccatcgtaattggaaagcgttgtgaccatggtactaccaaatatcgcccacacaacgttccccacgtcgttcttggcaccgtatttttgtggtttggttggttcggctttaacggtggttcttccgctgctgccaacatgcgtggtgtcatggctgtcgtcgttacacatcttgctgcttctgttggtggtattgtttggtgtgttatcgattttgccaagaaccgtcactggtctgtcgtcggcttctgtgaaggtgccgtcgctggtttggtcgccattactcctggctccggtttcgttcctccatgggctgccgtcgtcattggtgctttaggcgctgtcttctgctatgctgctacttaccttaagaaaatcatccgtgtcgatgatgccttggatatctttgctgaacatggtgttggtggtatggttggcaatatccttaccgctctttttgccgctgattacattgaagctttggatggtagtggtactgcttacactggtggttggattactcaccattacattcaacttggttatcagcttgcagacactgtctcttgtgccgcatattcattcgctgtctcatgtgcactcttgtttgttatgaattacattccaggactttcacttcgtgtttcacgcgaggatgaggttctcggtttggataagattgaacttggtgaaagtgcatattattacaaagactctactgacgagcctcccccaatcactacaagtggcgttcaatacacttctccaactgttagcgattccgcatccaacgaaaaggagcaagaacacagagctcaaaatgaggctcaaaaggaagaggagtatagagctgaatctgaggctcaagctccggctatttag

SEQ ID NO: 1697 - protein, 497 aa, Schizosaccharomyces pombe 972h-
MSSTTDATPTPSGVNGGDSMTVNLNQFYNNGDVAWILTSTALVFIMIPGVGFFYSGLARRRSAISMLFLSMMSVAIVAFQWFFWGYSLTFSHEGGPYIGSLANFGLRQTLGRPSSGASSVPDILFCVFQGMFAAITPALAIGAAADRGRMFPCMVFMFLWTSIVYDPIAFWTWNPNGWLNKLGSYDFAGGSPVHISSGMAALAYSIVIGKRCDHGTTKYRPHNVPHVVLGTVFLWFGWFGFNGGSSAAANMRGVMAVVVTHLAASVGGIVWCVIDFAKNRHWSVVGFCEGAVAGLVAITPGSGFVPPWAAVVIGALGAVFCYAATYLKKIIRVDDALDIFAEHGVGGMVGNILTALFAADYIEALDGSGTAYTGGWITHHYIQLGYQLADTVSCAAYSFAVSCALLFVMNYIPGLSLRVSREDEVLGLDKIELGESAYYYKDSTDEPPPITTSGVQYTSPTVSDSASNEKEQEHRAQNEAQKEEEYRAESEAQAPAI

SEQ ID NO: 1698 - DNA, 1539 bp, Schizosaccharomyces pombe 972h-
  CDS (1)..(1539)
atgtcgtcagtgaattcaattcccacagcaacttctactgtttatatttcagtactgccagctacagctacacctagtggtggtagtggtggaaatgttttgcacgaagatcttaataaattttatgattatggaaacactagttggattttagcttgtactccattgtgtcttattatggtgcctggtgtggcttttttctactctggcttagcaagaaggaaaaatacattggctcttatcatgctctctatgcttggtttatgtgttagttttttccaatggtatttctggggttattctcttgctttttctcaaactggaacctctggttatattggcaatcttcgtcattttgcctttattcgcacacttgccgattactctcctggtagcaataatattcccgagcttgtatttgcaaattttcaaggaatgttcgccgcaattactgtagccctcttcactggtgccgccgctgaaagaggtcgtattggtccaatgctcatcatcacatttgtgtggctcactgtcgtttattgtcccatagcgtgttggatttggaatccaaatggttgggcttttaaatttggtgtatacgatttcgctggcggaggacctgtagaagttggatcaggatttgcagctttggcgtatacggtttgtttaggacgtcgatccaaatttgttgaggaacaatttcgccctcattctgtgctcaatgttgtattgggaacatctctgctatggtttggttggcttggtttcaacggtggtagtgcttacggctccaatctgcgagccgctatggcaatcaccaacacaaacttagcaggtgctgtagctggtttagtatgggttatttacgactacatttttcgcactaggaaatggtcaaccataggtttttgttccggggttgttgccggtttggtggctgcaacgccttgtgctggttttgtgagtcctcatgcctctttggcaattggtgctattactggcttatgttgcaattgggccattaagttaaagtcacatatgcgcattgatgatgcgatggatattttcgctatccacggtgttgcgggttttgtgggtacctttttgaatggtttgtttgccgttgattatatcgcagcaatggatggtatttatgttggtgaaaacaaaatcagaggtggttggtttgatcaccattggcgccaactaggcttgcaaatggcctatatttgtgctgttggtgcatacgactttgttgtcacgtttatcattttattcattacggacaaaattccctaccttcaacttcgagtgagccctgatgctgaagaaattggtgtggatgctgatcaaataggtgaatacgcgtttgattatattgaagaacgtcgtgaatataagcattggaagatttcccctgccggtgtacctgaagaaatcattatttccaatggcgttgctcaacctactggaaatgtggctgctcccggcaagattctagaatcaacaaacccattggagcttggacttacgatctaa

SEQ ID NO: 1699 - protein, 512 aa, Schizosaccharomyces pombe 972h-
MSSVNSIPTATSTVYISVLPATATPSGGSGGNVLHEDLNKFYDYGNTSWILACTPLCLIMVPGVAFFYSGLARRKNTLALIMLSMLGLCVSFFQWYFWGYSLAFSQTGTSGYIGNLRHFAFIRTLADYSPGSNNIPELVFANFQGMFAAITVALFTGAAAERGRIGPMLIITFVWLTVVYCPIACWIWNPNGWAFKFGVYDFAGGGPVEVGSGFAALAYTVCLGRRSKFVEEQFRPHSVLNVVLGTSLLWFGWLGFNGGSAYGSNLRAAMAITNTNLAGAVAGLVWVIYDYIFRTRKWSTIGFCSGVVAGLVAATPCAGFVSPHASLAIGAITGLCCNWAIKLKSHMRIDDAMDIFAIHGVAGFVGTFLNGLFAVDYIAAMDGIYVGENKIRGGWFDHHWRQLGLQMAYICAVGAYDFVVTFIILFITDKIPYLQLRVSPDAEEIGVDADQIGEYAFDYIEERREYKHWKISPAGVPEEIIISNGVAQPTGNVAAPGKILESTNPLELGLTI

SEQ ID NO: 1700 - DNA, 1554 bp, Schizosaccharomyces pombe 972h-
  CDS (1)..(1554)
atgcttaacgagccgaatgcgctattacgtcgcgacgcaaactccactatcgcgactgtaacagaactgtttcccaacgaatactcaaatgctgatatagcgtacgtacttttgagtacagtggtagtatttaccgtaacccccggtatagctctttattatgctgggatggttagaaagaattcggctctctcaatattgactcagtcgtttttggttacagcagtggtgtttattcaatggtatctgtttggatactctcttgcttgctcatcggggtcctctttttatggaacgttgtggcaaggagggatgaaccatctttggttagaaccatatataccagggtccacaattccagcaattgtttactttccatttggtggtctctttgctgtagcgacagctcaattgtttgccggggcaatggctgagcgcggtaggctaattccctctctcgtaatatcttttttatacattacgctggtttattgtccacaggcatactggacatgggcacccaatggctggctctacacattgggtgcccttgactttgcaggcggcggtcccgtacatatttcatctggttttgctgcgctcgcttattccttatgtttaggtcgtcgcattgttgtcgacgagccagacagacccgattcaattcggtcgaccgataatgcagatttaccgtcgtcttcccaaaacaactgcaaagctaattggaagcggtggtttgggttcaaatctgtttcctggaagaattccttcggcagaggaaagatagctcataatcctccgcatgatgctggtatggtttacattggcgttgttttgatttggtttgcatggctctgcttcaattctggtactctattgactgttaatattcgtacagcttatatcatgaccaacacgctcatttcctcgtcatttggtgctttgacatgggcgattattgattacatccgttatagaaagttttccactataggtatttgcgaaggtgccattgcagggttagtgggtatcacaccagcctgtggatttgtatttccatggggagccgctgctgggggtatcgtaccggcattggtatgtaactttcttcatgacctcaatgaatggattggcgttgatgaaacgcttcgtgtctttaacttacacggtatcggcggcattgttggctccatcgtgctcggtgtagtagcgcatcccgatgtcgctgcctcagatggcgctacagttatagacgggggctgggccgttcatcactggaaacaaatgggttatcaatttgcaggttttacctctgttgctgcatggtctttcgtcataacagctatcatatgtctgttagtagatctagtaccgggccttcatattcgtgcatcttttgaagaagagttacgaggaatggattttgttgagttagaagagcaacttccaggccaaactttagagtcaaaacctatgattatatacgctcaggaaatggacgaacctgtaactcagggttcaaatataaaacaggaaaagcaggatgagttttga

SEQ ID NO: 1701 - protein, 517 aa, Schizosaccharomyces pombe 972h-
MLNEPNALLRRDANSTIATVTELFPNEYSNADIAYVLLSTVVVFTVTPGIALYYAGMVRKNSALSILTQSFLVTAVVFIQWYLFGYSLACSSGSSFYGTLWQGGMNHLWLEPYIPGSTIPAIVYFPFGGLFAVATAQLFAGAMAERGRLIPSLVISFLYITLVYCPQAYWTWAPNGWLYTLGALDFAGGGPVHISSGFAALAYSLCLGRRIVVDEPDRPDSIRSTDNADLPSSSQNNCKANWKRWFGFKSVSWKNSFGRGKIAHNPPHDAGMVYIGVVLIWFAWLCFNSGTLLTVNIRTAYIMTNTLISSSFGALTWAIIDYIRYRKFSTIGICEGAIAGLVGITPACGFVFPWGAAAGGIVPALVCNFLHDLNEWIGVDETLRVFNLHGIGGIVGSIVLGVVAHPDVAASDGATVIDGGWAVHHWKQMGYQFAGFTSVAAWSFVITAIICLLVDLVPGLHIRASFEEELRGMDFVELEEQLPGQTLESKPMIIYAQEMDEPVTQGSNIKQEKQDEF

SEQ ID NO: 1702 - DNA, 1317 bp, Corynebacterium glutamicum ATCC 13032
  CDS (1)..(1317): transl_table=11
atgggtgcagatcaaattgcagcagtctccggcaattcagcttggatgctgatgtccgcgtcgctcgtgctgctaatgacaccagcactggcacttttctatggcggcatgtctcgtcaaaagtccgtgctcaacatgatgatgatgtcctttggagcattgggcgtcgttactgttatttacctcttgtggggatggtcgatgtcttatggaacccaatcaatcgcgggaatctttgctaacccttttgagttcttcggtcttaaagattccatcgttgatgcagacggcaactacattgagggcgcagctggctacccaaacattattgatatcggattccagcttaccttcgccgttatctccactgcactgatctccggtgcgttggcagagcgtgtgaagttttccacctggcttattttcagcggcgcgtgggtgactttggtgtacttcccactggcacacatggtgtggggtggcggattgttgggccataatgtcactggttttgcttcgtggttgtttggttctaccgatggtgaagccaatatcgctccgatcgactttgctggtggtaccgttgttcacatttcggcgggcacagcggcccttgtgctggcttttatcgtcggcaagcgaaagacgtttggcaaggcaattgccaggccgcacaacctgcccatggtcatgctcggcgctgcgctgttgtggtttggttggttcgggttcaacggtggctcggcgttcgcagccgacggccttgcgggcctggcctgggtgaacaccacggcggcaaccgcagctgcgatgcttggctggttggctactgaaaaattccgcgatggacacgcaacctccttgggtgctgcttctggtgtcgtcgccggtctggtcgcaattactccagcagctggcgcactgaccccagtgacctccctgatcctcggtgcaatcggcggcatcttggcgtgcttgggcgtggggctgaagtaccgcttcggtttcgatgactccctcgacgtagttggtgtgcacctggtcgctggcctgtggggcaccgtgggtgtaggacttcttgccactgacatcggatggtttagtggtggtggcatggatggacttaaactctttattgtccagatcgtcatcgcgctagtcgctgtagttttcgcaggtgtgattactgcgctcatcgcattcgccctgaaggccacagtaggatggcgcgttgatgatgatgtggagcagcaaggcattgatactcacgaacacgcagaatccgcttatgacaccacgggtccggaaattcgttaa

SEQ ID NO: 1703 - protein, 438 aa, Corynebacterium glutamicum ATCC 13032
MGADQIAAVSGNSAWMLMSASLVLLMTPALALFYGGMSRQKSVLNMMMMSFGALGVVTVIYLLWGWSMSYGTQSIAGIFANPFEFFGLKDSIVDADGNYIEGAAGYPNIIDIGFQLTFAVISTALISGALAERVKFSTWLIFSGAWVTLVYFPLAHMVWGGGLLGHNVTGFASWLFGSTDGEANIAPIDFAGGTVVHISAGTAALVLAFIVGKRKTFGKAIARPHNLPMVMLGAALLWFGWFGFNGGSAFAADGLAGLAWVNTTAATAAAMLGWLATEKFRDGHATSLGAASGVVAGLVAITPAAGALTPVTSLILGAIGGILACLGVGLKYRFGFDDSLDVVGVHLVAGLWGTVGVGLLATDIGWFSGGGMDGLKLFIVQIVIALVAVVFAGVITALIAFALKATVGWRVDDDVEQQGIDTHEHAESAYDTTGPEIR

SEQ ID NO: 1704 - DNA, 1209 bp, Methanosarcina acetivorans C2A
  CDS (1)..(1209): transl_table=11
ttgaggtggatagaaatggcaatcgtagcagcagataccgtatgggtattgatttcctctgcccttgtattattaatgcttccagggctcgcactgttttatggcggattggttcagcgtaagaatgtactgagcagcatgatgcattcatttgttgcaatgggtgtcatggctctcgaatgggtaataattggttactcgcttgcgtttgggagcggaaacggtttcataggcagcctggaacacgtattcctgaaaggaattgacccttactcggtaacagggacaattcccacatatgcatttattgcctttcagggaatgtttgcaataattacccctgcccttatctcaggggccattgtcggacgtgtcaagttcaaatcatacatcgcattcatcgccctctggggactcattgtctatgcaccggtctgccactgggtatggggcggtgggttcctcacaggagaagcccttgactttgcaggtggaacggtagtccatataacatcaggcatatcctcactggcaattctgaccttccttggaaagaggagagggtacggcatagattcgataaaaccgcacaatgtcaccctgactcttctggggaccgggctcctctggttcggatggttcgggttcaatgccggctcctctcttgctgcaaatgaaattgcagccctcgcattcattacaaccctcgtagcccccgcagctgcagggtttgtctggatgaccctggaatggatccacctggggcgccctactgccctcggatttgcaacaggcgtcctggcagggcttgttgccataaccccggctgcagggtttgttacccccatggcagcaattccgataggtgtggttacaagctttatctgctaccaggctgtaatgctcaagggaagattaggttatgatgattctcttgatgctttcggagtccacggagtaggcggaattagcggggcaattctgacaggcgtatttgcaagcatagggtcttcaggactccttctcggcaactccgagcaactgatgctccaggtagaaggcgttattgccacgcttgtttacgcaagtgtttgcacccttatcatcgggtttgtactccacaagacgatcgggctcaaggtaagcgagagcgaagaaaatatcgggcttgaccggacacaacacggagaagcagcatataacatttga

SEQ ID NO: 1705 - protein, 402 aa, Methanosarcina acetivorans C2A
MRWIEMAIVAADTVWVLISSALVLLMLPGLALFYGGLVQRKNVLSSMMHSFVAMGVMALEWVIIGYSLAFGSGNGFIGSLEHVFLKGIDPYSVTGTIPTYAFIAFQGMFAIITPALISGAIVGRVKFKSYIAFIALWGLIVYAPVCHWVWGGGFLTGEALDFAGGTVVHITSGISSLAILTFLGKRRGYGIDSIKPHNVTLTLLGTGLLWFGWFGFNAGSSLAANEIAALAFITTLVAPAAAGFVWMTLEWIHLGRPTALGFATGVLAGLVAITPAAGFVTPMAAIPIGVVTSFICYQAVMLKGRLGYDDSLDAFGVHGVGGISGAILTGVFASIGSSGLLLGNSEQLMLQVEGVIATLVYASVCTLIIGFVLHKTIGLKVSESEENIGLDRTQHGEAAYNI

SEQ ID NO: 1706 - DNA, 1347 bp, Streptomyces coelicolor A3(2)
  CDS (1)..(1347): transl_table=11
atggctccagccatcacgctcgccgcagagacggagctctctgccgccaacacgggcttcatgctcatctgctccgccctggtgatgctcatgaccccggccctggccttcttctacggaggcatggtccgcgtcaagagcaccctgaacatgctgatgatgagcttcatcagcctcggcatcgtcaccgtcctgtgggtgctctacggcttttccatggcgttcggcaccgactccggcagcgtcgtcggctggaactccgactgggtgggcctgagcgacatcggcctgaccgagctgtgggacggctacaccatccccgtcttcgtcttcctggtcttccagctgatgttcgccgtcctcacccccgccctgatcagcggggccctcgcggaccgggtgaagttcacggcctgggcgctgttcatcgccctgtgggccacgatcgtctacttcccggtggcccactgggtctggggcgccggcggctgggccttcgagctgggcgtcatcgacttcgccggcggcacggccgtgcacatcaacgccggtgccgccgcgctcggcgtgatcctcgtcatcggcaagcgggtcggcttcaagaaggacccgatgcgcccgcacagcctcccgctggtcatgctcggcgccggcctgctctggttcggctggttcggcttcaacgccgggtcgtggctcggcaacgacgacggcgtcggcgcgctgatgttcgtcaacacccaggtcgccaccggcgccgccgtcctcggctggctcgcctacgagaagatccgccacggcgccttcaccaccctgggcgcggcctccggcgccgtctccgggctggtcgccatcaccccggcaggcggcgccgtctccccgctcggcgcgatcgccgtcggcctcgtcgccggcgtggtgtgcgccatggccgtcggcctgaagtacaggttcggctacgacgactccctcgacgtggtcggcgtccacctcgtcggcggcatcctcggctcgctgctcatcggcttcttcgccagcggcaagggccagtccgacgtcgagggcctcttctacggcggcggcctcgaccagttctggaagcagtgcgcgggcgtcttcggcgtcctcgcctactccctggtcgtctccgcggtcctcgccttcctgctggacaagacgatcggcatgcgggtgtcggaggacgtcgaggtggccggcatcgaccaggccgagcacgccgagaccgcatacgacttcagcggcgccggcggcggtgccgcccggacgaccgccacgccggccgcctccacggccgggtcggccccgagcaagaaggtggacgcatga

SEQ ID NO: 1707 - protein, 448 aa, Streptomyces coelicolor A3(2)
MAPAITLAAETELSAANTGFMLICSALVMLMTPALAFFYGGMVRVKSTLNMLMMSFISLGIVTVLWVLYGFSMAFGTDSGSVVGWNSDWVGLSDIGLTELWDGYTIPVFVFLVFQLMFAVLTPALISGALADRVKFTAWALFIALWATIVYFPVAHWVWGAGGWAFELGVIDFAGGTAVHINAGAAALGVILVIGKRVGFKKDPMRPHSLPLVMLGAGLLWFGWFGFNAGSWLGNDDGVGALMFVNTQVATGAAVLGWLAYEKIRHGAFTTLGAASGAVSGLVAITPAGGAVSPLGAIAVGLVAGVVCAMAVGLKYRFGYDDSLDVVGVHLVGGILGSLLIGFFASGKGQSDVEGLFYGGGLDQFWKQCAGVFGVLAYSLVVSAVLAFLLDKTIGMRVSEDVEVAGIDQAEHAETAYDFSGAGGGAARTTATPAASTAGSAPSKKVDA

SEQ ID NO: 1708 - DNA, 1200 bp, Methanosarcina mazei Go1
  CDS (1)..(1200): transl_table=11
ttgaaaatggctataaacggagcagacactgtatgggtattgctttcatcggcattggtattattaatggttcctgcgctggcactgttctacggagggcttgtccagcgtaaaaacgtcctgagcagcatgatgcattcattcgttgcaatgggcgtcctggctcttgaatggataataataggttactcccttgcgttttcagaaggcaactggtttattggcggccttgagaatgtgtttctgagcgggattgatccttactccgtaacaggtacgattcccacctatgcatttgttgcattccagggaatgttcgcaataattactcctgcacttatatccggtgccatagtagggcgtgtcaagttcaagtcttacatcgcgttcatcctgctctggggccttattgtctatgccccggtatgtcactgggtttggggcggcggattccttaccggagaagcccttgactttgcaggcggtacggttgtccacataactgcaggtatgtcttcacttgcaatactggcatacctcggcaagagaaggggatatggtgttgattccctgaagccgcacaacgttaccctgaccctcctcggagccggacttctctggttcgggtggttcgggttcaacgcaggctcggctcttgctgcaaacgaaatagcagcccttgcattcatgaccacgctcgttgctcccgctgcagcaggttttgtctggatggcgcttgaatgggcgcaccttggacgccccaccgcactcgggtttgcaaccggcatcctggcagggcttgtagggataactcctgctgccggatttgtcactccagtagccgcgattgccataggtgcgattgcaagcttcatatgttaccaggctgtgatgttcaaaaacaggctaggatacgacgattcacttgatgcatttggagttcacggagtcggcggaatagtcggtgcgatattaacaggcgtatatgcaagtgtaggcggagaaggcctacttctcgggaactctgcccagttgatgattcagcttcagggcgtggttatcacaattgtatacgcaatggcctgcaccctgctgataggatttgtactccataaaacgatagggctcaaagtcagtgaaagcgaagaaatcatagggcttgacaaaacccagcatggtgaagcagcatacaacatttga

SEQ ID NO: 1709 - protein, 399 aa, Methanosarcina mazei Go1
MKMAINGADTVWVLLSSALVLLMVPALALFYGGLVQRKNVLSSMMHSFVAMGVLALEWIIIGYSLAFSEGNWFIGGLENVFLSGIDPYSVTGTIPTYAFVAFQGMFAIITPALISGAIVGRVKFKSYIAFILLWGLIVYAPVCHWVWGGGFLTGEALDFAGGTVVHITAGMSSLAILAYLGKRRGYGVDSLKPHNVTLTLLGAGLLWFGWFGFNAGSALAANEIAALAFMTTLVAPAAAGFVWMALEWAHLGRPTALGFATGILAGLVGITPAAGFVTPVAAIAIGAIASFICYQAVMFKNRLGYDDSLDAFGVHGVGGIVGAILTGVYASVGGEGLLLGNSAQLMIQLQGVVITIVYAMACTLLIGFVLHKTIGLKVSESEEIIGLDKTQHGEAAYNI

SEQ ID NO: 1710 - DNA, 1476 bp, Xanthomonas axonopodis pv. citri str. 306
  CDS (1)..(1476): transl_table=11
atgcgctctgaccccaccagccccggagttcgtatgaagacagctctttttgccgggtggaaagcccggttctacagcgtgtgcatgctgatgctgttcagcgcgctgatggtgggcggcatgggcagtgcgcatgcgcagtccacgccgcaggtcaccccgctgccgaccgagccggtcaccaccgaaccgctgccgtcggcgcagccggccgccccgccggccgccgccgccgaagccgcaccggtcgtggagaagggcgatgtcgcctggatgctgacctccaccttgctggtgttgctgatggtggtgccgggccttgcgctgttctacggcggcatggtgcgcgccaagaacgtgttgtcggtgctgatccaggtggcggtggtgttctcgctgctgaccgtgctgtgggtgttctacggctacagcctggcgttctccggcgaaggcgcgtggatcggcaatctggacaaggcgttgctcaagggcgtcaccatcgaaaccctggcggcgaccttcaccaagggcgtgagcctgccggaatacgtgttcgtggcgttccaggcgaccttcgccggcatcaccggcgcgctgatcgtgggcgcctttgccgaacgcgccaagttcgcggcggtgctgctgttctcggcgatctggttcaccttcggctacctgccgctggcgcacatggtctgggccaccggtgggtatctgttcgggttgggcgcgttggatttcgccggcggcaccgtggtgcatatcaacgccggcgttgccggcctggtcggcgcctacttcgtcggcaagcgtgccggactgggacgtgaggcgatcaagccgcacaacgtgaccctgaccttcgtcggtgcctcgctgctgtgggtgggctggttcggcttcaacgccggttccaacctggaagccaatgccggtgcggcgctggccttcctcaacaccttgctggccactgccgctgccatcctgggctggtcgctgaccgagaagatcatcaagggcaagtcgtccgccctgggcgtggcctcgggcatggtggccggcctggtcggcatcaccccggcctgcggcacggtcggcccgttcggcgcgatcgtcattggtctggcggccggcgtactgtgcgtgtggggcgtcaccggcctgaagcgcctgttgggcgcggacgacagcctggacgtgttcggcgtgcatggcctgggcggcatcatcggcgccatcctgaccggtgtgttctcggcggcctcgctgggcggccagaagggcggcgattacgacatcgtccaccaggtcggcatccaggcgctgggcgtcgggatcacggtcggctggatcggcgtggtgtcggtggtggggttcgtggttgccaagctggtgttcggcctgcgcgtgagcgaagaagccgagcgcgagggcctggacatcacctcgcacggcgaagccgcgtacgagtcgtga

SEQ ID NO: 1711 - protein, 491 aa, Xanthomonas axonopodis pv. citri str. 306
MRSDPTSPGVRMKTALFAGWKARFYSVCMLMLFSALMVGGMGSAHAQSTPQVTPLPTEPVTTEPLPSAQPAAPPAAAAEAAPVVEKGDVAWMLTSTLLVLLMVVPGLALFYGGMVRAKNVLSVLIQVAVVFSLLTVLWVFYGYSLAFSGEGAWIGNLDKALLKGVTIETLAATFTKGVSLPEYVFVAFQATFAGITGALIVGAFAERAKFAAVLLFSAIWFTFGYLPLAHMVWATGGYLFGLGALDFAGGTVVHINAGVAGLVGAYFVGKRAGLGREAIKPHNVTLTFVGASLLWVGWFGFNAGSNLEANAGAALAFLNTLLATAAAILGWSLTEKIIKGKSSALGVASGMVAGLVGITPACGTVGPFGAIVIGLAAGVLCVWGVTGLKRLLGADDSLDVFGVHGLGGIIGAILTGVFSAASLGGQKGGDYDIVHQVGIQALGVGITVGWIGVVSVVGFVVAKLVFGLRVSEEAEREGLDITSHGEAAYES

SEQ ID NO: 1712 - DNA, 1302 bp, Brucella suis 1330
  CDS (1)..(1302): transl_table=11
atgctcataacaggaagaaacaagcaaacggccctcgtggccagcctgcccgcacttttcgccctggcggggacggcaatggcgcaggacaccgcaccggcaccaaccctcgatacgggcgatacggcctggatgctgacttcaaccgcgcttgtgttgatgatgaccatacccggtctggcgctgttttatggcggcatggtgcgcaagaagaacgtgctgtccacggtgatgcaaagctttgccatcacctgcctcatgtccatcctgtggatgatcgcaggctattcgctggcctttaccgatggcggctcgctccattcctatattggcggcttctcgaaggttttcttctccggagtgacgatggaatcgctcaccggaaccatccctgaatatctcttcatcaccttccagatgacgtttgcgatcatcacgcccgcgctgattaccggctcgtttgcagagcgcatgaagttttcctccatgctggttttcctgacgctgtggctgttcatcgtttatgttccggttgcccattgggtctggggcgggggcttcatggcttccgatggcgtgcttgattttgccggtggcacggtcgttcatatcaatgccggtgttgccggtctggtggcagccctcgttatcggcaagcgcgatggttatggccacaccaacatggcgccgcacaatctcgtgctctcggtcatcggtgctgcccttctgtgggtgggctggttcggcttcaatgccggttctgccgccggtgccaatgcgcttgccggtgtcgccatgctcaacacgcaggtcgcaaccgccggtgctgctcttgcgtggatgtttgtggaatgggctatttccggcaagccaagtgtgctcggcattatttccggcgctgttgcgggccttgtcgcggtcacgcccgctgccggttttgtcaatccgaccggcgcgcttatcatcggcatcgttgccggtgcggtctgctatgtggcggctgtgaagatcaagcatgtgctgggctatgacgattcgctcgatgcgttcggcgtccatggcgtcggtggttttgtcggcgcggtgctgaccggcttttttgccgatgctacgatcaatccggccagcgaaggggcaaccatcggcaagcagttcttcggcgccgccatcacgatcatttatacggcgattgccaccgtgatcatcctttacgtggtcaaggccatcatgggcttgcggcccggcaagcaggccgagatcgaggggctggatatcgccttgcatggggaggcggtgcagtga

SEQ ID NO: 1713 - protein, 433 aa, Brucella suis 1330
MLITGRNKQTALVASLPALFALAGTAMAQDTAPAPTLDTGDTAWMLTSTALVLMMTIPGLALFYGGMVRKKNVLSTVMQSFAITCLMSILWMIAGYSLAFTDGGSLHSYIGGFSKVFFSGVTMESLTGTIPEYLFITFQMTFAIITPALITGSFAERMKFSSMLVFLTLWLFIVYVPVAHWVWGGGFMASDGVLDFAGGTVVHINAGVAGLVAALVIGKRDGYGHTNMAPHNLVLSVIGAALLWVGWFGFNAGSAAGANALAGVAMLNTQVATAGAALAWMFVEWAISGKPSVLGIISGAVAGLVAVTPAAGFVNPTGALIIGIVAGAVCYVAAVKIKHVLGYDDSLDAFGVHGVGGFVGAVLTGFFADATINPASEGATIGKQFFGAAITIIYTAIATVIILYVVKAIMGLRPGKQAEIEGLDIALHGEAVQ

SEQ ID NO: 1714 - DNA, 1332 bp, Pseudomonas putida KT2440
  CDS (1)..(1332): transl_table=11
atgactctgcgtaagatcgcagggctaggagccctattgtccctcgtaatgcccgggcttgccctggcagaggaagctgccccagcgcttaattccggcgacaccgcctggatgctgaccgcaacggcgctggtgctgttcatgactattccgggcttggccctgttctatggcggcatggtgcgatccaagaacgtgctgtcggtgatgatgcagtgctttgcaatcaccggcctgatgagcattctctgggtcgtctacggctacagcatggccttcgataccgccggtatggaaaagggcgtgctcaacttcaactccttcgttggcggcttctccaaggccttcctcagcggtgtcacgcccgacagcctgacctcggccaccgcgctgttccctgaagcggtgttcatcaccttccagatgacgttcgccatcatcaccccggcgttgatcgtcggtgcctttgccgagcgcatgaagttctcggcgatgctcgtattcatgggtatctggttcaccctggtgtatgcgccgatcgcacacatggtgtggagcggtgacggtgccctgatgtgggactggggcgtactggacttcgctggcggcaccgtggtgcacatcaacgccggtatcgcaggcctggtctgctgcctggtactgggcaagcgcaagggctacccgaccacgccgatggccccgcacaacctcggctataccctgatgggcgcagcgatgctgtggatcggctggttcggtttcaacgcaggctctgctgctgccgccaacggtactgccggcatggccatgctggtcactcagatcgctaccgccgccgccgccctgggctggatgttcgccgagtgggtcggtcacggtaagccaagtgctctgggcatcgcttcgggcgtggttgctggcctggtcgccatcaccccggctgcgggcaccgtcgggccgattggcgcgctgatcatcggcctggtttcgggtgtgctctgctacttctgcgccaccacgctcaagcgcaaactcggctatgacgattcgctggatgccttcggcgtgcacggtgttggcggcatcatcggtgccatcctcacgggtgtattcgcggctccggcgctgggcggcttcggtaccgtcaccgacatcggcatgcaagtctggatccaggccaaaggtgtgattttcaccgtggtctacaccgccatcgtcacctacgtgattctcaaggtgctggatgtggtgatgggcctgcgggtcaacgaagaagaagagtcggtcggcctcgacctggctcagcacaacgagcgcggctacaacctgtaa

SEQ ID NO: 1715 - protein, 443 aa, Pseudomonas putida KT2440
MTLRKIAGLGALLSLVMPGLALAEEAAPALNSGDTAWMLTATALVLFMTIPGLALFYGGMVRSKNVLSVMMQCFAITGLMSILWVVYGYSMAFDTAGMEKGVLNFNSFVGGFSKAFLSGVTPDSLTSATALFPEAVFITFQMTFAIITPALIVGAFAERMKFSAMLVFMGIWFTLVYAPIAHMVWSGDGALMWDWGVLDFAGGTVVHINAGIAGLVCCLVLGKRKGYPTTPMAPHNLGYTLMGAAMLWIGWFGFNAGSAAAANGTAGMAMLVTQIATAAAALGWMFAEWVGHGKPSALGIASGVVAGLVAITPAAGTVGPIGALIIGLVSGVLCYFCATTLKRKLGYDDSLDAFGVHGVGGIIGAILTGVFAAPALGGFGTVTDIGMQVWIQAKGVIFTVVYTAIVTYVILKVLDVVMGLRVNEEEESVGLDLAQHNERGYNL

SEQ ID NO: 1716 - DNA, 1287 bp, Escherichia coli CFT073
  CDS (1)..(1287): transl_table=11
atgaagatagcaacgataaaaactgggcttacttcactggcgatgctgccgggactggtaatggctgcacctgcggtggccgataaagccgacaatgcgtttatgatgatttgtactgcgctggtgctgtttatgaccgttccggggattgccctgttttatggagggctgattcgtggcaaaaacgtgctgtcgatgctgacgcaggtgaccgtgacgtttgcactggtctgtattctctgggtggtttacggctactcgctggcgtttggcgaaggcaacaacttcttcggcaacattaacgggttgatgctgaaaaacattgaactgacggcggtgatgggcagcatttatcagtatatccacgtggcgtttcagggatcgtttgcctgcattaccgtaggcttgatagttggggcgctggcggaacgaatccgcttctcagctgtgttgatttttgtggtggtatggctgacgctctcttacattccgattgcgcatatggtctggggcggcggtttgctggcttctcacggggcactggatttcgcgggtggcacggtggtgcatattaacgccgcaatcgccggtctggtgggcgcgtatctgataggcaaacgcgtgggcttcggtaaagaggcgtttaaaccgcacaacctgccgatggtcttcaccgggactgctattctctatatcggttggtttggctttaacgccgggtcagcgggcacggcgaatgaaatcgcggcactggcatttgtgaatactgtggtcgcaactgcggcggcaattcttggctggatcttcggtgaatgggcgctgcgtggtaagccttcactgctgggagcgtgttctggcgcgattgccggtctggtcggcgtgacgccagcctgtggttacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggtattgtcggctgtatcatgaccgggatttttgccgccagctcgctgggcggtgtgggcttcgctgaaggtgtgacgatgggccatcagttgctggtacagctggaaagcatcgccattacgattgtctggtctggtgtggtggcatttatcggctacaaactggcggatctgacggttggtctgcgtgtaccggaagagcaggagcgagaagggctggacgtcaacagccacggcgagaatgcctataacgcgtaa

SEQ ID NO: 1717 - protein, 428 aa, Escherichia coli CFT073
MKIATIKTGLTSLAMLPGLVMAAPAVADKADNAFMMICTALVLFMTVPGIALFYGGLIRGKNVLSMLTQVTVTFALVCILWVVYGYSLAFGEGNNFFGNINGLMLKNIELTAVMGSIYQYIHVAFQGSFACITVGLIVGALAERIRFSAVLIFVVVWLTLSYIPIAHMVWGGGLLASHGALDFAGGTVVHINAAIAGLVGAYLIGKRVGFGKEAFKPHNLPMVFTGTAILYIGWFGFNAGSAGTANEIAALAFVNTVVATAAAILGWIFGEWALRGKPSLLGACSGAIAGLVGVTPACGYIGVGGALIIGVVAGLAGLWGVTMLKRLLRVDDPCDVFGVHGVCGIVGCIMTGIFAASSLGGVGFAEGVTMGHQLLVQLESIAITIVWSGVVAFIGYKLADLTVGLRVPEEQEREGLDVNSHGENAYNA

SEQ ID NO: 1718 - DNA, 1338 bp, Pseudomonas syringae pv. tomato str. DC3000
  CDS (1)..(1338): transl_table=11
atgactctgcgtcaattcgcagggctcggtgccctgttgtccctcgcaatacctggtcttgccctggcggctgacccagtggccgagccggtgctgaactctggcgacaccgcatggatgctgaccgcgaccgctctggtcctgttcatgaccattcccggtctcgcgctgttctacggcggcatggtccgttcaaaaaacatcctgtccgtgatgatgcagtgtttcgccatcaccggcctgatcagcatcctgtgggtcgtttacggttacagcatcgcgtttgacacaaccggtatggaagctggcgtcgtcaacttcaattccttctttggcggtatgggtaaagcgttcctggcgggtatcacgcctgcaagccttaccggtcctgctgcattgttccctgaggcggtgttcgtcacctttcagatgacctttgcgatcatcactccagccctgatcgtcggtgctttcgcagaacgcatgaagttctccgcgatgctgattttcatgggtatctggttcacgctggtctacgcgccaattgcccatatggtctggggcggcgtcggtggcttgatgtgggactggggcgttctggacttcgcaggtggcaccgtggtgcacatcaacgccggtgtagccggtctggtggcttgcctggtactgggcaagcgcaaaggcttcccgaccaccccgatggctccgcacaatctgggttacaccctgatcggcgcagcgatgctctgggttggctggttcggtttcaacgccggttccgccgctgcggccaacggcactgccggtatggcgatgctggtgacgcaaatcgctaccgctgccgccgcgctgggctggatgttcgccgagtggctgacgcacggtaagccaagtgcgctgggcatcgcttcgggtgtggttgccggtctggttgccatcaccccggcggccggtacagttggcccgatgggcgcgctgatcatcggtctggcggcaggcgtgatctgcttcttctgcgccaccagcctcaagcgcaagcttggctacgatgactccctggatgcgttcggcgttcacggtatcggcggtatcgtcggcgcgatcctgaccggtgtgttcgcagcacctgcactgggcggcttcggcacggtgactgacatcggtgctcaagtctggattcagttcaagggcgtcgcgttcaccgtcgtctacaccgcgatcgtgaccttcatcatcctcaaggtactggatgcagtgatgggtctgcgggttaccgacgaggaagagtctgtcggtctggaccttgcgcaacacaacgagcgtggctacaacttgtaa

SEQ ID NO: 1719 - protein, 445 aa, Pseudomonas syringae pv. tomato str. DC3000
MTLRQFAGLGALLSLAIPGLALAADPVAEPVLNSGDTAWMLTATALVLFMTIPGLALFYGGMVRSKNILSVMMQCFAITGLISILWVVYGYSIAFDTTGMEAGVVNFNSFFGGMGKAFLAGITPASLTGPAALFPEAVFVTFQMTFAIITPALIVGAFAERMKFSAMLIFMGIWFTLVYAPIAHMVWGGVGGLMWDWGVLDFAGGTVVHINAGVAGLVACLVLGKRKGFPTTPMAPHNLGYTLIGAAMLWVGWFGFNAGSAAAANGTAGMAMLVTQIATAAAALGWMFAEWLTHGKPSALGIASGVVAGLVAITPAAGTVGPMGALIIGLAAGVICFFCATSLKRKLGYDDSLDAFGVHGIGGIVGAILTGVFAAPALGGFGTVTDIGAQVWIQFKGVAFTVVYTAIVTFIILKVLDAVMGLRVTDEEESVGLDLAQHNERGYNL

SEQ ID NO: 1720 - DNA, 1341 bp, Streptomyces avermitilis MA-4680
  CDS (1)..(1341): transl_table=11
atggcaccagccatcacgcttgccgcagaggctcccaagctgtctgccgccaacacaggcttcatgctcatctgttccgccttggtactgatcatgaccccgggcctggccttcttctacggaggcatggtccgcgtcaagagcactctgaacatgctcatgatgagcttcatcagcatgggcatcgtcaccatcctgtgggtgctgtacggcttctcgctcgccttcggtaccgacaagggttcgctcatcggctggacgtccgacttcgtcggcttcaccgggatcggcaaggtggagctctggcccggttacaccattccggtctatgtcttcgccaccttccagctgatgttcgcgatcatcacgcccgccctgataagcggagccctggccgaccgcgtcaagttcaccgcctggtccctgttcgtcgccctgtgggccacggtcgtgtacttcccggtcgcgcactgggtgtggggcaccggtggctgggccttcgacctcggcgtgatcgacttcgccggtggtacggcggtccacatcaacgcgggtgccgcggcgctcggcgtcatcctggtcatcggcaaacgcgtcggcttcaagaaggacccgatgcgcccgcacagcctgccgctggtcatgctcggctgcggcctgctgtggttcggctggttcggattcaacgcaggctcgtggctcggcaacgacgacggtgtcggcgcgctgatgttcatcaacacgcagatcgccaccgccgctgcgatgctcgcctggctcgcgtacgagaagatccgccacggcgcgttcaccaccctcggtgccgcctccggcgcggtcgcgggcctggtcgccatcaccccgtccggtggcgcggtctccccgctcggcgcgatcgccgtcggcgccatcgccggtgtcctgtgcgccatggccgtgggcctgaagtacaagttcggctacgacgactccctcgacgtcgtcggcgtccacctcgtcggcggtgtcgcgggctccctgctcatcggcttcttcgccagcggcggcggccagtccgacgcgacgggcgtcttctacggcgaccactccttcgaccagctgtggaagcagtgcgccggagtcttcgcggtcctcgcctactccctggtcgtctccgcgatcctcgccttcctgatcgacaagacgatcgggatgcgggtttccgaggacgaggagatcgccggcatcgaccaggcggagcacgccgagaccgcatacgacttcagcggagcgggcggcggcgcggcccggatcctccccgcccctctcgcggacacggcgaccaagaaggtggacgcatga

SEQ ID NO: 1721 - protein, 446 aa, Streptomyces avermitilis MA-4680
MAPAITLAAEAPKLSAANTGFMLICSALVLIMTPGLAFFYGGMVRVKSTLNMLMMSFISMGIVTILWVLYGFSLAFGTDKGSLIGWTSDFVGFTGIGKVELWPGYTIPVYVFATFQLMFAIITPALISGALADRVKFTAWSLFVALWATVVYFPVAHWVWGTGGWAFDLGVIDFAGGTAVHINAGAAALGVILVIGKRVGFKKDPMRPHSLPLVMLGCGLLWFGWFGFNAGSWLGNDDGVGALMFINTQIATAAAMLAWLAYEKIRHGAFTTLGAASGAVAGLVAITPSGGAVSPLGAIAVGAIAGVLCAMAVGLKYKFGYDDSLDVVGVHLVGGVAGSLLIGFFASGGGQSDATGVFYGDHSFDQLWKQCAGVFAVLAYSLVVSAILAFLIDKTIGMRVSEDEEIAGIDQAEHAETAYDFSGAGGGAARILPAPLADTATKKVDA

SEQ ID NO: 1722 - DNA, 1311 bp, Streptomyces avermitilis MA-4680
  CDS (1)..(1311): transl_table=11
gtgaccctggccgccgcccggatcgacaccggcgacaccgcatggctgctcgccgccaccgcgctcgttctcctgatgacccccggcctggccctgttctacggcggcatggtccgcacgaagagcgtcctcaacatgctgatgatgagcttcgtgtcgatcgccctggtcacggtcgtgtggctggccgccggctactcgctcgcgttcggcgacgacctcgcgggcggactcatcggcggcctggaccacgccggcctggcggacctcggtcccgccgacgtccacggcacggtccccaccctcctcttcgccaccttccagctcaccttcgcgatcatcaccgccgccctcatcagcggcgccatcgcggaccgggcgaaattcgcggcctggctggtcttcgtccccctctgggcgctgctcgtatacgttcccgtcgcccactgggtgtggggccccggcggctggatcctcgaccgcctcggcgccctcgatttcgcgggcggactccccgtcgagatcacgtcgggcgcctcgggcctggccctgtgcctggtcctcgggccgcgcctcggcttcaagaaggacgccatgcgcccgcacaacctgccgatggtgatgctgggcgccggtctgctgtggttcggctggttcggcttcaacgcgggttcggcgctcggcgccaacggactggccgccgcggccttcctcaacacgctcgccgccggctgcaccggcctgctcggctggctcttcgtggagcagaagcgcgacggccacccgaccacgctgggcgccgcctccggcgcggtcgcgggcctggtcgccatcaccccgtcctgcggcgcggtctccctgctcggcgcgctggtcgtggggctcgccgccggtgtcgtctgctcgtacgccgtgggctggaagttcaagctgaactacgacgactcgctggacgtcgtcggcgtccacctggtcggcgggatcatcggcaccctgctgatcggggtcttcgcggccaaggagatgacgggcggcaccgagggcctgctctacggcggcgggctcggacagctcggcaagcagctggtggcggtcgtggccgtgggggcgtacgccttcgccgtcacctacggcctcgggaagctgatcgacaaggtcatgggcctgcgggcggccgaggacgacgagcaccagggcctggaccttacggtgcacgccgagaccgcttacgatcacgggattctggggcacggcgccccaagctccgcgtccgtcgtccccaccgcgcagaaggtcaagagccaggcatga

SEQ ID NO: 1723 - protein, 436 aa, Streptomyces avermitilis MA-4680
MTLAAARIDTGDTAWLLAATALVLLMTPGLALFYGGMVRTKSVLNMLMMSFVSIALVTVVWLAAGYSLAFGDDLAGGLIGGLDHAGLADLGPADVHGTVPTLLFATFQLTFAIITAALISGAIADRAKFAAWLVFVPLWALLVYVPVAHWVWGPGGWILDRLGALDFAGGLPVEITSGASGLALCLVLGPRLGFKKDAMRPHNLPMVMLGAGLLWFGWFGFNAGSALGANGLAAAAFLNTLAAGCTGLLGWLFVEQKRDGHPTTLGAASGAVAGLVAITPSCGAVSLLGALVVGLAAGVVCSYAVGWKFKLNYDDSLDVVGVHLVGGIIGTLLIGVFAAKEMTGGTEGLLYGGGLGQLGKQLVAVVAVGAYAFAVTYGLGKLIDKVMGLRAAEDDEHQGLDLTVHAETAYDHGILGHGAPSSASVVPTAQKVKSQA

SEQ ID NO: 1724 - DNA, 1233 bp, Bacillus cereus ATCC 14579
  CDS (1)..(1233): transl_table=11
atgaatatgggagatacagtttttatgtttgtgacgacagtaatggtcatgttgatgacaccaggattggcacttttttatggaggtatggttcgcagcaaaaatgtactcagtacaacgatgcatagttatagtgcaatggctatcgtttcgattcaatggattgttatcggctattctttatcattcggaccagattggcacgggcttattggtacacttgattggttcggtctaaacggagttacctacgcaccaaatccagactactcatctactattcctcacaatttattcatgatgtttcaactcatgttcgccattttaactccagctttaatttcaggtgcatttgctgaaagaatgcgattttctgcctttcttatttttatccttttatggacaacgattgtttacaatcctgtcgctcattgggtatggggcgtcggcgggtggctaagggaatttggtgcactagacttcgctggcggaaacgtcgttcacatcacttccggagttgctggtcttgtattagctattttcctcggaaaacgaaaaaacataaatggttcttctcctcaccatttgccatttacaatgttaggcgcaggcttattatggtttggctggttcggttttaacgtcggcagcgcattatccttaaacgacgtagctttaactgcatttattaatacaaatatagccgctgctgcctcagcattaacttggatgctttcagagtggttcttccaatcaaaaccgactgcgatgggagctgcttgtggcgccgtttccggtctagtcgctattacaccagcttgcgggttcgttacacctttctcagctcttcttatcggagcaattggcggcgtattatgcttcggagcggtctttttcttaaaaacaaaattcggatacgacgatacactcgatgcattcggatgtcacggcatcggtggaacttggggcggtattgcgacaggattatttgcaactactgccgtaaacggcgatggcgctaacggattattttacggaaacgcctcgctgctgttgaaacaacttgtagcgatcggcgcaacatatgcgttcacaattataatgacgtatgccattattaaagcaatcaacttcttcctccctgtccgggtagatgagcacgaggaacatatgggacttgatatttcgatgcacggggagaaagcttatgagtatactgagcgagtgaactaa

SEQ ID NO: 1725 - protein, 410 aa, Bacillus cereus ATCC 14579
MNMGDTVFMFVTTVMVMLMTPGLALFYGGMVRSKNVLSTTMHSYSAMAIVSIQWIVIGYSLSFGPDWHGLIGTLDWFGLNGVTYAPNPDYSSTIPHNLFMMFQLMFAILTPALISGAFAERMRFSAFLIFILLWTTIVYNPVAHWVWGVGGWLREFGALDFAGGNVVHITSGVAGLVLAIFLGKRKNINGSSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTAVNGDGANGLFYGNASLLLKQLVAIGATYAFTIIMTYAIIKAINFFLPVRVDEHEEHMGLDISMHGEKAYEYTERVN

SEQ ID NO: 1726 - DNA, 1590 bp, Rhodopirellula baltica SH 1
  CDS (1)..(1590): transl_table=11
gtggcggaaattacgcttcatccaccatcatccccatcgacttttcactggagcctgcccggaatgttgtcacgcgtgttggttgtcgtttgtttgctcacgtgcattctcggtgtgcccctggtcggcctgccggttgccagtgtgggggctcaggacgaggtcgcaaatacctcggcggctgagactgcaccggccgaaccgtcggcttcggcggaggaaattgccccggcggaggaaaacgaagcagccgaggagccggccgctccgacattggaaagcctgcaagcgggagtcgatgaggctttgctggccggacacaacggttggatgctggtttgttgtgctttggtgttgttcatgaccgcaccaggcctggcgatgttctacggtggtttggtgcgtcgcaaaaatgttctcagcgtgatgatgcagtgcatcttcttgatgggaatgatgacggtgctttgggcactctacggttactcgtttgccttcggtggatcaggcggttggttcggcaacacggactacttgttcatggaaggtgtccagcggtactgggacgatgacttgggcaaagccatcacgccgatggaaggcgcgatgacgcgaatgactcacatgttgttccaaggcatgttcttcatcatcacgcccgctctgatctgcggtgcattcgcggaacggatgaagtttagcgcgatggtggttttctcgatcctttggggaacattcatctattgcccactgacccactgggtttgggacgaaggacctttgtcgtactttgccggtgacaaagccttggccgggggagcactcgactttgcgggtgggacggttgttcacatcagcagcgggatctcggctttggtcgcggcgttgctgatcggtcctcgaatggggtacccacgcgaacctttgcaaccgcacaacttgacctacacggcacttggtgccgcgatgttatgggtgggatggttcggcttcaacgccggcagtgaacttgcatcggatgatttgacagccagtgctttcgccgtgactcacttttcggccgccgccggggcggttgcttgggtgacacttgaatggctggtccttggcaagccgaccgttctgggcgccagcagtggtgcggtcgccggattggtttgcatcacaccggccgctggatttgttcagcccatgccagctttgatcatgggagcgatggcgggcggagtttgttattgggcgtgttcgacgctgaagcacaaacttcgttatgacgatgctttggatgcgtttggcgtccacggagtcggcggcacactcggcgcaattctgaccggcgttttcgcgactcgtgcggcctgggatgtcagcgatggtgtgccaatcggattgatcgaatcgggcggtgacttcaccttggtcatcgggcaggttgtcgccgtgctggtcacctacgtgttcgccggagtcggaagtctgatcctgctgaagctgatcgacatctgcatcggactgcgagttcctgccgaaagcgaacagcgtggtttggacatttcagatcacggcgaagaaggttatcagttcgcctga

SEQ ID NO: 1727 - protein, 529 aa, Rhodopirellula baltica SH 1
MAEITLHPPSSPSTFHWSLPGMLSRVLVVVCLLTCILGVPLVGLPVASVGAQDEVANTSAAETAPAEPSASAEEIAPAEENEAAEEPAAPTLESLQAGVDEALLAGHNGWMLVCCALVLFMTAPGLAMFYGGLVRRKNVLSVMMQCIFLMGMMTVLWALYGYSFAFGGSGGWFGNTDYLFMEGVQRYWDDDLGKAITPMEGAMTRMTHMLFQGMFFIITPALICGAFAERMKFSAMVVFSILWGTFIYCPLTHWVWDEGPLSYFAGDKALAGGALDFAGGTVVHISSGISALVAALLIGPRMGYPREPLQPHNLTYTALGAAMLWVGWFGFNAGSELASDDLTASAFAVTHFSAAAGAVAWVTLEWLVLGKPTVLGASSGAVAGLVCITPAAGFVQPMPALIMGAMAGGVCYWACSTLKHKLRYDDALDAFGVHGVGGTLGAILTGVFATRAAWDVSDGVPIGLIESGGDFTLVIGQVVAVLVTYVFAGVGSLILLKLIDICIGLRVPAESEQRGLDISDHGEEGYQFA

SEQ ID NO: 1728 - DNA, 1239 bp, Bordetella parapertussis 12822
  CDS (1)..(1239): transl_table=11
atggataaagccgatatctcctggctgctggtttcgacactgctggtactgatgatggcggtgcccggcctggccctgttctacggcggcctggtgcgcagcaaaaacgtactgtcggtgctgctgcaagtgctgtgcaccttcgccctcgggctgctgctgtggttcgcctacggctactcgctggccttcaccgaaggcaacgccttcttcggcggcctgtcgcgcacgttcttctccggcatgttcacgccggccgatggcacgtacacgctgtcgggcacgctcaccgagctcttgttcgcctcgttccaggcgaccttcgcgggcatcacctgcgccctgatagtgggcagcttcgccgagcgcgcgcgtttttcggccgtgctggtgttcacggcgatctggttcacctttgcctatatcccgatcgcgcacatggtctggttcgcctccgaaaccgcgccgggcctgctcaatgcccgcggcgcgctggatttcgccggcggcaccgtggtgcacatcaatgcgggggtggccggactggtcggcgcgtacgtggtgggccgacgcatcggctatggccgcgaagcgatgcagccgcacaacctgccgatgaccttcatcggcgcggcgctgctgtgggtcggctggttcggcttcaacgccggctcgtcgctggcggccagcgacggcgccaccctggcgttcttcaacaccatgaccgccaccgcgggcgcagtgctgggctggctgttcacggaatgggccgtcaagggcaaaccctcgatgctgggtgcggcctcaggcgccgtggcgggcctggtcggcatcacgcccgccgccggcctggtcggcccggtcggcgccctggtcatcggcgtgaccgccggcgtggtctgcgtctggggagtaaacggcctgaagcgtctgctgcgcgccgatgacgccctcgatgtgttcggcgtgcatggcgtgggcggcatcgtcggcgccctgctgaccggggtgttcaatgccaaggtgctcggcggcccgggcctggacagcgccagcgcgattgccggccaggtgtgggtgcaattcgaaggcgtgctgctgacgatcgtgtggtccgccgtggtggcctggatcgcctacaagatcgcggacaagctgtgcggactgcgcgtaccggaagatcaggagcgtgaaggactggatgtgaccagccacggagaatcggcttatcacagctga

SEQ ID NO: 1729 - protein, 412 aa, Bordetella parapertussis 12822
MDKADISWLLVSTLLVLMMAVPGLALFYGGLVRSKNVLSVLLQVLCTFALGLLLWFAYGYSLAFTEGNAFFGGLSRTFFSGMFTPADGTYTLSGTLTELLFASFQATFAGITCALIVGSFAERARFSAVLVFTAIWFTFAYIPIAHMVWFASETAPGLLNARGALDFAGGTVVHINAGVAGLVGAYVVGRRIGYGREAMQPHNLPMTFIGAALLWVGWFGFNAGSSLAASDGATLAFFNTMTATAGAVLGWLFTEWAVKGKPSMLGAASGAVAGLVGITPAAGLVGPVGALVIGVTAGVVCVWGVNGLKRLLRADDALDVFGVHGVGGIVGALLTGVFNAKVLGGPGLDSASAIAGQVWVQFEGVLLTIVWSAVVAWIAYKIADKLCGLRVPEDQEREGLDVTSHGESAYHS

SEQ ID NO: 1730 - DNA, 1239 bp, Bordetella bronchiseptica RB50
  CDS (1)..(1239): transl_table=11
atggataaagccgatatctcctggctgctggtttcgacactgctggtactgatgatggcggtgcccggcctggccctgttctacggcggcctggtgcgcagcaaaaacgtactgtcggtgctgctgcaagtgctgtgcaccttcgctctcgggctgctgctgtggttcgcctacggctactcgctggccttcaccgaaggcaacgccttcttcggcggcctgtcgcgcacgttcttctccggcatgttcacgccggccgatggcacgtacacgctgtcgggcacgctcaccgagctcttgttcgcctcgttccaggcgaccttcgcgggcatcacctgcgccctgatcgtgggcagcttcgccgagcgcgcgcgtttttcggccgtgctggtgttcacggtgatctggttcacctttgcctatatcccgatcgcgcacatggtctggttcgcctccgaaaccgcgccgggcctgctcaatgcccgcggcgcgctggatttcgccggcggcaccgtggtgcacatcaatgcgggagtggccggactggtcggcgcgtacgtggtaggccgacgcatcggctatggtcgcgaagcgatgcagccgcacaacctgccgatgaccttcatcggcgcggcgctgctgtgggtcggctggttcggcttcaacgccggctcgtcgctggcggccagcgacggcgccaccctggcgttcttcaacaccatgatcgccaccgcgggcgcagtgctgggctggctgttcacggaatgggccgtcaagggcaaaccctcgatgctgggtgcggcctcgggcgccgtggcgggcctggtcggcatcacgcccgccgccggcctggtcggcccggtcggcgccctggtcatcggcgtgaccgccggcgtggtctgcgtctggggagtaaacggcctgaagcgtctgctgcgcgccgatgacgccctcgatgtgttcggcgtccatggcgtgggcggcatcgtcggcgccctgctgaccggggtgttcaatgccaaggtgctgggcggccccggcctggacagcgctggcgcaatcgccggccaagtgtgggtgcagctcgaaggcgtgctgctgacgatcgtgtggtccgccgtggtggcctggatcgcctacaagatcgccgacaaactgtgcggactgcgcgtaccggaagaccaggaacgcgaaggactggacgtgaccagccacggcgaatcggcctaccacagctga

SEQ ID NO: 1731 - protein, 412 aa, Bordetella bronchiseptica RB50
MDKADISWLLVSTLLVLMMAVPGLALFYGGLVRSKNVLSVLLQVLCTFALGLLLWFAYGYSLAFTEGNAFFGGLSRTFFSGMFTPADGTYTLSGTLTELLFASFQATFAGITCALIVGSFAERARFSAVLVFTVIWFTFAYIPIAHMVWFASETAPGLLNARGALDFAGGTVVHINAGVAGLVGAYVVGRRIGYGREAMQPHNLPMTFIGAALLWVGWFGFNAGSSLAASDGATLAFFNTMIATAGAVLGWLFTEWAVKGKPSMLGAASGAVAGLVGITPAAGLVGPVGALVIGVTAGVVCVWGVNGLKRLLRADDALDVFGVHGVGGIVGALLTGVFNAKVLGGPGLDSAGAIAGQVWVQLEGVLLTIVWSAVVAWIAYKIADKLCGLRVPEDQEREGLDVTSHGESAYHS

SEQ ID NO: 1732 - DNA, 1311 bp, Chromobacterium violaceum ATCC 12472
  CDS (1)..(1311): transl_table=11
atgaaaaagatactcgctgcaatggcttccgggctcgccgccctctccctgcccgcgctggccgatgcgccggccggcccggcggtggccgccgccaaggtgatcaactccggcgacaccgcctggatgctgacctccaccgccctggtgctgttcatgaccattcccggcctggcgctgttctatggcggcatggtccgcaagaagaacgtgctggccacgctgatgcagagcttcgccatcaccgcgctggtgaccgtgctgtgggccgtcgtcggctacagcctggccttcaccgtcggcaccccctatatcggcgacctgtcccgcgtgctgctggacggcatggtgtacatgaaggacgccggcaagctggcggtgcatccgctggccggcaccatcccggaatcggtgttcatgaccttccagatgaccttcgccatcatcaccccggcgctgatcaccggcgccttcgccgagcggatgaagttctctgcgatgctggtcttcatggcgctgtggtctctgctggtctatgtgccggtcgcccactgggtatgggcgccgggcggctggatgggcgacaagggcgtgctggacttcgccggcggcaccgtggtgcacatcaatgccggcgtggccggcctggtgaccgcgctggtgctgggcaagcgcgtcggcttcggccgcgaggcgatgccgccccacaacctggtgctgaccctggtgggcgcgtcgatgctgtgggtgggctggttcggcttcaacgccggctcggcgggcgccgccgacggccgcgccggcatggcgatggtcaccacccaggtcgccaccgcgatggccgcgctggcctggatgttcgccgaatggatcgccaagaaaaagccttcggtactgggcatcgcctccggcgcggtggccggcctggtggccatcaccccggccgccggcttcgtcgacgtcaagggcgcgctggccatcggcctggccgccggcgtgatctgcttctggggcgccaccggcctgaaacacatgatgggctacgacgactcgctggacgctttcggcgtgcacggcgtgggcggcatcctgggcgcgctgctgaccggcgtgttcgcggtcaaggacatcggcggcgccgacggcagcctggccacccaggcgctgggcgtgggcgtgaccatcgtctactgcggcgtggtcaccttcatcctgctgaagctggtggacatcgtgctcggcctgcgcgtcgcggaggacgaggaacgcgaaggcctggatctggtgctgcacggcgagcgggtggaataa

SEQ ID NO: 1733 - protein, 436 aa, Chromobacterium violaceum ATCC 12472
MKKILAAMASGLAALSLPALADAPAGPAVAAAKVINSGDTAWMLTSTALVLFMTIPGLALFYGGMVRKKNVLATLMQSFAITALVTVLWAVVGYSLAFTVGTPYIGDLSRVLLDGMVYMKDAGKLAVHPLAGTIPESVFMTFQMTFAIITPALITGAFAERMKFSAMLVFMALWSLLVYVPVAHWVWAPGGWMGDKGVLDFAGGTVVHINAGVAGLVTALVLGKRVGFGREAMPPHNLVLTLVGASMLWVGWFGFNAGSAGAADGRAGMAMVTTQVATAMAALAWMFAEWIAKKKPSVLGIASGAVAGLVAITPAAGFVDVKGALAIGLAAGVICFWGATGLKHMMGYDDSLDAFGVHGVGGILGALLTGVFAVKDIGGADGSLATQALGVGVTIVYCGVVTFILLKLVDIVLGLRVAEDEEREGLDLVLHGERVE

SEQ ID NO: 1734 - DNA, 1314 bp, Wolinella succinogenes DSM 1740
  CDS (1)..(1314): transl_table=11
atgaaaatcgttaaacttttgatcttggccctgctaccggttctgcttttcggagacgaagccgcagcggaggcagcagagaccgctttggaattggacgccgcgaacacggcttggatgttagtggccacagcctttgtcatgctcatgacacccgctggcttggctctcttttatggaggcatgacgcgctctaagaatatgctcaacaccatcggcatgagcgtggtgggctacattctcgcctctcttgtttgggtgggctggggttatggcctagcctttggtgaagacattggcggatttgtgggcgctttggatggattcttcctcagcaatgttaaggtgactgatatttgggaaggcggaaatattcccgtgctcctattcgctgctttccaaatgacttttgcgggtattaccgtagccttggcaagtggatcagtcattgagcgactcaaattctccacatggattctctttgtggtgctttgggtcaccgtggtttacgctcctgtagcacactgggtgtggggcggaggcttcttggctaatgagggtgttcttgattttgccggaggaaccgttgttcatatcaacgctggggttgcaggtctagtcatggcctatatgcttggcaaacgaagcgacaaagataaggcaatcttcccttcatctgtgactttgaccatgctaggggctattcttctatggtttggatggtttggtttcaacgccggaagcgagcttgctgctgatggaatcgccgctagtgctttcatggtgaccaacactgccgcagcggcagcggctttggcttggatgctcattgaatacgccgtctacaagaagttcaccctcatcggtatcgcctcagggattgtggcgggtctcgtggccatcactcctgcagcgggctttgtagacactcctgcctcagtgatcattggtcttgtagcgggtcttgtggccttctttggtatccatgggctcaaaaaagccttgggggcagacgactctctagatgcctttggaatccatggagttgcgggtatctggggagctttggcgacaggactctttgccaaccccgaagtcaacgagctaggcacgggtcttttctatggaaatgcaggtcaattcctcatccagcttgagggcgtagtggtcactatggtctttaccgccatcgccactgccatcgtcttcaagatcgtctgcttgattactggaggaggaagagtggatgcccaagaagagaccatgggtctggatgagtccacccacggcgaaaaaagctttcacttaaagtaa

SEQ ID NO: 1735 - protein, 437 aa, Wolinella succinogenes DSM 1740
MKIVKLLILALLPVLLFGDEAAAEAAETALELDAANTAWMLVATAFVMLMTPAGLALFYGGMTRSKNMLNTIGMSVVGYILASLVWVGWGYGLAFGEDIGGFVGALDGFFLSNVKVTDIWEGGNIPVLLFAAFQMTFAGITVALASGSVIERLKFSTWILFVVLWVTVVYAPVAHWVWGGGFLANEGVLDFAGGTVVHINAGVAGLVMAYMLGKRSDKDKAIFPSSVTLTMLGAILLWFGWFGFNAGSELAADGIAASAFMVTNTAAAAAALAWMLIEYAVYKKFTLIGIASGIVAGLVAITPAAGFVDTPASVIIGLVAGLVAFFGIHGLKKALGADDSLDAFGIHGVAGIWGALATGLFANPEVNELGTGLFYGNAGQFLIQLEGVVVTMVFTAIATAIVFKIVCLITGGGRVDAQEETMGLDESTHGEKSFHLK

SEQ ID NO: 1736 - DNA, 1437 bp, Gloeobacter violaceus PCC 7421
  CDS (1)..(1437): transl_table=11
atgttaatgaaatgtaaatggaaatggggattgggcacgctggcagcggctctcgccactgccgccccggcgtttgcccaggacgcgccgaagatcgacaccggcgacaccgcctgggtgctggtttcggccgcgctggtgctgctgatgacccccggcctggcctttttctacggcgggctggtgcgaggcaagaacgcactgaacactttgatgatgagttttgttgccctcggggtgatcgcgctcgtttggacgctggtgggctactcgatcgcttttggacccggtaacggttactttggcagcttcgcctggctcggcctcaacggggtcgggcaggatccaaacaccgcccaggctgccaccgtgccgcacctggcgttcatgatttttcagatgatgtttgcggtgattaccccggcgctgatttccggtgccatcgtcgatcgcatgaagttcaagacctacgtcgtgttcatcatgatctggtcggtcgtggtctactcgccggtggcccactgggtctggtcgctgggtaaccccgacccgaccgatgcggccaagatgctgcctggctggctcggggctatcggggcgctcgactttgccggcggtacggtggtgcacctgacggccggtatctcggctttggtggcggcgatcattcttggtccgcgcaaaggctttcccaaccagccgatgactccccacaacgtgccttttgtgctgttgggagcggggctgttgtggttcggctggttcggcttcaacgccggttcggcgctcgccgccaatggcctcgcttcgctggcttttgtgacgacgaatgtcgccacggcggcggctctatccacctggcttttgcttgacacgtttatcggcggcaaaccgacggcggtgggtgcagccaccggtgcggtcgtcggtctggtggcaatcaccccggcggcgggttttgtcagcccgctttcgtcgattgcgatcggcggtatcgccgcgatcatctccttcgccgccattcaactgaagaaaaagctcaactacgacgattcgctcgacgtgtttgcctgccacggcatgggcggtctgaccggcgccattctcactggggtgtttgccgacaaatcgctcaattccctgggtgataacggcttgctcctgggcaacggggcgcagcttattgagcaattgattggtgtcggtgccgttgccgtctacgcagcggtctgcacgacggtcattttgctggcgctcaagttcaccctgggactgcgcccgagcgaggaagccgagcaggagggcctcgacaccgccgagcacggcgaggaagcctacaccggcagcatcggcggccttggcgccatggaagaagcgatgtcctccacttcccagggccagggttttacccgaccggcgacccagcagcaagaatag

SEQ ID NO: 1737 - protein, 478 aa, Gloeobacter violaceus PCC 7421
MLMKCKWKWGLGTLAAALATAAPAFAQDAPKIDTGDTAWVLVSAALVLLMTPGLAFFYGGLVRGKNALNTLMMSFVALGVIALVWTLVGYSIAFGPGNGYFGSFAWLGLNGVGQDPNTAQAATVPHLAFMIFQMMFAVITPALISGAIVDRMKFKTYVVFIMIWSVVVYSPVAHWVWSLGNPDPTDAAKMLPGWLGAIGALDFAGGTVVHLTAGISALVAAIILGPRKGFPNQPMTPHNVPFVLLGAGLLWFGWFGFNAGSALAANGLASLAFVTTNVATAAALSTWLLLDTFIGGKPTAVGAATGAVVGLVAITPAAGFVSPLSSIAIGGIAAIISFAAIQLKKKLNYDDSLDVFACHGMGGLTGAILTGVFADKSLNSLGDNGLLLGNGAQLIEQLIGVGAVAVYAAVCTTVILLALKFTLGLRPSEEAEQEGLDTAEHGEEAYTGSIGGLGAMEEAMSSTSQGQGFTRPATQQQE

SEQ ID NO: 1738 - DNA, 1320 bp, Photorhabdus luminescens subsp. laumondii TTO1
  CDS (1)..(1320): transl_table=11
atgcggcactgtaactcactgatagagaagatagatatgaaaaggcaattctcagtggctgccagtgttgtggccagttgtgtaccatcattatctcaggctgcggaaggcgttgttgataaagcggataatgcttttatgatgatttgtacagtgcttgttctgtttatgaccattccgggaattgctctgttttatggtggattgctacggagtaaaaacgttttatcgctaatggctcaggtcatggtgagctttgctttagtatgtgtgttgtgggtgatttatggttatagcctggcttttgagccagggaatggttttttcggtggttttagtcaagtgatgctaaagaatttggcattcactgacttaagtggcaatttttatcagctaattcatgtggcatttcagggctctttcgcttgtatcactgttgctttgattattggcgcgttaggggagcgtattcgctttccggctttgttagtttttactgtgttgtggctgacattttcttacttgcctatggcgcacatggtttgggggggaggtgtgctttcacaagatggagcattggattttgctggtggtacggttgttcatattaatgctgctgtagctggattggttggtgcttacttactgggaaaacgtactggctttgggaaagaagcatttaaaccgcataacttgccgatggtcttcacgggcactactgtgctctatattggttggtttggttttaatgctggttctgctagtgctgctaatgagatagctgctttggcatttttaaataccattgtggcgactgccgccgctatcctgtcatgggtttttgcagagtggcttttccgtaataaaccgtctcttttaggggcatgttcaggctgtattgctgggctggttggtattacacctgcggcaggaatggttggtgttggtggtgcattaatcattggcctgattgcgggttttaccggactttggggggtggtggccttaaaacggtggttacgtgttgacgatgtgtgtgatgtattcggcatacacggcgtatgtgggatcgtaggttgccttctaacaggggtttttacggctaaatctttgggagggatcggttatgcagagggtataaccatgttgggacaagttggtattcaggcttttagtatactggtttgtgtgatttggtcagtcgttgttgcctttattgcttttaaaatagcagatctgttggtagggctgcgggttacggttgaaattgaaagggaagggttggacattaattctcacggagagagtgcttataattaa

SEQ ID NO: 1739 - protein, 439 aa, Photorhabdus luminescens subsp. laumondii TTO1
MRHCNSLIEKIDMKRQFSVAASVVASCVPSLSQAAEGVVDKADNAFMMICTVLVLFMTIPGIALFYGGLLRSKNVLSLMAQVMVSFALVCVLWVIYGYSLAFEPGNGFFGGFSQVMLKNLAFTDLSGNFYQLIHVAFQGSFACITVALIIGALGERIRFPALLVFTVLWLTFSYLPMAHMVWGGGVLSQDGALDFAGGTVVHINAAVAGLVGAYLLGKRTGFGKEAFKPHNLPMVFTGTTVLYIGWFGFNAGSASAANEIAALAFLNTIVATAAAILSWVFAEWLFRNKPSLLGACSGCIAGLVGITPAAGMVGVGGALIIGLIAGFTGLWGVVALKRWLRVDDVCDVFGIHGVCGIVGCLLTGVFTAKSLGGIGYAEGITMLGQVGIQAFSILVCVIWSVVVAFIAFKIADLLVGLRVTVEIEREGLDINSHGESAYN

SEQ ID NO: 1740 - DNA, 1332 bp, Rhodopseudomonas palustris CGA009
  CDS (1)..(1332): transl_table=11
atgaccttgttgctacgccgcgcggcgtcggccgcgacgggctacatacttgcaacattcggccttgcggcagtcggcgtcacgccggcgctggcgcaggggatggccacggcggcgccgggcatcagcccggccgacaccgcctggatgacggtcgccaccgccttcgtgctgatgatgacgatccccggcctggcgctgttctactccggcatggtgcgcaagaagaacgtgctggccacgatggcgcagagcctcgcggctgtggcgctgatctcgatcctgtgggtggcattcggctactcgctggccttcaccggcagcggcagcctgatcggctcgttcgaccggatcttcctggccggcatgaccatggacagcgtcaatccggcggccaagaccatcccggaagcgctgttcatgctctatcagatgactttcgcggtcatcacggtggccctggtggccggctcggtcgccgaccggatgcggttttccgcctatctgttgttctcgatcggctggttcatcttcgtctatgtgccgctggcgcattggatctggggcggcggctttttgggcgcaatgggcgtgctggacttcgccggcggcctggtggtgcacctgtcggccggcaccgggggcttggtggcggcgatcgtgatcggccgccgccatggctacggcatggaaaacctgtcgccgttcgacctgtcgctggcggtgatcggcactggcctgttgtgggtcggctggttcggattcaatggcggctccgccctggcggcggattcccgtgcggtgttcgccatcacggcgacgcatctggcggcgtgctcgggcgcgctgacctggggcgcaatcgaatggatggcgcggcgcaagccgtcggtgctgggcatgatttccggtgccgtcgccggcctcggcaccatcacaccggcatcgggctatgtcgaaccctggcacggcgtggtgatcggcatcgtcgccggcctgatctgttactgggcctgcacttggctgaagcaccggctgcgctacgacgactcgctcgacgtgttcggcgtccacggcatcggcggcctgaccggcacgttcctggccggcattttcgccacagcctcgatcggtggcgtctcgggcgccctcgagggttcgtggatgcagccgctgacgcagctcgccggtattctagtcaccttcgtgtggtccgccgtggccacctatgtgttgctgaaggccgtcagcctgttcgtggcgctgcgcgtctcccgtgagcacgagatcgaaggcctggacatttcgcagcatggcgaggcgctgcagtaa

SEQ ID NO: 1741 - protein, 443 aa, Rhodopseudomonas palustris CGA009
MTLLLRRAASAATGYILATFGLAAVGVTPALAQGMATAAPGISPADTAWMTVATAFVLMMTIPGLALFYSGMVRKKNVLATMAQSLAAVALISILWVAFGYSLAFTGSGSLIGSFDRIFLAGMTMDSVNPAAKTIPEALFMLYQMTFAVITVALVAGSVADRMRFSAYLLFSIGWFIFVYVPLAHWIWGGGFLGAMGVLDFAGGLVVHLSAGTGGLVAAIVIGRRHGYGMENLSPFDLSLAVIGTGLLWVGWFGFNGGSALAADSRAVFAITATHLAACSGALTWGAIEWMARRKPSVLGMISGAVAGLGTITPASGYVEPWHGVVIGIVAGLICYWACTWLKHRLRYDDSLDVFGVHGIGGLTGTFLAGIFATASIGGVSGALEGSWMQPLTQLAGILVTFVWSAVATYVLLKAVSLFVALRVSREHEIEGLDISQHGEALQ

SEQ ID NO: 1742 - DNA, 1470 bp, Geobacter sulfurreducens PCA
  CDS (1)..(1470): transl_table=11
atgaagtggaaacgttcgatcatcacacttgccctggccgccgcagccttcatggctccggccgcagtcctcgccgaagaggccaaggcccccgccgtggcggcaacccaggcagccgtcacctccgcccaggctgctccggcggccgttgccccggctgaggccgcaccggcggctgccgaagcccccaaggtggccgaaccggtcctcaataccggcaataccgcctggatgctcgtctgcgcggccctggtccttctgatgcttcccggccttgccctcttttacggcggcatggtccggagcaaaaacgtcctctcaaccctgatgcattcctttgttgccatggggatcgtgggggtccagtgggccgtcatcggttactcgctggccttcggtcccgacatgggcggcatggggcttgtgggagacttcagccgggcgctgctcaacggaatgatcagcttcaaggacggcgcgccggtctacaccctctggcagaacgtgaccagtgaacccaacgccatccccgagtacgtctttgccatgttccagggaatgttcgccatgatcaccgtagccctcatctccggcgccatggccgagcgggttaagttctccgcctactgcgtctttgtgctcctttggaccaccctggtctacgatcccctggcccactgggtctggatggtggacggctggctcttcaagaagggtgccctggactttgccggcggcaccgttgttcacctctcctccggtatttccgccctggcgttcctcgtcttcctcggcaaacgtcacgggttcccccatgagcgtatggctccccataacctctccatgaccatgctcggcgtggggctcctctggttcggctggttcgggttcaacgcgggttcggcggtagtcggcgtgaacaacgttgatgcggccggcgggcttgcgggcctcgccttcgccaccaccaccatcgccccggcagccggcggcctggcctggatgatcgccgaatggatccacgcgggcaggccctcggcactcggcttcggttcaggcgtggtcgcaggactggtcggcattacgcccgcggccggctttgtccagccgggcgctgccatcatcatcggcctcggcgccggcgtgatctgctacctgggtgtgctcatgaaggcgaagctcaagtatgacgactccctggatgccttcggcgtgcacggcgtgggcggcacctttggcgccctcgtcaccggcgtcttcgccacggtgggggccacggggctcctctccggcaacgtgtcccagttcatcacccaggtgatcggggtggtgtcggccggtgcctatgccttcatcgtgaccctggtcatcgccttcatcctcgacaagaccatcggtctccgggtggagaaggaagacgagatcatgggcctcgaccagacccagcactccgagtcggcgtacaactag

SEQ ID NO: 1743 - protein, 489 aa, Geobacter sulfurreducens PCA
MKWKRSIITLALAAAAFMAPAAVLAEEAKAPAVAATQAAVTSAQAAPAAVAPAEAAPAAAEAPKVAEPVLNTGNTAWMLVCAALVLLMLPGLALFYGGMVRSKNVLSTLMHSFVAMGIVGVQWAVIGYSLAFGPDMGGMGLVGDFSRALLNGMISFKDGAPVYTLWQNVTSEPNAIPEYVFAMFQGMFAMITVALISGAMAERVKFSAYCVFVLLWTTLVYDPLAHWVWMVDGWLFKKGALDFAGGTVVHLSSGISALAFLVFLGKRHGFPHERMAPHNLSMTMLGVGLLWFGWFGFNAGSAVVGVNNVDAAGGLAGLAFATTTIAPAAGGLAWMIAEWIHAGRPSALGFGSGVVAGLVGITPAAGFVQPGAAIIIGLGAGVICYLGVLMKAKLKYDDSLDAFGVHGVGGTFGALVTGVFATVGATGLLSGNVSQFITQVIGVVSAGAYAFIVTLVIAFILDKTIGLRVEKEDEIMGLDQTQHSESAYN

SEQ ID NO: 1744 - DNA, 1440 bp, Mycobacterium avium subsp. paratuberculosis K-10
  CDS (1)..(1440): transl_table=11
ttgcgagtgacatacccgatactgggccagcccaataccggcgataccgcctggatgctggccagttccgcgctggtgctgttgatgacgccgggtctggcgtttttctacggcgggatggtgcgcgccagaagcgtgctgaacatgctcatgatgagcatcagcgcgatgggcgtggtcaccgtgctgtgggtgctttacggctattcggtcgccttcggcgacgacgtcggcaacttcatgggcaagccgacgtcctactggggcctcaagggtctcatcggcgtcaacgcggtggccgccgacccgagcaaaggcactgcggcaacggacattccgctggccggcacgctgccggccaccgtgttcgtggccttccagctgatgttcgcgatcatcaccgtcgccctgatctccggcgcggtgtccgaccggctgaagttcgccgcctggctggtgttcgccggcctgtgggcgacgttcgtctatttcccggtggcgcactgggtgttcgcgttcgacggcttcgcctccgagcacggcggctggatcgccaacaagctgcacgcgatcgacttcgccggcgggacggcggtgcacatcaattccggtgtggcgggcctgatgctggcgatcgtgctgggcaagcgccgcggctggcccaccacgttgttccggccgcacaacctgccgttcgtgatgctgggcgccgggctgctgtggttcggctggtacgggttcaacgccggatcggccaccagctccaacggcgcggcggggtcgacgttcatgacgacgacgatcgcgaccgccaccgcgatgctggcctggatgctcaccgaacgcatccgcgacggcaaggccaccacgttgggcgcggcgtccgggatcgtcgccgggctggtcgccatcaccccgtcctgctcgtcggtcaacgtgctgggcgcgctggtggtgggcctggtggccggcgtggtgtgcgcgctggcggtcggcctgaaattcaagctgggctttgacgactcgctcgacgtggtcggggtgcacctggtcggcgggttggccggcaccctgctggtgggcctgctggccgccccggagagcccggccatcagcggcgttaccggcgtgtccaagggactgttctacggcggcggctgggcgcagctggaacggcaggcggtcggcgcgttcagcgtcctcatctactctggggtggttacgctgatcctggcgttgatcctgaagtacacgatggggcttcgtctcaacccggaggccgaagcctcgggtatcgacgaggctgagcacgccgagagtggttacgatttcgccgtggctaccggctcggttctcccgccccgggtcgctgtggcggatacccgcaacggcctggaggagcagcgagtgggcgacaaagtggaggcagagcagtcatga

SEQ ID NO: 1745 - protein, 479 aa, Mycobacterium avium subsp. paratuberculosis K-10
MRVTYPILGQPNTGDTAWMLASSALVLLMTPGLAFFYGGMVRARSVLNMLMMSISAMGVVTVLWVLYGYSVAFGDDVGNFMGKPTSYWGLKGLIGVNAVAADPSKGTAATDIPLAGTLPATVFVAFQLMFAIITVALISGAVSDRLKFAAWLVFAGLWATFVYFPVAHWVFAFDGFASEHGGWIANKLHAIDFAGGTAVHINSGVAGLMLAIVLGKRRGWPTTLFRPHNLPFVMLGAGLLWFGWYGFNAGSATSSNGAAGSTFMTTTIATATAMLAWMLTERIRDGKATTLGAASGIVAGLVAITPSCSSVNVLGALVVGLVAGVVCALAVGLKFKLGFDDSLDVVGVHLVGGLAGTLLVGLLAAPESPAISGVTGVSKGLFYGGGWAQLERQAVGAFSVLIYSGVVTLILALILKYTMGLRLNPEAEASGIDEAEHAESGYDFAVATGSVLPPRVAVADTRNGLEEQRVGDKVEAEQS

SEQ ID NO: 1746 - DNA, 1236 bp, Bacillus cereus ATCC 10987
  CDS (1)..(1236): transl_table=11
atgaatacaggagatacggtttttatgtttgtagcgacagtaatggtcatgttaatgacaccaggattagcacttttttatggaggtatggttcgcagtaaaaacgtactcagtacgacaatgcatagttatagcgcaatggctatcgtttcgattcaatggattgtaattggttattctttatcattcggacccgattggcacggacttatcggcacattcaattggttcggtttaaacggagttacctacgcaccaaatccagactactcatctactattcctcacaatttatttatgatgtttcaactcatgtttgctattctaacccccgctctaatttcaggagcatttgccgaaagaatgcgattttcagctttccttattttcatccttctatggacaacaatcgtttacaatcctgtcgctcattgggtatggggcgttggcggatggctaagagaacttggcgcattagacttcgctggcggtaatgtcgttcatattacatctggcgtggctggcctcgtattagctattttccttggaaaacgaaaaaacataaacggttcgtctcctcatcatttaccatttacgatgttaggcgctgggctgctatggttcggctggttcggttttaacgtcggaagcgcattatctttaaatgatgtagctttaactgcatttattaatacaaatatagctgccgctgcctccgcattaacttggatgctttcagagtggttcttccaatcaaaaccgaccgcgatgggagctgcttgtggcgccgtttccggtctagtcgctattacaccagcttgcgggttcgttacacctttctcagctcttcttatcggagcaattggcggcgtattatgcttcggagcggtctttttcttaaaaacaaaattcggatacgacgatacactcgatgcatttggatgtcacggcatcggcggaacttggggcggcattgcgacaggactatttgcaactactaccgtaaacagcgatggcgctaacggattattttacggaaacgccgcgttgctgtttaaacaacttgtagcaatcggcgcaacatatgcgttcacaattataatgacgtacgcgattattaaagcaattaacttcttcctccctgtccgggtagatgagcacgaggaacatatgggacttgatatttcaatgcatggggagaaagcttatgagtatgtagaaaaatcggctaattaa

SEQ ID NO: 1747 - protein, 411 aa, Bacillus cereus ATCC 10987
MNTGDTVFMFVATVMVMLMTPGLALFYGGMVRSKNVLSTTMHSYSAMAIVSIQWIVIGYSLSFGPDWHGLIGTFNWFGLNGVTYAPNPDYSSTIPHNLFMMFQLMFAILTPALISGAFAERMRFSAFLIFILLWTTIVYNPVAHWVWGVGGWLRELGALDFAGGNVVHITSGVAGLVLAIFLGKRKNINGSSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTTVNSDGANGLFYGNAALLFKQLVAIGATYAFTIIMTYAIIKAINFFLPVRVDEHEEHMGLDISMHGEKAYEYVEKSAN

SEQ ID NO: 1748 - DNA, 1458 bp, Magnaporthe grisea 70-15
  CDS (1)..(1458)
atgtcttcctctccggtcgaatacaacggcaccctgccgacgggtggtgactcgttgactgaggatctcaacatttactactcgagcggcgactttgcttggataatgacctcgtccgccctcgtcctgctcatgatcccaggtgtcggcttcttctactctgggctggcccgcagaaagtcagcccttgccttgatatggctgtcgctcatgtcgataggagtggcgagcttccagtggttcttctggggctactctctcgccttttcgcacacgggggagagcgggttcatcggcgacttggccaacattggtctgaaggacgtgctcgggcagccttcagtcggtagcagcaagctcccggatctgctgttttgcctctaccagggcatgtttgccgccatcactcctgccctcgccatcggagctgcagctgatcgtggccgaatgctaccggccatggtcttcgtctttgtctgggccaccatcgtttacgacccgatcgcatactggacctggaacccgaacggttggtccttcaagctcggcggcctcgacttcgccggaggaacgcccgtgcacatttcttcgggcgcggcggcgctcgcgtactcgctgatgctgggcaagcgcgccggctacgattcgaacgccggcatgccgttcaggccacacaacgtcacccacgtcgtgctcggcaccgtcatgctctacgttggttggttcggcttcaacggcggctcggcactggccgccaacctccgagccgtcatggctctgctggtgaccaacatctcggccgccgtcggtggactgacttggtgcttcctcgactaccgcctggagaagaagtggagcaccatcggcttctgctccggcgtcatcgcgggactggtggctatcacgcccgctgctggctacgtacctgcgtggtcggccgtcatctttggcgttgttggaggtgccgcttgcaactttgcgaccaagatcaagttcctgctgggcattgacgaggcgctcgacatctttgccgagcactgcgttggtggaatcgtgggcaaccttttgacgggtatctttgctgccgactacattgcacacctcgacggtgcgaccgagatccccggcggctggctcaaccaaaactacatccagctcgcgtaccagcttgccgactgcgtggccggcttctcctactcgttcgtcatgacgtgcatcatcctcttcctcatgaacctgatccccggcctgtcgctccgtgtgtcggccgccgaggagaacatgggcttggacgacgcccagattggagaatttgcctacgactacgtggagctgacccggcactttgaggatgcggcggtgacgacgccggccgtgggaagcagccagggcagcatcaaggagccgaggaccaaggagacccaggaggtcagcaagaccgagacgactgttgtataa

SEQ ID NO: 1749 - protein, 485 aa, Magnaporthe grisea 70-15
MSSSPVEYNGTLPTGGDSLTEDLNIYYSSGDFAWIMTSSALVLLMIPGVGFFYSGLARRKSALALIWLSLMSIGVASFQWFFWGYSLAFSHTGESGFIGDLANIGLKDVLGQPSVGSSKLPDLLFCLYQGMFAAITPALAIGAAADRGRMLPAMVFVFVWATIVYDPIAYWTWNPNGWSFKLGGLDFAGGTPVHISSGAAALAYSLMLGKRAGYDSNAGMPFRPHNVTHVVLGTVMLYVGWFGFNGGSALAANLRAVMALLVTNISAAVGGLTWCFLDYRLEKKWSTIGFCSGVIAGLVAITPAAGYVPAWSAVIFGVVGGAACNFATKIKFLLGIDEALDIFAEHCVGGIVGNLLTGIFAADYIAHLDGATEIPGGWLNQNYIQLAYQLADCVAGFSYSFVMTCIILFLMNLIPGLSLRVSAAEENMGLDDAQIGEFAYDYVELTRHFEDAAVTTPAVGSSQGSIKEPRTKETQEVSKTETTVV

SEQ ID NO: 1750 - DNA, 1554 bp, Magnaporthe grisea 70-15
  CDS (1)..(1554)
atggtcaagatacatgagatcgagctcgatgatttctacgccatcaagcggccgtacaatggctcggccgagactgggggagatgctctggtgcaggacttgaacgtgtggtataatacgggcgatattgcctttgtcatcacaagcacagccttgatgttgctcatgataccggggatcggtttgttctactcaggcctcgcacgacgcaagtcggccctctcgctgatgttcctctccatcctggcgctggccgtgacgacggtgcagtggttcgtgtggggctactcgctgtccttctcgcggacggccaacgccttcatcggcgacctgagcaacgccggtttccaaagcgtcctggcgcgtccctccatcgggggcgacagcatcccggacctcctcttcgccgtgtacgagggcatgctgtcggcgctgacggtaacgctggccgtcggcgccgcggcagagaggggaagggtgctgccggccatcgccttcatgttcgtctgggcgacgctcgtctacgaccccatcgcctgctggacgtggaaccccgccggttggtcgttccggatgggcgggctcgactacgccggcggaacgcccgtgcacatcgcctcgggcgcggcggcgttggcgtactcgatgatgctaggtccgaggcggggccatggcacgcacgagctgaatttcaggccacataatgtcgctcacatcgtcatcgggacggtgtttttgtggttcgggtggtttgggttcaatgccgggtcgacgctcgcggcgaacctccgcgccgttctggctgttgtcgtgacgcacctggcggcgtgcgtcggggggcttacctggtgtcttatggactatcgggtggagcggaagtggtctgccgtaggattctgctccggggtggtcgcggggttggtggccatcactcctgggtcgggagcatcaagcgccaacctcgccacccggctcaagttcaccctcggcatcgacgacgcgctcgacatattcgccgtgcacggagtggccgggttcatgggcaacatctgcacggcgctcttcgccctcaaccaggtggtcgcgctagacgggccctcggccggcagctcccgtgacggcatcgcgggcggctggctcaacggccactggatccagatcgcataccagctggcgggctcctttgcgggtctggcctactccttcatcgtgagctgcgccatcctggccgccctggaccgcatcccgggctgccgcctgcgcgcgactgacgaggccgaggtcgccggcatggacgcggccgagatgggcgagtttgcctacaactatgtggcgctgacccgcgagctgttgcgggtgccgggcgaggagaatggtggaagcgacgggacagccgtctgtgatcctttctcacggccgtcggccatggcagcgagacatagccagtggttctcgggccggcgggagctgcttcaggccgacgatggcgggtaccatgtgaagccggcgagggcaaggcttggttccgagggcaccatcattagtcggtgttga

SEQ ID NO: 1751 - protein, 517 aa, Magnaporthe grisea 70-15
MVKIHEIELDDFYAIKRPYNGSAETGGDALVQDLNVWYNTGDIAFVITSTALMLLMIPGIGLFYSGLARRKSALSLMFLSILALAVTTVQWFVWGYSLSFSRTANAFIGDLSNAGFQSVLARPSIGGDSIPDLLFAVYEGMLSALTVTLAVGAAAERGRVLPAIAFMFVWATLVYDPIACWTWNPAGWSFRMGGLDYAGGTPVHIASGAAALAYSMMLGPRRGHGTHELNFRPHNVAHIVIGTVFLWFGWFGFNAGSTLAANLRAVLAVVVTHLAACVGGLTWCLMDYRVERKWSAVGFCSGVVAGLVAITPGSGASSANLATRLKFTLGIDDALDIFAVHGVAGFMGNICTALFALNQVVALDGPSAGSSRDGIAGGWLNGHWIQIAYQLAGSFAGLAYSFIVSCAILAALDRIPGCRLRATDEAEVAGMDAAEMGEFAYNYVALTRELLRVPGEENGGSDGTAVCDPFSRPSAMAARHSQWFSGRRELLQADDGGYHVKPARARLGSEGTIISRC

SEQ ID NO: 1752 - DNA, 1563 bp, Magnaporthe grisea 70-15
  CDS (1)..(1563)
atgtcgtactcgtggataggggccccggccgaatttaacggcaccaatgccgagacaggtggtaactccgccaccgaaaatctgaaccaatggtaccaatccggagaccaggccttcatcctggtctcctcgtgtttggtcctcatcatgatacccgggatcgccttcctctactcgggtttggccaggaggaagtctgctctgtctttgatatgggtggtcatgatgtcctttagcgtggtcattttccagtggtacttttggggttattccctggccttcagcacctcgacgacaaacggtttcatcggcgacctcagcaaattcggcctcatgaacaccctcggaaagccctcgcaagggtcgccgcttatccccgagctactctactcgttctaccagatgcagttctgcggtgtcaccgcagccctggtgatcggagccacggctgagcgcggtcgtgtcgtccccgccatggtcttcactttcttttgggccaccattgtctactgccctctggcccattgggtttggaatgccaatggctgggccttcaagtacggcgtgctcgactacgccggtggtggccccgtcgagatcggttccggaatgtctgcgctggcctactcgtgggtcctcggacgccgcaatgagaagatgatgctgaacttccgcccgcacaacatctcgctcatcactctcggaactatcctcctttggttcggctggttgggattcaacggcggctccgcatttggagctaaccttcgcgccgctatggcctgctggaacacttgtttgaccgccatgtttgcagccatgacctggacccttctcgacttccgtctggccaagaaatggtcacttgtcggttggtgttcgggaaccatttcgggactcgttgcagcgacaccagcttccggcttcattcctccgtgggctagtattgtgctgggtgttgtgactggtgtctgctgcaactttggcacaaaggtcaaattcctcctccgcatcgacgactccctcgacgtgttcgccgagcattacatcggtggcgttgtcggcctcttcttcaacggcttcttcgcggccgactacatcattggtctcgacggtgtcaacaccggcctcgtcacgggtggtttcctgaaccagaactacaagcagctctacatccagattgcattcatcgtcgccgcctcggcctactcgtttgtcgtctctgcgatcctggccaagatcatcgacatgattcctggtctcaagctccgtgccgacgagaaggccgaactgctcggcatggatgacgatcagcacggagagttcgcctacgactacgtcgaggtccgccgggactaccttgcctggactcctgcggagagggaccccaaggaggatggacatgccgtcgtgccacaactggggatcgaggggcaccagaccattcacgacaacatcatcaatggtgttgggagtgtgaggcacacaccggcagttcccaacgatgctcatgcacagcacgactcggaaaagcccaagtcagttgaccgttcctctgaataa

SEQ ID NO: 1753 - protein, 520 aa, Magnaporthe grisea 70-15
MSYSWIGAPAEFNGTNAETGGNSATENLNQWYQSGDQAFILVSSCLVLIMIPGIAFLYSGLARRKSALSLIWVVMMSFSVVIFQWYFWGYSLAFSTSTTNGFIGDLSKFGLMNTLGKPSQGSPLIPELLYSFYQMQFCGVTAALVIGATAERGRVVPAMVFTFFWATIVYCPLAHWVWNANGWAFKYGVLDYAGGGPVEIGSGMSALAYSWVLGRRNEKMMLNFRPHNISLITLGTILLWFGWLGFNGGSAFGANLRAAMACWNTCLTAMFAAMTWTLLDFRLAKKWSLVGWCSGTISGLVAATPASGFIPPWASIVLGVVTGVCCNFGTKVKFLLRIDDSLDVFAEHYIGGVVGLFFNGFFAADYIIGLDGVNTGLVTGGFLNQNYKQLYIQIAFIVAASAYSFVVSAILAKIIDMIPGLKLRADEKAELLGMDDDQHGEFAYDYVEVRRDYLAWTPAERDPKEDGHAVVPQLGIEGHQTIHDNIINGVGSVRHTPAVPNDAHAQHDSEKPKSVDRSSE

SEQ ID NO: 1754 - DNA, 1542 bp, Gibberella zeae PH-1
  CDS (1)..(1542)
atgtcttacgttgtccccggacccccaacgcctttcaatggcaccaacgaggagctcggtggtgattccaccaccgaaaacctcaaccaatggtaccaatctggtgaccaggccttcatcctcgtctcggcctgtctcgtccttctcatggttcccggtatcgcctttctctactccggtcttgctcgaagaaagtctgctctctccatgctctgggtcgtcatgatgtccttttccgttatcgtcttccagtggtatttctggggtttctcactcgccttttccacaacttccaacaaccctttcatcggcgatcttaagcacttcggtctcaggcacgtttggggtgccccctcggtcggatcagctctcatcccagctcttctatactctttctaccagatgatgttctgcgccgtcactgctgctcttaccatcggtgctgttgctgagcgaggccgtgttattcctagcatggttttcatcttcttctgggccactctcgtttactgccctctcgcctactgggtctggaaccccagtggttggggtttcgtcaacggcgttctcgactatgccggtggtgttcccgtcgagattggctctggtatgtccgctctcgcctactcttgggttctcggccgccgtaacgagaagatgatgatgaacttccgccctcacaacatttcgctcatcaccctcggtaccatcttcctctggtttggctggcttggcttcaacggtggttctgccttcggcgccaacctccgtgctgttatggcttgctggaactcttgcctcactgccatgttcgctgccatgacctggtgtattctcgatttccgtctggcccgcaagtggtccatggtcggttggtgctctggtactatctctggtcttgttgctgccactcctgcttctggttttatcgacccctgggccagtattattctcggtgttgttgctggtgtcgcctgtaactttgccaccaaggtcaagttcctcatccgaattgatgactctctcgatgtcttcgctgagcacggtgttggcggtatcgttggtctcattttcaacgctttcttcgctcgcggttctatcatcggactcgacggcgtcaacactggtgccacaggtggattcatggacggcaactacgttatcattggctggcaaatcgctgccattgttggtgcttcttcttacgcctttgttatgtccgccatcattgccaagatcattgacctcatccctggtcttaagcttcgtgcttctgaggaggccgaactccttggtatggacgatgaccagcatggcgagttctcctacgattacgtcgaggttcgccgagacttccttgcctggagccctcagcgtggcgagcctgctgaggatggtgatgtccttgagcccactcatggtattcatgagcatcagtccatgatgaaccccagcgagtcagacgacgcccgcaagactccttctctcaacacacctgatgttatcgcgccagacgccgtcatcaacgagaagcatgcttaa

SEQ ID NO: 1755 - protein, 513 aa, Gibberella zeae PH-1
MSYVVPGPPTPFNGTNEELGGDSTTENLNQWYQSGDQAFILVSACLVLLMVPGIAFLYSGLARRKSALSMLWVVMMSFSVIVFQWYFWGFSLAFSTTSNNPFIGDLKHFGLRHVWGAPSVGSALIPALLYSFYQMMFCAVTAALTIGAVAERGRVIPSMVFIFFWATLVYCPLAYWVWNPSGWGFVNGVLDYAGGVPVEIGSGMSALAYSWVLGRRNEKMMMNFRPHNISLITLGTIFLWFGWLGFNGGSAFGANLRAVMACWNSCLTAMFAAMTWCILDFRLARKWSMVGWCSGTISGLVAATPASGFIDPWASIILGVVAGVACNFATKVKFLIRIDDSLDVFAEHGVGGIVGLIFNAFFARGSIIGLDGVNTGATGGFMDGNYVIIGWQIAAIVGASSYAFVMSAIIAKIIDLIPGLKLRASEEAELLGMDDDQHGEFSYDYVEVRRDFLAWSPQRGEPAEDGDVLEPTHGIHEHQSMMNPSESDDARKTPSLNTPDVIAPDAVINEKHA

SEQ ID NO: 1756 - DNA, 1401 bp, Gibberella zeae PH-1
  CDS (1)..(1401)
atggcgactccttacaatggcaccagcgaccatgccgacgatggctactcgtctggcgtctccgacctcaacatcttctatgagacgggccacttggtcttcctggtcaccagcgccgtgctcgttcttctcatgattcccggcgtgggtttcttctacagtggtctcgctcgtcgcaagtcggccctgactttgatcctcttgtcaatggtctctgtcgctgtcattagtttccagtggttcttctggggttattccttgaccttttcacgaactggaaatgccttctttggcgatctcacccagttcggtctcatggagacacttgcccagcccaacggctcctctgctcttcctgatattctcttctgtctttaccagggcatgtttgctgctattacacctgctcttgccattggtgccgtggcagacagaggtcgcatcctcccagccatcgtcttcatgttcctctggtccaccattgtctacgaccctatcgcatactggacctggaacgctaacggctggctcttcaaccttcccagctacgactttgctggaggcggtcccgttcacgtcgcttcaggaacatgcgcccttgcttactccctcatgctcggcaagcgcaccggctacaaccgcaacaatggccttccctaccgtcctcacaacgtcacccatgtcgttctcggcacggttttcctctgggtcggttggtttggattcaacggcggttcagctcttgctatgaacatccgcgccatcatggcatgctacgtgaccaacctggctgcctcatgcggtgctatcgcctggattctacttgattatcgccttgaaaagaagtggagcacaattggtttctgctccggtgccatctctggtcttgtcgctattactcccgctgctggcttcgtcaagccttgggctgccgttattatcggaatttgcggtggtgttgtatgcaactttgccaccaagctcaagttcgtcatgaacattgacgacagtcttgatatctttgctatccatggagttggcggtatggctggcaacatcctcactggtatctttggaactaaatccatcgctgctcttgacggtggagagtacgaccccatcggctgggttgatagccactgggtccagttaggctaccagattgctggtactctagcttgcttcgcttggtcatttgtactgacctgccttctgctcttcattctcaacctcatccctggtctgtccctgcgtgtagctcccgaggaggaagagcttggtacagatgatggacagttgggcgaatttgcgtatgactatgttgagatgacccgccacatggctgatagcacacatcccaactctgatgcaagtgcgcgaaccagtcacgagaaggtctag

SEQ ID NO: 1757 - protein, 466 aa, Gibberella zeae PH-1
MATPYNGTSDHADDGYSSGVSDLNIFYETGHLVFLVTSAVLVLLMIPGVGFFYSGLARRKSALTLILLSMVSVAVISFQWFFWGYSLTFSRTGNAFFGDLTQFGLMETLAQPNGSSALPDILFCLYQGMFAAITPALAIGAVADRGRILPAIVFMFLWSTIVYDPIAYWTWNANGWLFNLPSYDFAGGGPVHVASGTCALAYSLMLGKRTGYNRNNGLPYRPHNVTHVVLGTVFLWVGWFGFNGGSALAMNIRAIMACYVTNLAASCGAIAWILLDYRLEKKWSTIGFCSGAISGLVAITPAAGFVKPWAAVIIGICGGVVCNFATKLKFVMNIDDSLDIFAIHGVGGMAGNILTGIFGTKSIAALDGGEYDPIGWVDSHWVQLGYQIAGTLACFAWSFVLTCLLLFILNLIPGLSLRVAPEEEELGTDDGQLGEFAYDYVEMTRHMADSTHPNSDASARTSHEKV

SEQ ID NO: 1758 - DNA, 1449 bp, Gibberella zeae PH-1
  CDS (1)..(1449)
atggctagttctaagatcacaccggtcactgagtggccagactattctgtcgacccgaccggtggtgatcctttcaccaaggatttgaatgcaccatatgataaggcaatatgcacgatcctttgttggcagattacacccgccatcggcttcctgtatgcgggtatgcatcgccgaaaggctgccttgacaatggtcctgcagtctctcttctgcgcctgcgcggtcggtatccagtattggatctacggttattctctttaccaaagtcgtactacaaacccgatcctcggtgatctttcactggcggctttccgcaacgtccttgctcagccgtcgctcgcgaatggcgatatccctgagcttctctatgccgtctttggtgttactttcgtgacagcaactgccatgatcttggctggagctatgttggagagaggcagactttggcctagcatggtcttccttctctgctggacgacatttgtatactacatcctagcatactgggaatggaacccaagcggatggctctacaaactcggcctctacgatttcgccggctcaggacccgttcatatcgcgagtggctttggagcccttgcttggtcaatgatgctaggtcctcgaatccccgatgccactgttaccgaccgaaagaaagccgtgcattacaaacctcacaacccgttgcttatgtgcttcggcactgtgcttatctggtttggctggttcgcctttaacggcggtagcacagccaacctcagtcttcgatcgatctatgttgttgtcaatacgaacatgtcagcatgtgctggtggtttcggctgggttctcctaggatacctgcacacacgcaagtttagtcttgttggattctgctctggaatcatcgcgggacttgttgatatcacgccttgcgcaggttacacacccatctacgtggcaccagttattggtctggttactactgtcggctgcttctacactgtcaagtacaagtacctcctttcgatcgatgatggtctggatatctttgccatccatggaattggagggttcatcggcgatatcttgacaggtctcttcgcagccaagtttgtccccgccctggacggagtatctggagattcatatgctggaggatggtgggatggcaactacaagcagatgggactgcaattggctggtgctactacttgtgcggcctggtcctttgtcatctcctgcttgcttctcttcgtcattaacaagatccctgggctgcatcttagagccagtgaggagcatgagatccgaggtctcgatttcaagtacctcagcgatgttgaatgggaggaccactacatgaatggcggcattaccccctttatggaaggtacaccagtcagggctgtaacacctcaggaagtcgttgaaccgaagaatgaagagaggaagatggattag

SEQ ID NO: 1759 - protein, 482 aa, Gibberella zeae PH-1
MASSKITPVTEWPDYSVDPTGGDPFTKDLNAPYDKAICTILCWQITPAIGFLYAGMHRRKAALTMVLQSLFCACAVGIQYWIYGYSLYQSRTTNPILGDLSLAAFRNVLAQPSLANGDIPELLYAVFGVTFVTATAMILAGAMLERGRLWPSMVFLLCWTTFVYYILAYWEWNPSGWLYKLGLYDFAGSGPVHIASGFGALAWSMMLGPRIPDATVTDRKKAVHYKPHNPLLMCFGTVLIWFGWFAFNGGSTANLSLRSIYVVVNTNMSACAGGFGWVLLGYLHTRKFSLVGFCSGIIAGLVDITPCAGYTPIYVAPVIGLVTTVGCFYTVKYKYLLSIDDGLDIFAIHGIGGFIGDILTGLFAAKFVPALDGVSGDSYAGGWWDGNYKQMGLQLAGATTCAAWSFVISCLLLFVINKIPGLHLRASEEHEIRGLDFKYLSDVEWEDHYMNGGITPFMEGTPVRAVTPQEVVEPKNEERKMD

SEQ ID NO: 1760 - DNA, 1359 bp, Candida glabrata CBS 138
  CDS (1)..(1359)
atgctagctcgccgaggagtgcaatatgtgtgggattcaggaatagccgtctcatcgacggcgttcctggtggttgcaagtgcactggtgttctttatggttcctggtatagggtttctttactcaggacttgctcgtcggaaatcagcgctttcgttgctatgggtaacgcttatggcgtcattggttggtatgctgcaatggtacttttggggttactcactggcgttatccagaacagccacgaacaataaatttatagggaacttggattcctttggatttcgaaacgtatatgggttgaatgcagtgtggactgagaatttggaagttgcatatgcttcttttcagatgatgtttttatgtgtgactctttcactggtagcaggttctactgctggaagaggcagatttttcccacatatggtgtatttatttctgtttgccactctagtgtactgtcctattgtatactggatatgggctcctggtggatgggctaataaatggggtgtgttagattgggctggtggagggccagttgaaatagtgagtgccattagtggattcgtctattcttatttcctcggttgcagaaatgagaggtttctggttaactttagggctcataatgtttcgtacgttactcttgggacgactgtattatggttcggatggttgttattcaatgcagcttctgcgctttctcccaacttaagatcagtgtatgctttcctcaatacaaacattagtgctgttactggtggtatgacatggtgtattttagattacagactagaaaaaaaatggtctaccgtaggtctatgctcaggtatcatttgtggattagtcgctgccacaccaagctcagggtgtataactctttatgggtcattaattcaaggaattgtagctgggatatgttgtaattttgcaacaaagatcaaacattttttccaggttgatgatgccatggatttattagctgagcacggtgttgctggaatgattggtttactatttaatggattttttgctgcagactgggttattgggatggatggacacacaacacatggcggtggctggatcacccaaaactataaacaaatgtataagcagatagcatatattggagctgttaccggttattgcgctgctgtttcggcactactctgctttattattgacaaaataccaggtttacaattaagagtatcagccgatggtgaagagaaaggtacggatgatgatcagattggagaatttgcctacgattttgttgaaattcgaagagagtttgatatatggggcaaggaggaagatgaagatgaaaatgagcaatccactgatgaatga

SEQ ID NO: 1761 - protein, 452 aa, Candida glabrata CBS 138
MLARRGVQYVWDSGIAVSSTAFLVVASALVFFMVPGIGFLYSGLARRKSALSLLWVTLMASLVGMLQWYFWGYSLALSRTATNNKFIGNLDSFGFRNVYGLNAVWTENLEVAYASFQMMFLCVTLSLVAGSTAGRGRFFPHMVYLFLFATLVYCPIVYWIWAPGGWANKWGVLDWAGGGPVEIVSAISGFVYSYFLGCRNERFLVNFRAHNVSYVTLGTTVLWFGWLLFNAASALSPNLRSVYAFLNTNISAVTGGMTWCILDYRLEKKWSTVGLCSGIICGLVAATPSSGCITLYGSLIQGIVAGICCNFATKIKHFFQVDDAMDLLAEHGVAGMIGLLFNGFFAADWVIGMDGHTTHGGGWITQNYKQMYKQIAYIGAVTGYCAAVSALLCFIIDKIPGLQLRVSADGEEKGTDDDQIGEFAYDFVEIRREFDIWGKEEDEDENEQSTDE

SEQ ID NO: 1762 - DNA, 1437 bp, Candida glabrata CBS 138
  CDS (1)..(1437)
atggctagaggagatggatatgtatggacagagacatatgatcctgcgacagttgcttttatcatactaggtgccgcgctggtattctttatggttccaggtttaggatttttatactcaggactggcgagaagaaagtctgccttagcactgatatgggctgtactgatggcaacactggttggcatgctccaatggtatttttggggttattctcttgcattttcaaagacagctccaaacaacaaattcattggaaatttggattcttttggtttcagaaacgtctatgggaagacatcagaagattcaacgtacccggaaattgcatttgcatctttccagatgatgttcttatgtgtcacagtaagcattattgctggtgctaccgctgaaagaggtaaacttcttccacatatggtgtttctctttatttttgcaacactagtttattgtcctatcacgtactggatatgggctccaggtggatggtgttataaatggggtgttttggattgggctgggggtggcccagtcgaaattgttagtgctgttgctgggtttgtttattcatacttccttggaagacgtagagagaatttacttatcaacttcagaccacataatgtttccatggtcactttaggtacttcaattctatggtttggctggctgcttttcaatgcagcaacatctttgacacctaatttacgctctgcatacgcatttatgaatacaaacatcagtgctgttacaggtggtatgacatggtgtctactggattataggtcggagaaaaagtggtcgactgtgggtttatgttccgggatcatctgtggtctagttgctgcaacccccagttcaggttgtatcacattatatggatcattaatacaaggcattatttcaggcgtagtttgtaacttcgctactaagatcaagtactacttaaaggtcgatgatgctatggatctgttggcggagcacggtgttgctggtatagtaggcttgatatttaacgctttattcgcagcagactgggttattggaatggatggagctacaaagcatagaggtggctggatcacacacaactacagacaaatgtacaaacaaatcgcatatattggtgctgttgctggatatacagctgtagtgactgctttgatatgcatagtcatagacaatataccaggattaagacttagagcatctgaagaagctgaggctcttggtatggatgaagatcaaattggtgaatttgcatacgattatgtcgaagttagaagagattattacttatggggtgttgataacgacaacaatagtgcagataacaccgatggaaatgctgatgatcaatcagttacaggttcatcaacagcagccaccaatgaaggtcacgatatagaaaaggttccagctggaccacaatag

SEQ ID NO: 1763 - protein, 478 aa, Candida glabrata CBS 138
MARGDGYVWTETYDPATVAFIILGAALVFFMVPGLGFLYSGLARRKSALALIWAVLMATLVGMLQWYFWGYSLAFSKTAPNNKFIGNLDSFGFRNVYGKTSEDSTYPEIAFASFQMMFLCVTVSIIAGATAERGKLLPHMVFLFIFATLVYCPITYWIWAPGGWCYKWGVLDWAGGGPVEIVSAVAGFVYSYFLGRRRENLLINFRPHNVSMVTLGTSILWFGWLLFNAATSLTPNLRSAYAFMNTNISAVTGGMTWCLLDYRSEKKWSTVGLCSGIICGLVAATPSSGCITLYGSLIQGIISGVVCNFATKIKYYLKVDDAMDLLAEHGVAGIVGLIFNALFAADWVIGMDGATKHRGGWITHNYRQMYKQIAYIGAVAGYTAVVTALICIVIDNIPGLRLRASEEAEALGMDEDQIGEFAYDYVEVRRDYYLWGVDNDNNSADNTDGNADDQSVTGSSTAATNEGHDIEKVPAGPQ

SEQ ID NO: 1764 - DNA, 1515 bp, Candida glabrata CBS 138
  CDS (1)..(1515)
atgtcttacaactttacagggaccccaacgggtcatgggacaggtggtgactcacttaccaccgatttaaacacacaatttgacctagtcaatatgacgtggctaggtgtatgtacctcaggtgtctggcttatggtgcctggcataggtctgctgtactctggtctttccagaaagaaacacgccttatcacttctatgggcatcgctcatggccgcttgcttagtgatattccaatggttcttctggggttactcactatcattttcccatgaaactagaggaaacggattcttgggaactctagagttttttggttttagaaatgtccttggtgcaccatccgtcgtcacatcagtacctgatatcgtctttgccatcttccaaggaatgttcgctgctgtaactggtgctttaatgcttggtggtgcttgcgaaagagctcgtctaatgccaatgatgatcttcctatttctatggatgacaatcgtctactgccccattgcatgctggacatggaatgcggagggatggttagctaaactgggtgctctggactatgcaggctctggacctgttcacacggcctccggccatggtgctcttgtctacgcattaatcttgggtaagagaaacgatccagtcgccaagaaaggtatgccaaagtataagccacactcagtcacttctgttgtgctgggtaccgtcttcctatggtttggatggcaattctttaacccaggttctgctggtaatgcttccattagagcctggtactctgctatgaacacaaacctggctgccgcatctggtggtctaacttggttattcatcgactatttcagaactggcggaaaatggaccaccgttggtatgtgctctggtatcatttctggtttggtcggtattacacctggtgctggctttgttccaatttggtcttcatttatcatcggtgtgctttctgcagcaggctgtaacttagccgttgacttgaagaatgttctgcacatcgacgatggtcttgatgtgtatgcattgcatggtgttggtggttgtattggttccgtgctaaccggtatcttcgcagctgattatgttaacgcaacagcaggttcatacatcgccccaattgcaggaggatggttaaaccatcactggaaacaagtgggataccaattggctgctatttgtgcaacaattgcctggacagtcaccattactgcaattttgcttcttgccatggatcaaattccattcctgagactaagattaagaccagaagaagaggaacaaggtactgatgaagcggagattggcgagtttacataccaagaggaacaagaatatattcctgaaccagtccgttcaaggtctccaggtatgcaaccaaaaatgtcctccattgacgataaaattactggaccacaacaagtgattgattcaaagctttctgagtcagaatcaggatctaatgaggcaggctctaatatgggtgaaaagcaaacagtttaa

SEQ ID NO: 1765 - protein, 504 aa, Candida glabrata CBS 138
MSYNFTGTPTGHGTGGDSLTTDLNTQFDLVNMTWLGVCTSGVWLMVPGIGLLYSGLSRKKHALSLLWASLMAACLVIFQWFFWGYSLSFSHETRGNGFLGTLEFFGFRNVLGAPSVVTSVPDIVFAIFQGMFAAVTGALMLGGACERARLMPMMIFLFLWMTIVYCPIACWTWNAEGWLAKLGALDYAGSGPVHTASGHGALVYALILGKRNDPVAKKGMPKYKPHSVTSVVLGTVFLWFGWQFFNPGSAGNASIRAWYSAMNTNLAAASGGLTWLFIDYFRTGGKWTTVGMCSGIISGLVGITPGAGFVPIWSSFIIGVLSAAGCNLAVDLKNVLHIDDGLDVYALHGVGGCIGSVLTGIFAADYVNATAGSYIAPIAGGWLNHHWKQVGYQLAAICATIAWTVTITAILLLAMDQIPFLRLRLRPEEEEQGTDEAEIGEFTYQEEQEYIPEPVRSRSPGMQPKMSSIDDKITGPQQVIDSKLSESESGSNEAGSNMGEKQTV

SEQ ID NO: 1766 - DNA, 1362 bp, Kluyveromyces lactis NRRL Y-1140
  CDS (1)..(1362)
atgacttcagtgtggcatgagacttacgatggttcaacaattgcgtttatcttcatgggatgcgctttagtattcattatggtacccggtttgggtttcttatattcaggtttagcaagaaggaaatctgctctttcgttgatttgggcagttatcatggctactttggttggaatggtccaatggtatttctggggttactctttggccttttcaaagactgcgatcaatcacaaattcataggggatttgaactcgttcgggttcagaaacgtttatgggtatgcggatcccgaggatccaacgacgtacccggaattagcatgggcagctttccaaggtatgtttttatgtgtcactttgagtattattgccggtgccactgcagaaagaggtagactcttgcctcatatggttttcctattctgtttcgcaaccattgtgtactgtcccgttacattttgggtttggtgccctgatggatgggctgccagatggggagtgctagactgggccggtggtggtcctgttgagattttgagtgcggttggtgggttcgtttattctgcattcttgggtaagcgtcatgaaagccaattgatcaatttcagacctcataacgtctctatggttactttagggaccagtttattgtggtttggatggctcggtttcaatggttgtaccagtttggatccaaatatgaaatccgtgtttgcgctcttgaacacaaatctaagtgccgcatttggtggtatgacctggtgtctattggattatagactagagaagaaatggtctactgtgggtctttgctctggtatcatttgtggtctcgttgcagccacaccaagtgcaggttgtatcacactctatgcatcagttatccaggggatcacagctggtgtagtatgtaacttttccaccaagataaaatacgtgctaaaagtggacgatgcgatggatatcttggcagagcacggtatcgcaggagttgttgggctaatatttaatgcattttttgctgcagactggatcatcggttcagatggtgccactgaacatggtggtggatggctctctcacaattggaagcaaatgtacatgcaaatcgcttatatcgcggcagttaccggttacgctgctgtggttactgccatcatttgcttcgtgctaaataagattccaggcctgcaactcagagctgacgaagaggcagaagatagaggtatggatgaggaccaaatcggagaattcgcatacgattatgtcgaagtgagaagagattattattcatggggtgtacctaatgacaccgattcaggaaacgaaaaaatcactggtcctcaaacaccaatataa

SEQ ID NO: 1767 - protein, 453 aa, Kluyveromyces lactis NRRL Y-1140
MTSVWHETYDGSTIAFIFMGCALVFIMVPGLGFLYSGLARRKSALSLIWAVIMATLVGMVQWYFWGYSLAFSKTAINHKFIGDLNSFGFRNVYGYADPEDPTTYPELAWAAFQGMFLCVTLSIIAGATAERGRLLPHMVFLFCFATIVYCPVTFWVWCPDGWAARWGVLDWAGGGPVEILSAVGGFVYSAFLGKRHESQLINFRPHNVSMVTLGTSLLWFGWLGFNGCTSLDPNMKSVFALLNTNLSAAFGGMTWCLLDYRLEKKWSTVGLCSGIICGLVAATPSAGCITLYASVIQGITAGVVCNFSTKIKYVLKVDDAMDILAEHGIAGVVGLIFNAFFAADWIIGSDGATEHGGGWLSHNWKQMYMQIAYIAAVTGYAAVVTAIICFVLNKIPGLQLRADEEAEDRGMDEDQIGEFAYDYVEVRRDYYSWGVPNDTDSGNEKITGPQTPI

SEQ ID NO: 1768 - DNA, 1482 bp, Kluyveromyces lactis NRRL Y-1140
  CDS (1)..(1482)
atgtccgaatttacaggtattccaactgacaccggaaccggtggtaactctttggatacagatttgaacactccatatgacaaggctaacatggcctggattatggttgccggttcatttgtctggttaatggtcccaggtatcggtttgttgtactctggtctttcgagaaaaaagcacgctttgtctctattatgggcttccattatgactatttcggtggtcactttccaatggtattggtggggttacagtcttgtgttctcccataatacaagaggtaacggtttcatcggtactttatccgaatttggtttcaaaaacgttcttggtgctccttctgctgctggtactgttccagatatcttattcgcttggtttcaaggtatgttcgcaatggtcaccggtattttgatggtcggtggtgcctgtgaaagagctagattgttcccaatgatggtctttttgttcttgttcatcaccatcgtatactgtccaattgcttgttggacttggaacccagagggttggttggctacccttggtgctttagattacgcaggtggtggtccagtccacatttgctccggtcacggtgctttgatttacgctttgattttgggtagaagaaatgatccattgacgaagtctggtgttcctaagtacaagccacattccgttacctctgtcgtgttgggtactgtcttcacttggatcggttggattggtggtttcaacccgggttccgctggtaacgctaccattagagcttggtactctgcctattcaacaaacttggctgctgcttgcggtgctttgacctggatgttcatcgattacttcagatctggtcgtaaatggactactgttggtttgtgttctggtgccatttccggtttggtcggtattacccctgccgctggtttcgttccattatgggcttccgttatcatcggtatcgtcacagctgctggttgtaacttggctgtcgacctgaagaatttgttgaagatcgatgacggtttggacgtgtacgctttgcatggtgtcggtggctgtatcggttcagttttgactggtattttcgctgccgattacattaacgcattggccggcgttgaaagttccccaattgctggaggttggatcaaccacaactacaagcaagttggttatcaattagctgccgtgtgtgctactatcgcatggacctgtgtcgttaccgcatgtttgctattgatcttggacaggatcccattcctaagattgagattgagacctgaagaagaagaattgggtactgatgaagctgaaattggtgaattcacctacgaagaagacgctgtctacattccagaaccaatcagatccaaatccatcgctgaagctcctccagcaaacatcgatgacaagattcacacaggaaacaactcttcatcagaactacaatctgaaccaaaaactacttccgctaatgcctaa

SEQ ID NO: 1769 - protein, 493 aa, Kluyveromyces lactis NRRL Y-1140
MSEFTGIPTDTGTGGNSLDTDLNTPYDKANMAWIMVAGSFVWLMVPGIGLLYSGLSRKKHALSLLWASIMTISVVTFQWYWWGYSLVFSHNTRGNGFIGTLSEFGFKNVLGAPSAAGTVPDILFAWFQGMFAMVTGILMVGGACERARLFPMMVFLFLFITIVYCPIACWTWNPEGWLATLGALDYAGGGPVHICSGHGALIYALILGRRNDPLTKSGVPKYKPHSVTSVVLGTVFTWIGWIGGFNPGSAGNATIRAWYSAYSTNLAAACGALTWMFIDYFRSGRKWTTVGLCSGAISGLVGITPAAGFVPLWASVIIGIVTAAGCNLAVDLKNLLKIDDGLDVYALHGVGGCIGSVLTGIFAADYINALAGVESSPIAGGWINHNYKQVGYQLAAVCATIAWTCVVTACLLLILDRIPFLRLRLRPEEEELGTDEAEIGEFTYEEDAVYIPEPIRSKSIAEAPPANIDDKIHTGNNSSSELQSEPKTTSANA

SEQ ID NO: 1770 - DNA, 1470 bp, Kluyveromyces lactis NRRL Y-1140
  CDS (1)..(1470)
atgtccgaatttacaggtattccaactgacaccggtactggtggtaactctttggatacagatttgaacgctccatatgacaaggctgacatggtctggatttttattgctggttcatttgtctggttgatggtcccaggtatcggtttgttgtactctggtctttcgagaaaaaagcacgctttgtctctattgtgggcttccattatgaccattgccgtggtcactttccaatggtattggtggggttacagtcttgtgttctctaagacaagaggtaacggattcatcggtactttatctatgttcggtttcaaagatgttcttggtgctccttctgctgtcggcgttgttcctgatattgtattcgcttggttccaaggtatgttcgctattgccaccggtattttgatggtcggtggtgcctgtgaaagagctagattgttcccaatgatggtctttttgttcttgttcatcaccatcgtatactgtccaattgcttgttggacttggaacccagagggttggttggctgcccttggtgctttagattacgcaggtggtggtccagtccacatttgctccggtcatggtgctttgatgtacgctttgattttgggtaagagaaacgatccattgacaaaatctggtgttcctaagtacaagccacattccgttacctctgtcgtgctgggtactgtcttcacttggctaggttggattggtgccttcaacccaggctccgccggtaacactaccattagagcttggtactctgcttattcaactaacttggctggttcatgtggagctttgacctggatgttcatcgattactttagatgtggtcgtaaatggactactgttggtttgtgctccggtgcgattgcaggtttagttggtattactccggctgctggatttgttccattatgggcctcagttatcgttggtattgttaccgctgctggttgtaatttcgccgttgatttgaagcatatcttgagaatcgatgacggtttggacgtgtacgctttacatggtgtcggtggctgtatcggttcagttttgactggtattttcgctgccgattacattaacgcattggccggcgttgaaagttccccaattgctggaggttggatcaaccataactacaagcaagttggttaccaattagctgccatgtgtgcgagtgtcgcctggacctgtgtcgttaccgcatgtttgctattgatcttggacaggatcccattcctaagattgagattgagacctgaagaagaagaattgggtactgatgaagttgaaattggtgaattcacctacgaagaagatgctgtctacatcccagagccaatcagatccaaatccatcgctgaagctcccgcagcaatcattgacgacaaagtccaaacaggaaacagttcttcagaggaactccaatctgaaccaaaaactaatgcttaa

SEQ ID NO: 1771 - protein, 489 aa, Kluyveromyces lactis NRRL Y-1140
MSEFTGIPTDTGTGGNSLDTDLNAPYDKADMVWIFIAGSFVWLMVPGIGLLYSGLSRKKHALSLLWASIMTIAVVTFQWYWWGYSLVFSKTRGNGFIGTLSMFGFKDVLGAPSAVGVVPDIVFAWFQGMFAIATGILMVGGACERARLFPMMVFLFLFITIVYCPIACWTWNPEGWLAALGALDYAGGGPVHICSGHGALMYALILGKRNDPLTKSGVPKYKPHSVTSVVLGTVFTWLGWIGAFNPGSAGNTTIRAWYSAYSTNLAGSCGALTWMFIDYFRCGRKWTTVGLCSGAIAGLVGITPAAGFVPLWASVIVGIVTAAGCNFAVDLKHILRIDDGLDVYALHGVGGCIGSVLTGIFAADYINALAGVESSPIAGGWINHNYKQVGYQLAAMCASVAWTCVVTACLLLILDRIPFLRLRLRPEEEELGTDEVEIGEFTYEEDAVYIPEPIRSKSIAEAPAAIIDDKVQTGNSSSEELQSEPKTNA

SEQ ID NO: 1772 - DNA, 1545 bp, Debaryomyces hansenii CBS767
  CDS (1)..(1545)
atggcaaacgatggttttactgggacaggtcccggaggagatataatgaaggtggatttgaacgaacaatttgacaaagcggacatggtctgggtcggagtatcggctgcattggtgtggcttatggttccaggagtgggtttgctttattctggtttatccagaaagaagcatgcattgtcgttattatgggcctcgcttatggccacttgcttgactgcctttcagtggttcttttgggggtactcattagttttcacaaaaagtgactcggtgatcttgggtaacttggactatttctccttgaagaatgtgttcggggccccaagcgtggtctcaactgttccagacattttattttgtcttttccagggtatgtttgccgcagtgactgccattttaatggttggtgctgggtgtgagagagcaaggttaggaccaatgatggtcttcttattctgctggttaactgttgtttattgtccgatcgcatactggacttggggtggtaatggatggttattcaacttgggtgcattagattttgctggtggtggaccagttcacgaaaattctggttttgctgcgttggcttattcattggtattgggtaagagacacgatccattaacagctggtaaagttcctaaatataaaccacattcagttacttcagttgtgttaggaactgtgtttttatggttcgggtggtttggcttcaacggtggttctacagggaacgcatctatccgttcttggtatgcttgtgtcaacactaatattgctgctgcatgtggtggtttaacttggatgtttgtcgattggtttagaaccggtggaaaatggtccacagtaggtttatgtaccggtgccattgctggtttggtcggtattactccggctgccggatttgtcccagtttacacctcgatagtctttggtgtcgttccagctattgtttgtaactttgctgttgatttgaaatctatcttacagattgatgatggtatggatgtttttgctttgcatggtgttggtggtatctgtggttcaattttaaccggattttttgctgctgactacattgctgcttctgatggttctgttgcagcagatccttcagctgccatcgctggtggctggatgaatcataattataagcaattaggttaccaaattgcaggctcatgtgccgttggcctctggagtttcacgcttactggcatcttattattaataatggacagaattcctcagttgagaatcagattacatgccgatgaagaaattatgggcaccgatattgctgaaatcggtgaatttacatactacgatgatgaaatgggacaaggtaatacgttggctatgagcgataacttaccatatgttatagaaccaatcagatctaccgatcaaaagaaagcccaattacaagctgctgcttccagaaatgatccagaagttcatatgggcactacagcagacggccaagggtttgttagtcccgacgatggaagcggtacaagtcatgctaccaaagaataa

SEQ ID NO: 1773 - protein, 514 aa, Debaryomyces hansenii CBS767
MANDGFTGTGPGGDIMKVDLNEQFDKADMVWVGVSAALVWLMVPGVGLLYSGLSRKKHALSLLWASLMATCLTAFQWFFWGYSLVFTKSDSVILGNLDYFSLKNVFGAPSVVSTVPDILFCLFQGMFAAVTAILMVGAGCERARLGPMMVFLFCWLTVVYCPIAYWTWGGNGWLFNLGALDFAGGGPVHENSGFAALAYSLVLGKRHDPLTAGKVPKYKPHSVTSVVLGTVFLWFGWFGFNGGSTGNASIRSWYACVNTNIAAACGGLTWMFVDWFRTGGKWSTVGLCTGAIAGLVGITPAAGFVPVYTSIVFGVVPAIVCNFAVDLKSILQIDDGMDVFALHGVGGICGSILTGFFAADYIAASDGSVAADPSAAIAGGWMNHNYKQLGYQIAGSCAVGLWSFTLTGILLLIMDRIPQLRIRLHADEEIMGTDIAEIGEFTYYDDEMGQGNTLAMSDNLPYVIEPIRSTDQKKAQLQAAASRNDPEVHMGTTADGQGFVSPDDGSGTSHATKE

SEQ ID NO: 1774 - DNA, 1578 bp, Debaryomyces hansenii CBS767
  CDS (1)..(1578)
atgacaatttcatctgtaacaacaggcatattaaatcgaagaaagctattcacagcaaatgaagactataaggaaagtgacatattattattctcgatcgcttcgtcgctaatctggataatgataccgggtttagcatttttatattctgggttggccagacggaaaagtgcgttgtcgatgatatggatagtgttgatgagttcgttcattggaatcttccaatggtacttttggggatactcgttagccttttctgacaaatctgcaaacaattttattggggacttgcatttctttggcttcaagaatctattaggtagtgctgaaggcacgcctgactatcctgaaatcgcctatgcgttatttcaaatgcaatttttgttggtcaccttagctattttagcaggcgggtgtattggagaaagaggaagatttttaccaacggctatctttttattttgctgggcgacagtggtttactgtccggtggtttactggatttggggaggtggatgggcctcacagtggcaagggggtgctttggattatgcgggtggtggcccagtagaaatactatcgggtgtatcagcgtttgtattcagtgcattcttaggtagaagaaacgagacattgatgattaattatcgtccacacaacatttccaccatttgtatgggaacatcattactttatgtgggatggttatttttcaacgggttctcttgtggaaatgcatcaatcaaggttccatactcgatgttcaatacccatttatgtggtgcattcggggctatcacatggtgtttgcttgatttcagattggaaaataaatggtccatggttgcggtctgctcgggttgtatttcaggattagtggcggccactccttcatcaggtatgatcccattatgggcctcagtgattcttggaattgtatctggtattgtgtgtaacttttccaccaaaatcaaatatctctgcagagtcgacgattccctagatgttttagcggagcacggtatcgccggtattgtgggattgattttcaatgcattatttggaagttccactgttatcggctacgatggagtaactgtgcacgccggtggttggattgatcacaattacaaacaattgtacattcaaatcgtctatatcttggccaccgcagcttatgctggtggtgtcacggctgtgctatgcttcgtaatcaacaaaatccccggtttgcacttgagaatagattacaatgccgaagaaattggtatggacgaagaccaaatcggtgaatttgcctatgattatgtcgaagtaagaagagatttcttagattggggcaatcctaacgtcaatccaaatgctcaaatgtctcgtccatcccaggaagttatggagggaattcctccgaatccccaggttttccaggcagttggcagctcctcagtatcgactgctcatcaggatgactcgagcattcaagaaaaactcgattctcagaatcatgactcccaagtcccagaatcccaaaattataatactgctagcgatactaaggaagatgttatcgaagagtag

SEQ ID NO: 1775 - protein, 525 aa, Debaryomyces hansenii CBS767
MTISSVTTGILNRRKLFTANEDYKESDILLFSIASSLIWIMIPGLAFLYSGLARRKSALSMIWIVLMSSFIGIFQWYFWGYSLAFSDKSANNFIGDLHFFGFKNLLGSAEGTPDYPEIAYALFQMQFLLVTLAILAGGCIGERGRFLPTAIFLFCWATVVYCPVVYWIWGGGWASQWQGGALDYAGGGPVEILSGVSAFVFSAFLGRRNETLMINYRPHNISTICMGTSLLYVGWLFFNGFSCGNASIKVPYSMFNTHLCGAFGAITWCLLDFRLENKWSMVAVCSGCISGLVAATPSSGMIPLWASVILGIVSGIVCNFSTKIKYLCRVDDSLDVLAEHGIAGIVGLIFNALFGSSTVIGYDGVTVHAGGWIDHNYKQLYIQIVYILATAAYAGGVTAVLCFVINKIPGLHLRIDYNAEEIGMDEDQIGEFAYDYVEVRRDFLDWGNPNVNPNAQMSRPSQEVMEGIPPNPQVFQAVGSSSVSTAHQDDSSIQEKLDSQNHDSQVPESQNYNTASDTKEDVIEE

SEQ ID NO: 1776 - DNA, 1722 bp, Yarrowia lipolytica CLIB122
  CDS (1)..(1722)
atgtattccagatcaggtcggaaaaaagaaaccacaacaccccaacaccaacaccaacagctacagctactctacacgctcttattcacactattcatggaggcgtatcatccgggcgacctgctctcggtgatccacagcacgatggccatgatgctcatgtgtccggcgctcggcatgctctattcagggctcactccacactcttcggccctctccatggcaggcatgaatcttgcagctctatcgatggctgtattgcagtgggtggtatgggggtactcgttggctctgagtccgacggggggcaagttcatggggaatctacgacacgcaggcttccaccatgtggctctggaaccacaccccattgcttttggacggctaccaggactcgcggtggccatgtttgagggcatgtttttgtgcatcacggcggtcattatgacgggaagcatcgtggggcgaggccgtgtcgtcccctttgtggtcttcatcttttgctgggccacggtggtttactgccccattgcatgctgggtttgggggcctaatggatggagcggcaacttgggcgctcttgattttgcgggaggctcacctgttcacatcaactcgggattcacaggtttggcatacggtatcatgctcagatggagccgaggaaggaagatgggccagacccccgtggcggtccctgaaccacattatccacattcagccatgctggtaatgattggaacaggcctactgtggacggggtggctcggttttgcgtctgaaggcgcctttggggccaacctcatggctcttatggcttcgtccaatactatgattggaggagcgtttggaggactagcatgggccgtgctggactacagaatcgaacgaaagctgtcgatgattgggttctgctcaggtgccgtgtctggactcgtttctctgtccccttcgtcgggctatgtggctccttgggccgctattgtttgtgccattgtaggctccatagcctgcaacctcgccacacagctcaagtttttcatccacgtggaggaccctctggacgtgtttgctattcacggtatcggcggcatggtaggttcgctgctagtcgggctgtttgccgagaaagaagtggccaaactggacggaaacagagatatcaagggaggttgggtcaatcagcattacgcccagcttggctaccagtgcgcagaggtgttttccgtggccggatacgccttctttgtgtctcttgttctgctattcatcattgatcgaattccagggctacatctgcggatggatcctgaagcagagagccagggtcctgacaccaaccagcatggcgaggtgtgctacgagtttctggcgcagctgggtgacgaccccagccccaaccatccagacacggatccttccaacaccatcaatgggtcgtccccgcgtccttccatggacggcaaccagtttggcatctatgagttgcatgccattcagtccaaaaaggtgaacgatgcgtaccattttcccatgcacccgcccatgcaggtcaacttccctcccccggtatcccagccgcaacctccatctcaggatgcgacccctccgccccacaatgaaccacctccaacgcccatgctggactttagtcttggaccccaacagcccccaagacagccgttgaaccgcacagtgacgtctcccttgctaggggaatga

SEQ ID NO: 1777 - protein, 573 aa, Yarrowia lipolytica CLIB122
MYSRSGRKKETTTPQHQHQQLQLLYTLLFTLFMEAYHPGDLLSVIHSTMAMMLMCPALGMLYSGLTPHSSALSMAGMNLAALSMAVLQWVVWGYSLALSPTGGKFMGNLRHAGFHHVALEPHPIAFGRLPGLAVAMFEGMFLCITAVIMTGSIVGRGRVVPFVVFIFCWATVVYCPIACWVWGPNGWSGNLGALDFAGGSPVHINSGFTGLAYGIMLRWSRGRKMGQTPVAVPEPHYPHSAMLVMIGTGLLWTGWLGFASEGAFGANLMALMASSNTMIGGAFGGLAWAVLDYRIERKLSMIGFCSGAVSGLVSLSPSSGYVAPWAAIVCAIVGSIACNLATQLKFFIHVEDPLDVFAIHGIGGMVGSLLVGLFAEKEVAKLDGNRDIKGGWVNQHYAQLGYQCAEVFSVAGYAFFVSLVLLFIIDRIPGLHLRMDPEAESQGPDTNQHGEVCYEFLAQLGDDPSPNHPDTDPSNTINGSSPRPSMDGNQFGIYELHAIQSKKVNDAYHFPMHPPMQVNFPPPVSQPQPPSQDATPPPHNEPPPTPMLDFSLGPQQPPRQPLNRTVTSPLLGE

SEQ ID NO: 1778 - DNA, 1368 bp, Yarrowia lipolytica CLIB122
  CDS (1)..(1368)
atgtctgaacccacgctcgagtctcttcagtacaccatcaacaccgcatacatgctggtggcatcggctggagtgtttgttatcactccgggaattggcttattctacgcgggcatgctcaggaagaacagtgctatgcaggtgattgttcaatcgtacatcaccacgtttgttgtcacgatacaatggtggatatggggctatgccctggcattaggagatggaagctcttttctaggaaacctgaacatggctttcctcaaggactcgaaccctggtcccttggtcgaaggaggtcccgttcccagtgcagcctacttcatcttttccgtcttctttcccgtttgcactgttcagatctttttagggagcacagccgaaagaggccgtgtgattccggcgcagatcatcgggtttctgttcactacagtggtatactgtcctctggcatactggttctgggcacccaagggctggttgctggttctaggcacgctggattttgctggaggagcacctgttcatattgctggaggaaccgcatctttggcctatgccatgttcctgggaccacgaaaaatcacccccagattccatgcctataaaccacacaatgcgacaatgtctatgattggcacgactctcatctggtatggctggctgttcttcaactcggggactctccaggctgtcaacacccggacagcttacatcatgctcaacacccatttgagtgcctctgcagctggaatgacttatgtcatctacgataagatcttccacaaaaaattttctatgatgggtgcatgcgaaggagctattgcaggactggtcgctgttactccttcctgtggttacgttgcgccatgggctgccttcactggaggcatcatgactgccctggtgtgtagattgaccataaacgtgaacaagtggctacgagtcgacgatgccatctactcgttcaatctccatgccattggtggatgtatgggatccctcgttaccggcttctttgcgtcttcaacttggactgatatggatggcagtaaagacgctattgctggaggttggattgccaaccactgggtccagatcccttaccagctggctggactgggagccactattggctggacgtttgtcgtcacctatattctctgctttgtggtggacaagattccgggcctgaagctccgagtagatgaagaccaagaactcaagggtatggacgcatatgacattctggagtccgctggagagaccattgacggtgtcattgttaacacaactgaaattttggtggcccatactcctgctcatactccagatagtggctcttttgtacggggtgagaagaaggaatag

SEQ ID NO: 1779 - protein, 455 aa, Yarrowia lipolytica CLIB122
MSEPTLESLQYTINTAYMLVASAGVFVITPGIGLFYAGMLRKNSAMQVIVQSYITTFVVTIQWWIWGYALALGDGSSFLGNLNMAFLKDSNPGPLVEGGPVPSAAYFIFSVFFPVCTVQIFLGSTAERGRVIPAQIIGFLFTTVVYCPLAYWFWAPKGWLLVLGTLDFAGGAPVHIAGGTASLAYAMFLGPRKITPRFHAYKPHNATMSMIGTTLIWYGWLFFNSGTLQAVNTRTAYIMLNTHLSASAAGMTYVIYDKIFHKKFSMMGACEGAIAGLVAVTPSCGYVAPWAAFTGGIMTALVCRLTINVNKWLRVDDAIYSFNLHAIGGCMGSLVTGFFASSTWTDMDGSKDAIAGGWIANHWVQIPYQLAGLGATIGWTFVVTYILCFVVDKIPGLKLRVDEDQELKGMDAYDILESAGETIDGVIVNTTEILVAHTPAHTPDSGSFVRGEKKE

SEQ ID NO: 1780 - DNA, 1380 bp, Yarrowia lipolytica CLIB122
  CDS (1)..(1380)
atggactcagaagcccccgtggaaactcttactgcggcgcaaataaaatcgtatgtcgacacagcatacattcttgtgtgtgcagtgggcgtgtcgctcatcaccccaggtattggaatgctgtatgccggcatgatcagacgcaagaacgcactcactatcgtcgcccaaagtgtactcacaacctgtgtcatctgtcttcaatggtggatctggggctactctctgggtaacgttcccaatggcaagatgcttggtaacctgagtctggctttcatgatgggtagccctactagccatgacgagctttctctcgaccagctcgaggaggagggaatccccacttctgttcatttcatcttctccgccttctttgttgtctgcacagtccagattttcgctggtgccatcgctgagcgaggtagactcatttcatcacagattgtcggcttcatcttcgctacggtcgtctactgtcctctctcgtactggttctgggccgaggacggctggctcaacgccatgggagtccttgactttgctggaggaggacccgtccacatcgccagtggaacgggtgctcttgcctacgcactgtacctaggaaagcgaattgatgacaacggagaggcctctatgcttgcccgtgccaaaccccataaccccactctggttctgcttggaactctgctcatctggtacggatggctcttcttcaactcaggcaccttgttggctgtcagctctcgaactggatacatcatgctgaacacccagctttctgcctgcactggcggtatcatctttgccgccgtcgacaagtggcgatacggacgggtgtctctcgtcggtctttgtgagggagtcatctgtggtctagtggccatcactccttcctgtggatacatctctccatggttctctgttgttggagctatcatcactgctggagtctgctgctctctgtccaatatcaaccagtggattggcattgacgatactatccgatcctttaacatccacgcaattggcggaatcatgggatctatctgcactgccttctttgccgaccctgcctgggcccaggaagatattccaggaggctggatcaagcacaactgggtccaactgggccacgagctcgccgctgtcaccacctgtgtcgcctggtccttcgtcctcacctacatcatctgtttcgtggttgaccacattcctggtctcaagctgcgagtcactgctgaggaagagatgctcggaactgatgtcaaggatctgtcagagaaggtcgaaaacatggaggactctctctggggcaactccccatccatgagccgagagcccaccgtcgccaagcgggacgctgagcccatggtctaa

SEQ ID NO: 1781 - protein, 459 aa, Yarrowia lipolytica CLIB122
MDSEAPVETLTAAQIKSYVDTAYILVCAVGVSLITPGIGMLYAGMIRRKNALTIVAQSVLTTCVICLQWWIWGYSLGNVPNGKMLGNLSLAFMMGSPTSHDELSLDQLEEEGIPTSVHFIFSAFFVVCTVQIFAGAIAERGRLISSQIVGFIFATVVYCPLSYWFWAEDGWLNAMGVLDFAGGGPVHIASGTGALAYALYLGKRIDDNGEASMLARAKPHNPTLVLLGTLLIWYGWLFFNSGTLLAVSSRTGYIMLNTQLSACTGGIIFAAVDKWRYGRVSLVGLCEGVICGLVAITPSCGYISPWFSVVGAIITAGVCCSLSNINQWIGIDDTIRSFNIHAIGGIMGSICTAFFADPAWAQEDIPGGWIKHNWVQLGHELAAVTTCVAWSFVLTYIICFVVDHIPGLKLRVTAEEEMLGTDVKDLSEKVENMEDSLWGNSPSMSREPTVAKRDAEPMV

SEQ ID NO: 1782 - DNA, 1461 bp, Yarrowia lipolytica CLIB122
  CDS (1)..(1461)
atggctgacgctacctcaacgcaagctccccttccgaccactggcaatggaggagactccctcacacaaaacctgaacgtccccttcctgggtgccgatatggtctggatcatgacctcttcggcactggtctggatcatgattccaggagtcggtctgctctactctggtatgtcgcgtaagcaccacgccctgtctctcctgtgggcatccatcatgtgctgtgccctcgtctctttcgagtggtttttctggggttacactctggcattctctcacaaggccggaaagttcattggaaccatggataacttcggtcttatgaatgttctcgctgctccctctgttggctcctctgctgtccccgatatcctgtatatgttctaccagggcatgttcgcatgcatcaccggtatgctcatggttggtggagctcacgagcgagctcgactcggccccatgatggtatatctcttcatttggatgactgtcgtctactctcctattgcatgctggacatggaaccctagtggatggctcgccgtccttggaggacttgatttcgcaggtggaggacctgttcacatgtcttccggtgcgggtgcccttgcctatgctctctggtgtggtaagagacgtgaccctgctgttgagaagctgcctcactaccggccctcttccgttacttccgttgttctcggcactgttttgctttggttcggatggttcggattcaacggtggttcctctggtaacgcctccatccgaggcttctacgctgccgctaatactaaccttgctgctgcttgcggtgctctcgcttggatgtgtgtcgacttcttccgaaagggccgaaagtggtccactgttggtctctgttctggtgccatcgcaggtctcgttggcatcacccccgccgccggcttcgtccctatctggtctgctgtccctattggtatcatcaccgccgtcttcgctaacatttctggtgaccttaagaatctgctccgaattgatgatggtctcgatgtcttctctctccatggtgtgggaggattctgcggctctgttcttactgccttctttgctgctgactacattgcccatctggatggtgccacagagatcaagggtggatggctcaaccaccactgggctcagctgggttaccagctggctggtgcgtttgctaccctcggctactcctttgtggtctcttcagttattcttgtcatcatgaacagaatcccctacctcaacgtccgaatgaccgaggaggaggagatgcttggaaccgacatggcccagatcggcgagtttgccttcgactgggaggactctggagtcctggacctgcatggccagaaccccaatggtatgggcgtcacccccaacgtccagactcccaagcccagcagcatcaacgaaaacaaggaggctgctgagagtgattcggtttaa

SEQ ID NO: 1783 - protein, 486 aa, Yarrowia lipolytica CLIB122
MADATSTQAPLPTTGNGGDSLTQNLNVPFLGADMVWIMTSSALVWIMIPGVGLLYSGMSRKHHALSLLWASIMCCALVSFEWFFWGYTLAFSHKAGKFIGTMDNFGLMNVLAAPSVGSSAVPDILYMFYQGMFACITGMLMVGGAHERARLGPMMVYLFIWMTVVYSPIACWTWNPSGWLAVLGGLDFAGGGPVHMSSGAGALAYALWCGKRRDPAVEKLPHYRPSSVTSVVLGTVLLWFGWFGFNGGSSGNASIRGFYAAANTNLAAACGALAWMCVDFFRKGRKWSTVGLCSGAIAGLVGITPAAGFVPIWSAVPIGIITAVFANISGDLKNLLRIDDGLDVFSLHGVGGFCGSVLTAFFAADYIAHLDGATEIKGGWLNHHWAQLGYQLAGAFATLGYSFVVSSVILVIMNRIPYLNVRMTEEEEMLGTDMAQIGEFAFDWEDSGVLDLHGQNPNGMGVTPNVQTPKPSSINENKEAAESDSV

SEQ ID NO: 1784 - DNA, 1362 bp, Yarrowia lipolytica CLIB122
  CDS (1)..(1362)
atgtcagaatatgaactacccgacctagtatgggtgacgacaagcggagcgttagtgtggctcatggtgcctggaatcgcgtttctatactcgggattgtcgcgcaaaaaccatgccctgggtgctctttggactggaatgatgactctcggcgtctccttcttccagtggtggttgtggggctactcgttgagcttttcggccaaggataacggtcaacacttcattggaggaatggaacacgttgttgctcaacatgtatggacttctcggtcggcttcgacgcccacagttcccgatgtagtgtgttacttctaccagggcatgtttgcgtgtgtcactgcagctctcatgattggcggaggaaacgagcgagtaagactggggcctttggctgtgtttcttttcatatggcagacaattgtgtattgtccaattgcctactggacgtggaaccccaatggttgggctgctcgtttgggcagtctggactttgcagggggaggaccggttcacatgtgctctggaagtgcagccatggcgtttgccttggtggttggacgtcgaaaaagtccagcttgtgactttgtgcctgccttcaggccctcgtcggtagcctacatcatcatgggcaccatcatgctgtggtttgggtggctggggttcaacggaggctctgctgggggagccagtgtgcgaggaattgtggccatggtgaacaccaatctggcggcttcctgtggtggactcacgtggatgatggtggactacttccgacacaatggaaagtggactgccatcggtatctgttcgggagccattgtggggcttgtgggggtcactccagctgccggatttgtgcccgcgtggtcggcggtagttattggaattgtttctggagtcgcagccaatctcggaatcggaatcaagggtgttgtatacatcgacgacggtctagacgtgtttgcgctccatggaattggaggctttacaggctcagtcatgaccgccttttttgcgtccgactgggtcacaaaaacagacggagtcaccgtaatccagggcggatgggtcaacggacattacgtccagctgggctaccaattggcctcggcatgtgctaccattggctggtcctttgccatcacctacctcattctcatcaccatggacttgatcccgtttctgaccctgagaatggacgcagtggatgaacaactaggcaccgacgtgacccaactgagcaacgagtgtcctgagcagtgggaggagttgaccctctatctcagaccgtggctggagaatgtggagaaggagaaacaggaaagaatggcccaggaggccatgcaccaggtggtatga

SEQ ID NO: 1785 - protein, 453 aa, Yarrowia lipolytica CLIB122
MSEYELPDLVWVTTSGALVWLMVPGIAFLYSGLSRKNHALGALWTGMMTLGVSFFQWWLWGYSLSFSAKDNGQHFIGGMEHVVAQHVWTSRSASTPTVPDVVCYFYQGMFACVTAALMIGGGNERVRLGPLAVFLFIWQTIVYCPIAYWTWNPNGWAARLGSLDFAGGGPVHMCSGSAAMAFALVVGRRKSPACDFVPAFRPSSVAYIIMGTIMLWFGWLGFNGGSAGGASVRGIVAMVNTNLAASCGGLTWMMVDYFRHNGKWTAIGICSGAIVGLVGVTPAAGFVPAWSAVVIGIVSGVAANLGIGIKGVVYIDDGLDVFALHGIGGFTGSVMTAFFASDWVTKTDGVTVIQGGWVNGHYVQLGYQLASACATIGWSFAITYLILITMDLIPFLTLRMDAVDEQLGTDVTQLSNECPEQWEELTLYLRPWLENVEKEKQERMAQEAMHQVV

SEQ ID NO: 1786 - DNA, 1497 bp, Yarrowia lipolytica CLIB122
  CDS (1)..(1497)
atggagatgctggagaagcgaggaggtgatgtgtggcaatacacttacgatactggagatgtggcctacatcaccgtgtccatgtgcatgattctggtcatgattccaggcctgggttttctgtactcgggtctggcccgaagaaagtcggcgctgtctatgatctgggtgtgtttcatgggcgccattgttgcccagattcagtggtacttctggggatactcgttggccttttctccttcttctaaccggtttatcggcaacctggacaactttggtcttaagaacattctcaaacacgaggacggcagtcgcaagtaccccgagctgctgtttgccggcttccagggtatgttctgctctgtgaccgtggccattgtggtgggaggtgtggccgagcgaggtcgtctgctgcccgccatgatttttgcattctgctgggccaccattgtctactgccccattgcattctggatctggggccccaacggatgggctggagctcactgggacgtgctggactttgcaggaggaggacctgtggaaattgcatctggtatcggaggtctggcatactcttttgctcttggccgaagaaaggaacaactgctgctcaacttccgaccccacaacgtgtctctggtgaccatgggaaccgctctactgtggtttggctggctgggattcaacggaggctctgctcttggctccaacctgaaggcggtctacgctgtgtggaactccaacattgccgcctgctttggtgctctgacttggtgtctgctggatttccggctcgaaaagaagtggtctaccgtggccatctgttccggtattatttcggggctggttgctgctactccctgttctggtatcattcctctgtgggcctctgtccctctcggtatcgttgcagcagcgatttgtaacttttctacacaaatcaagtacattctcaagattgatgattccatggatacctttgctgagcacggcgtcgcaggaattgtcggactcattttcaacgccttctttggagccgactacgtgattggcttggatggatccactcctcacggaggaggatgggtgtccaacaactggaagcagatctacaagcagatttgttttgtgttggccgcctctggatacacctttgtcatgactgtcgtgctctgctacgccatcaacttcatccccggctgcaagctgcgagcatctgaggaggccgaacttcgaggaatggacgaagaccagattggagagttcgcctacgactacgtcgaggtccgacgagactggctggcttggactccccccaccaagtcgcacatgcacgatgagcctgagcactcgaccgatgccgacgcgattgaggccaacgccgacgtcctggccggctccagtccaaacgaccagaactcgtccatggaacaaccccccacttcttcccaggccacctcggccgacgatgaaaagaacggaattcatccgtaa

SEQ ID NO: 1787 - protein, 498 aa, Yarrowia lipolytica CLIB122
MEMLEKRGGDVWQYTYDTGDVAYITVSMCMILVMIPGLGFLYSGLARRKSALSMIWVCFMGAIVAQIQWYFWGYSLAFSPSSNRFIGNLDNFGLKNILKHEDGSRKYPELLFAGFQGMFCSVTVAIVVGGVAERGRLLPAMIFAFCWATIVYCPIAFWIWGPNGWAGAHWDVLDFAGGGPVEIASGIGGLAYSFALGRRKEQLLLNFRPHNVSLVTMGTALLWFGWLGFNGGSALGSNLKAVYAVWNSNIAACFGALTWCLLDFRLEKKWSTVAICSGIISGLVAATPCSGIIPLWASVPLGIVAAAICNFSTQIKYILKIDDSMDTFAEHGVAGIVGLIFNAFFGADYVIGLDGSTPHGGGWVSNNWKQIYKQICFVLAASGYTFVMTVVLCYAINFIPGCKLRASEEAELRGMDEDQIGEFAYDYVEVRRDWLAWTPPTKSHMHDEPEHSTDADAIEANADVLAGSSPNDQNSSMEQPPTSSQATSADDEKNGIHP

SEQ ID NO: 1788 - DNA, 1419 bp, Aspergillus nidulans FGSC A4
  CDS (1)..(1419)
atgtctagtcccgaatatgatccctccatacctgatggcggagatacgaccaagctcgacgtgaacgcgccgtttgttggatatgagttccatgccgtttacatcgctgcctgtactttcatcgtctatctcattcttccgggaatcggttttctttacagcggtttgactagaaggaagtctgcgatgacttttttgtttcaggcatttttagtcctggcagtcaccacatttcaatggatgttctgggggtattcactcacctactcgcgggatggcggcccctacattgggacgctgcagaattttgggctcatggatgccctggcggccccatcgccagggtctgccgtgcttcccgaagtcctcttctgcttgtaccagctcctcttcggttcctgcacggtcatgattgttgttggcggcgcctttgaaagaggcggtatcttggcgtcacttgtcttcgcctttgtctgggaaaccattgtgtactgtcctctcgcacggtggacttggagtagccatggctggctgtataatcttccctccgtcgacttcgccggaggcggcccggtccatattgcctcaggctgcgctgcattggcgtacgcagttgtcctcggcaagcgcaaaggctacccagacgccagtatgaagcggcctcacaacacgactctggtcttcctgggtaccgtctttatttggactggctggcttgggtttaatggcggttcgaccctcaacgcaagtgtccgtagttacatggccgttatgaacaccaacatcgcaggctccacgggcgtcctgggttgggtcctggtcgacatgatccggaacaagggaaaattctctatggtaggagcttgcgaaggcgccattgctggccttgttggtatcactccctgtgcgggatgtgtcactttctggctgggcgccctagttggtttccttactggcatcgtgtgttccgcgtgcaagaacctcaacgagtggattcgggttgatgaagggatggacgttttcaaactccatggagtcggcggtatggtcggctcattcctgactggcattttcgccgatcagtacatctcggcgttggatggcgattccctcattcctggagccatcaacggcgagggcgttcaggttggaaagcagcttgctgagatctgcgccatctccgcttattctttcggtgtgacctgggtcatactcatggtgatgaagttcattccatacctggggctgcgggccaacgaagaagctgagatggtcggactggaccgatccttcttcgtggacgagcagatcggcgactactccatgctggatgggatcaatagctcgccgttgatgggggtgtcgaaaacaccctcgagcgaagtacagcagacagcggccgagacgaaaagggcgtag

SEQ ID NO: 1789 - protein, 472 aa, Aspergillus nidulans FGSC A4
MSSPEYDPSIPDGGDTTKLDVNAPFVGYEFHAVYIAACTFIVYLILPGIGFLYSGLTRRKSAMTFLFQAFLVLAVTTFQWMFWGYSLTYSRDGGPYIGTLQNFGLMDALAAPSPGSAVLPEVLFCLYQLLFGSCTVMIVVGGAFERGGILASLVFAFVWETIVYCPLARWTWSSHGWLYNLPSVDFAGGGPVHIASGCAALAYAVVLGKRKGYPDASMKRPHNTTLVFLGTVFIWTGWLGFNGGSTLNASVRSYMAVMNTNIAGSTGVLGWVLVDMIRNKGKFSMVGACEGAIAGLVGITPCAGCVTFWLGALVGFLTGIVCSACKNLNEWIRVDEGMDVFKLHGVGGMVGSFLTGIFADQYISALDGDSLIPGAINGEGVQVGKQLAEICAISAYSFGVTWVILMVMKFIPYLGLRANEEAEMVGLDRSFFVDEQIGDYSMLDGINSSPLMGVSKTPSSEVQQTAAETKRA

SEQ ID NO: 1790 - DNA, 1437 bp, Aspergillus nidulans FGSC A4
  CDS (1)..(1437)
atgtcgacttaccctgttgcctacaatgggaccggcgtgaacggtggtgactccctcagggaggatctcaacatctactacagttctggtgatattgcatgggttattacctcaaccgcgctagttcttctaatgataccgggtgtaggattcttctactccggtctcgctcgtcggaagtccgccctctccctgatatggctttcattgatgtctatcggtgtggtctcattccaatggttcttctggggttattcgttggccttttcccacactgccggaaagtacattggtaacttggataactttgggttcaagggtgtcctgggcgctccttcagtgggctcaaccaaggtccccgatcttctgtttgctgtctttcagggaatgtttgctgcgattaccgttgcacttgccgttggtgccgttgcagagcgtggtcgtatgcttccctgcatggttttcgtctttatctggagtaccatcatctacgaccccgttgcatgctggacctggaatgcttctggttgggtcttccagttaggaggcttggactttgctggtggcacgccagtccacattgtctccggtacgacggctctggcctactctttgatgctcggcaagcgtcgtggtcacggaactcatgagctcaactatcgccctcacaacgttactcatgttgtgattggcaccgtctttctttgggttggctggttcggtttcaacgccggctccgccttgagcgctaatctgcgtgctgtgatggctgctgtagtgacaaacttggctgcttctgtaggtggtgtcacctggtgcttgctcgactaccgtctagaaagaaagtggtcaaccgttggcttctgttccggtgtgatttccggccttgttgccattacccccggttctggcttcgtgactccctgggctgcgtttatcttcggcgttgtcggtgctgctgcttgcaacttcgcgactaaagtcaagtatctcatccgagttgatgatgctctcgatatcttcgctgtgcacggtatcggtggtcttgtcggtaacctcctgaccggtctcttcgcagctgactacattgcccacctggacggctctaccgagatcgacggcggctggatcaaccacaattacatccaactcggctaccaacttgccgattccgtcaccggcatggcctactccttcttcggcagctgcatcattctctttatcatcaacatgatccccggccttagcctgcgcgtccctgaagaagatgaagtccttggtatcgatgacgccgaaattggcgaatttgcttatgactacgtcgaactcacccgcgacgttattaacgggaccactgagccgatggacggcgcatccaagcgcagcaccactcccaccggacccgtcgaaccatcccctgccgagctcaaagcgtaa

SEQ ID NO: 1791 - protein, 478 aa, Aspergillus nidulans FGSC A4
MSTYPVAYNGTGVNGGDSLREDLNIYYSSGDIAWVITSTALVLLMIPGVGFFYSGLARRKSALSLIWLSLMSIGVVSFQWFFWGYSLAFSHTAGKYIGNLDNFGFKGVLGAPSVGSTKVPDLLFAVFQGMFAAITVALAVGAVAERGRMLPCMVFVFIWSTIIYDPVACWTWNASGWVFQLGGLDFAGGTPVHIVSGTTALAYSLMLGKRRGHGTHELNYRPHNVTHVVIGTVFLWVGWFGFNAGSALSANLRAVMAAVVTNLAASVGGVTWCLLDYRLERKWSTVGFCSGVISGLVAITPGSGFVTPWAAFIFGVVGAAACNFATKVKYLIRVDDALDIFAVHGIGGLVGNLLTGLFAADYIAHLDGSTEIDGGWINHNYIQLGYQLADSVTGMAYSFFGSCIILFIINMIPGLSLRVPEEDEVLGIDDAEIGEFAYDYVELTRDVINGTTEPMDGASKRSTTPTGPVEPSPAELKA

SEQ ID NO: 1792 - DNA, 1635 bp, Aspergillus nidulans FGSC A4
  CDS (1)..(1635)
atggcctctgaaggcatggctcccttcactcccgagtatgcctcgtacaactggacaggcgctccctcagactattccagcctggccaccaacgagctgggcggaaactcaagggtggaaaacttgaacaaatggtaccagtcgggtgaccaagcctacatcatcgttgcttcggccatggtcatgctcatggtgcctggcctcggattcctttactccggtctcgctcgccgcaagtcagccctcagcatgatctgggcttgtatgggctcgatgtgcgttgtaacattccaatggtacttctggggttactcgcttgctttctctcccaccgctacaaatggatacattggaaacctgcgcaatttcggtctgatgaaggttctggcggaccccagcccagggtctcctctggttcctaacctcctctacgccttctaccagatgcaattctgtgccgtaactgctgctatcattatgggagcggttgccgaacgtgggcgtcttcttcctgccatggtctttactttcgtctgggccacaatcgtgtactgccccatcgcttgctgggtatggaatgtcaacggctgggccttcaactatggcgtgctggattatgctggtggtggccccgtcgaaatctgctccggtctttcggcgctcgcatactctatggtcctcggtcgtcgccaggagcgcatgatgctcaacttccgcccccacaatgtttccctcattctgctcggtaccgtctttctctggttcggatggcttggattcaacggtggctcgtcattcggtgcaaacatgcgcgctacgatggcatgctggaacacaaacttgaccgctgcctttggcgcgatcacttgggttattctcgattggcgcctggctcgcaagtggtcgatggtcggttggtgttccggtacaatctccggtcttgtcgctgctactcctgcttccggtttccttcctccctgggctagtgttgttctcggtattgtgaccggcattgtatgcaactactccacgaaggtgaaatactggatccgtattgatgactctatggatgtgttcgccgagcacggtgttgctggtattgtcggtctcattttcaacgccttcttcgcagacgacgccatcgtcggccttgacggggtcaacaccggttctgaaatgggcggctggctcatccacaactggaagcaactttacatccaaatcgccttcatcgtcgctgcctccgcctactccttcgttgtgtcggccattgtcgcctacgccatcaacgccatcccaggcctgaagctccgtgcatccgaagaggccgaactcctcggcatggatgatgatcagctgggtgaattcgcttacgactatgttgaggtccgtcgtgactaccttgcctggacaccccagaagcacgaccaacacgcagacggtcatgaggttcctgctgccgcgaggtatggcatcggggagcacagcgagatgatgctcgacggtgaggctcccacaggtgcgaccaacagccgcggaagtgaggtatcaggcgtgcaagaaatcaatgtcaaggaagaatcgcaacggcctgcgccgccgaccgacgccgagaaggctgctcaggggctttaa

SEQ ID NO: 1793 - protein, 544 aa, Aspergillus nidulans FGSC A4
MASEGMAPFTPEYASYNWTGAPSDYSSLATNELGGNSRVENLNKWYQSGDQAYIIVASAMVMLMVPGLGFLYSGLARRKSALSMIWACMGSMCVVTFQWYFWGYSLAFSPTATNGYIGNLRNFGLMKVLADPSPGSPLVPNLLYAFYQMQFCAVTAAIIMGAVAERGRLLPAMVFTFVWATIVYCPIACWVWNVNGWAFNYGVLDYAGGGPVEICSGLSALAYSMVLGRRQERMMLNFRPHNVSLILLGTVFLWFGWLGFNGGSSFGANMRATMACWNTNLTAAFGAITWVILDWRLARKWSMVGWCSGTISGLVAATPASGFLPPWASVVLGIVTGIVCNYSTKVKYWIRIDDSMDVFAEHGVAGIVGLIFNAFFADDAIVGLDGVNTGSEMGGWLIHNWKQLYIQIAFIVAASAYSFVVSAIVAYAINAIPGLKLRASEEAELLGMDDDQLGEFAYDYVEVRRDYLAWTPQKHDQHADGHEVPAAARYGIGEHSEMMLDGEAPTGATNSRGSEVSGVQEINVKEESQRPAPPTDAEKAAQGL

SEQ ID NO: 1794 - DNA, 1443 bp, Candida albicans SC5314
  CDS (1)..(1443): transl_table=12
atgtctggaaatttcactggaacaggcacaggtggagatgtgttcaaagtcgatttaaatgaacaatttgatcgtgccgatatggtatggattggcactgcaagtgttttggtatggattatgattcctggtgtgggtctcttgtattcagggatctcccgtaagaaacatgcattatcattaatgtgggctgctttgatggctgcgtgtgtggcagccttccaatggttctggtgggggtactcgttggtttttgcccacaatggctctgtgtttttagggaccttgcaaaacttttgtctcaaggatgttttgggtgcaccatctattgttaaaaccgtgcccgatatcttgttctgtctttaccaagggatgtttgctgctgtcactgctattttgatggctggtgctgggtgtgaacgtgcgagattaggtcctatgatggtgtttttgtttatctggttgactgttgtttactgtcctattgcctattggacatggggtggaaatggttggttggtcagcttaggtgcattggatttcgccggtggcggtccagttcacgaaaactctgggtttgctgccttggcatactctctctggttgggtaagagacatgacccagttgccaagggcaaagttccaaaatacaagccacattcggtttcctccattgttatgggcacaatctttctttggtttggttggtacggtttcaacggtgggtccactggtaactcttccatgcgttcatggtacgcctgtgtcaataccaatcttgctgccgcaactggtgggttgacttggatgcttgtcgattggttcagaacaggtggtaagtggtcgactgttggtttatgtatgggtgctattgctggtcttgttggtatcactcctgctgctggttacgttcccgtttacacgtcagtaatcttcgggattgttccagccattatttgtaactttgcagtagacttgaaggacttgttgcagattgatgatggtatggacgtgtgggcactccatggtgttggtggatttgttggtaactttatgactgggttatttgctgcagactacgttgccatgattgatggaactgagattgatggtgggtggatgaaccaccactggaagcaattggggtatcagttagcaggaagctgtgcagtcgctgcctggtcgttcactgtgacgtccattattttgcttgccatggacagaatcccatttctcagaatccgtctccacgaagacgaggaaatgttgggaaccgacttggcccaaattggtgaatatgcctattatgctgatgacgatcctgaaaccaacccatacgtcttggaacctatccgttctactactataagccaaccattacctcatattgatggtgttgctgatgggtctagtaataacgactcaggagaagctaaaaattaa

SEQ ID NO: 1795 - protein, 480 aa, Candida albicans SC5314
MSGNFTGTGTGGDVFKVDLNEQFDRADMVWIGTASVLVWIMIPGVGLLYSGISRKKHALSLMWAALMAACVAAFQWFWWGYSLVFAHNGSVFLGTLQNFCLKDVLGAPSIVKTVPDILFCLYQGMFAAVTAILMAGAGCERARLGPMMVFLFIWLTVVYCPIAYWTWGGNGWLVSLGALDFAGGGPVHENSGFAALAYSLWLGKRHDPVAKGKVPKYKPHSVSSIVMGTIFLWFGWYGFNGGSTGNSSMRSWYACVNTNLAAATGGLTWMLVDWFRTGGKWSTVGLCMGAIAGLVGITPAAGYVPVYTSVIFGIVPAIICNFAVDLKDLLQIDDGMDVWALHGVGGFVGNFMTGLFAADYVAMIDGTEIDGGWMNHHWKQLGYQLAGSCAVAAWSFTVTSIILLAMDRIPFLRIRLHEDEEMLGTDLAQIGEYAYYADDDPETNPYVLEPIRSTTISQPLPHIDGVADGSSNNDSGEAKN

SEQ ID NO: 1796 - DNA, 1605 bp, Candida albicans SC5314
  CDS (1)..(1605): transl_table=12
atgtcagcagaagaagtaatacaatacatttctagaaggaaattattcacggaaaataatgaatataatgaaagttatttattactatttacaattgcatcatcaatgatttggatcatgataccgggtttagcatttttatattctggattagcaagaagaaaatcggcattatcaatgatttggatagttataatgtcatcatttgttgggatcttccaatggtatttttggggttattcattagcatttagtgatacttcaaaaaattcatttattggtgatttacattttttcgggtttaaaaatttattaggtgcaagtgatgataaaacaacttatccagatatagcatattctttatttcaattacaattcttattagtgactttagcaattatagctggtggttgtattgctgaaagaggaagatttttaccagcattagtgtttatgttttgttgggccaccgtggtttattgtcccgtggtttattggatttggggtggtggttgggccctgtcgtatagatcaggtgctttagattatgctggtggtggccccgtggaaatcttatcgggtatgtcagcatttgtttattcagcatttttggggagaagaaatgaaactttaatgattaattatcgtcctcataatatttcgacaatttttttgggaacatcattattatatgttggttggttatttttcaatggattttcttgtggtaatccttcacttaaagtagcttattcaatgatgaatactcatttatgtggagcttttggagccatatcttggtgtttattggatttccgtttggaaaataaatggtctatggtagcagtttgttctgggtgtatttctggtttagtggctgctactccttcttcaggaatgattccattatgggcatcagtaatattaggtattactgctgggatagtttgtaacttgtcgactaaaatcaaatatttattacatgttgatgattcattggatgtatgggcagagcacggtatggccggagttgttggattgattttcaatgcattatttggttcagctacagttattggttatgatggagttactgaccatcaaggtggttggattgatcataattggaaacaattatatattcaaattgtttatattttggccacaatggcttattcgggtgttgttactgccatattatgttttgtcattaataaaatccctggattacaccttagaatcgattataatggagaagaagctggtgttgatgaagatcaaattggtgaatttgcttatgattacgttgaagtgagaagagatttcttggattgggggattccaaccgttaatcctacttatcaaaacctgatcaatgatcaacaacaacaacaacagccagaggtacctgaaataacatcacaacagaagagaggtggtggattatctggaattgaagaagctgaagaaaaacaagtacaaggaataccaattaaaagacaaactcaaattattgatggtacaacaactcaaagtaattctgatacaacatcaaatacaagtatacaagagaagcatgatccagtggaatatcgtcccagttga

SEQ ID NO: 1797 - protein, 534 aa, Candida albicans SC5314
MSAEEVIQYISRRKLFTENNEYNESYLLLFTIASSMIWIMIPGLAFLYSGLARRKSALSMIWIVIMSSFVGIFQWYFWGYSLAFSDTSKNSFIGDLHFFGFKNLLGASDDKTTYPDIAYSLFQLQFLLVTLAIIAGGCIAERGRFLPALVFMFCWATVVYCPVVYWIWGGGWASSYRSGALDYAGGGPVEILSGMSAFVYSAFLGRRNETLMINYRPHNISTIFLGTSLLYVGWLFFNGFSCGNPSLKVAYSMMNTHLCGAFGAISWCLLDFRLENKWSMVAVCSGCISGLVAATPSSGMIPLWASVILGITAGIVCNLSTKIKYLLHVDDSLDVWAEHGMAGVVGLIFNALFGSATVIGYDGVTDHQGGWIDHNWKQLYIQIVYILATMAYSGVVTAILCFVINKIPGLHLRIDYNGEEAGVDEDQIGEFAYDYVEVRRDFLDWGIPTVNPTYQNSINDQQQQQQPEVPEITSQQKRGGGLSGIEEAEEKQVQGIPIKRQTQIIDGTTTQSNSDTTSNTSIQEKHDPVEYRPS

SEQ ID NO: 1798 - DNA, 1608 bp, Candida albicans SC5314
  CDS (1)..(1608): transl_table=12
atgtcagcagaagaagtaatacaatacatttctagaaggaaattattcacggaaaataatgaatataatgaaagttatttattactatttacaattgcatcatcaatgatttggatcatgataccgggtttagcatttttatattctggattagcaagaagaaaatcggcattatcaatgatttggatagttataatgtcatcatttgttgggatcttccaatggtatttttggggttattcattagcatttagtgatacttcaaaaaattcatttattggtgatttacattttttcgggtttaaaaatttattaggtgcaagtgatgataaaacaacttatccagatatagcatattctttatttcaattacaattcttattagtgactttagcaattatagctggtggttgtattgctgaaagaggaagatttttaccagcattagtgtttatgttttgttgggccaccgtggtttattgtcccgtggtttattggatttggggtggtggttgggccctgtcgtatagatcaggtgctttagattatgctggtggtggccccgtggaaatcttatcgggtatgtcagcatttgtttattcagcatttttggggagaagaaatgaaactttaatgattaattatcgtcctcataatatttcgacaatttttttgggaacatcattattatatgttggttggttatttttcaatggattttcttgtggtaatccttcacttaaagtagcttattcaatgatgaatactcatttatgtggagcttttggagccatatcttggtgtttattggatttccgtttggaaaataaatggtctatggtagcagtttgttctgggtgtatttctggtttagtggctgctactccttcttcaggaatgattccattatgggcatcagtaatattaggtattactgctgggatagtttgtaacttgtcgactaaaatcaaatatttattacatgttgatgattcattggatgtatgggcagagcacggtatggccggagttgttggattgattttcaatgcattatttggttcagctacagttattggttatgatggagttactgatcatcaaggtggttggattgatcataattggaaacaattatatattcaaattgtttatattttggccacaatggcttattcgggtgttgttactgccatattatgttttgtcattaataaaatccctggattacaccttagaatcgattataatggagaagaagctggtgttgatgaagatcaaattggtgaatttgcttatgattacgttgaagtgagaagagatttcttggattgggggattccaaccgttaatcctacttatcaaaacctgatcaatgatcatcaacaacaacaacagccagaggtacctgaaataacatcacaacagaagagagtaggtggtggattatctggaattgaagaaactgaagaaaaacaagtacaaggtataccaattaaaagacaaactcaaattattgatggtacaacaactcaaagtaattctgatacaacatcaaatacaagtatacaagagaaacatgatccagtggaatatcgtcccagttga

SEQ ID NO: 1799 - protein, 535 aa, Candida albicans SC5314
MSAEEVIQYISRRKLFTENNEYNESYLLLFTIASSMIWIMIPGLAFLYSGLARRKSALSMIWIVIMSSFVGIFQWYFWGYSLAFSDTSKNSFIGDLHFFGFKNLLGASDDKTTYPDIAYSLFQLQFLLVTLAIIAGGCIAERGRFLPALVFMFCWATVVYCPVVYWIWGGGWASSYRSGALDYAGGGPVEILSGMSAFVYSAFLGRRNETLMINYRPHNISTIFLGTSLLYVGWLFFNGFSCGNPSLKVAYSMMNTHLCGAFGAISWCLLDFRLENKWSMVAVCSGCISGLVAATPSSGMIPLWASVILGITAGIVCNLSTKIKYLLHVDDSLDVWAEHGMAGVVGLIFNALFGSATVIGYDGVTDHQGGWIDHNWKQLYIQIVYILATMAYSGVVTAILCFVINKIPGLHLRIDYNGEEAGVDEDQIGEFAYDYVEVRRDFLDWGIPTVNPTYQNSINDHQQQQQPEVPEITSQQKRVGGGLSGIEETEEKQVQGIPIKRQTQIIDGTTTQSNSDTTSNTSIQEKHDPVEYRPS

SEQ ID NO: 1800 - DNA, 1587 bp, Ustilago maydis 521
  CDS (1)..(1587)
atggtcaacatcacttacggtgtgcttcaagcacccgatggctcctcggctacctcgagcgccatcgccaacggaactgacattatcgtttcttacggcccaaatggcgagagcgtcgcttcctattcgcccggtgacatttcctgggttctcacatgtaccgctctcgtatggctcatgattcccggtctcggttacctctactctggtcttgctcgcagaaagaacgcgcttcacctccttttgctcactttggccgctctcgccgttgtctcgttccagtggttcttttggggctactcgctcaccttttctcaaacctcaggcgctttcctcggcaatctgcgcaactttggctacatgggtgttctcgaaaatcccgtgcctcaggcatacaacaaagtgcccgaaattgtatacgccatctaccagtgcatgttcgccaaccttgtccccgccatcgccatcggtgccgcttgtgagcgtggccgtgtctggcctttcctcgtctttacctttgtctggaccacgctcgtctacgatgtgatcgcctgctgggtctggaaccccaccggttgggcgttcaagtggggtgttcttgactacgccggtggtggacccgtcgagattaactcgggtatcactggtctcgtcatctcttactatcttggccctcgtaccggttatggcaccgagcgtctactcttcaagccacacaacgtttcctacatcttcctgggcaccgccttcctctggttcggctggatcggcttcaacggtggttcggtctttgctgccaacctccgtgcggctatggccatcagcaccaccaacctcgccgcttcgtccgccggtctcacctggatgttcctcgactggcgtctcgaacgcaagtggtccgtcgttggcttctgcacgggtgccattgctggtctcgtcgccatcactcccgctgctggctttgtcggcatgcccgctgctttgctcgtcggagtcgtttcctcggccgtttccaactttgccaccgttctcaagggccccatgcgcgttgacgatgtcatggacattttctcggtccacgctctcgccggtattgttggcacccttctcaccggtatcttcgcccaggcttccgtagccaacaacgacggcaacacggtcatcgccggtggctggctcgactcaaactggatccagctcgcctatcaactcgcctactgtgtcgctgtcacctgttggtgtggtggcgtcacgtttgctatcatgtttgttattgaccacattccttacatcggtcccttccgttcgagcgagatgggtgaagtggtgggtatggatgaggaccagtgtggcgagtgggcttacgactacgcctttatcaaccgtgatcttgagggcaactacaagcccgaccacggtcagacgctcgacatcaacgaaaagatgcccaacgttcatcaaaccgactcgctgcgctccgaaacgcacgccgactcgagccaagacaactccaactcgcagctcgccgctgccgaacaccagtctccatccaccgctgaaccagccgtggaaatgaagcaggcttaa

SEQ ID NO: 1801 - protein, 528 aa, Ustilago maydis 521
MVNITYGVLQAPDGSSATSSAIANGTDIIVSYGPNGESVASYSPGDISWVLTCTALVWLMIPGLGYLYSGLARRKNALHLLLLTLAALAVVSFQWFFWGYSLTFSQTSGAFLGNLRNFGYMGVLENPVPQAYNKVPEIVYAIYQCMFANLVPAIAIGAACERGRVWPFLVFTFVWTTLVYDVIACWVWNPTGWAFKWGVLDYAGGGPVEINSGITGLVISYYLGPRTGYGTERLLFKPHNVSYIFLGTAFLWFGWIGFNGGSVFAANLRAAMAISTTNLAASSAGLTWMFLDWRLERKWSVVGFCTGAIAGLVAITPAAGFVGMPAALLVGVVSSAVSNFATVLKGPMRVDDVMDIFSVHALAGIVGTLLTGIFAQASVANNDGNTVIAGGWLDSNWIQLAYQLAYCVAVTCWCGGVTFAIMFVIDHIPYIGPFRSSEMGEVVGMDEDQCGEWAYDYAFINRDLEGNYKPDHGQTLDINEKMPNVHQTDSLRSETHADSSQDNSNSQLAAAEHQSPSTAEPAVEMKQA

SEQ ID NO: 1802 - DNA, 1464 bp, Ustilago maydis 521
  CDS (1)..(1464)
atggttaacgccagctacacgcccagcggcgatctgatcacctactacgatgaccaaggcacgcccaccgaactcatctataacctcggcaacatgtcgtggatcattgtttcgaccgccttggtctttatcatgattcccggtcttggtttcttctacgccggtctgctcagaaagaagtcggcgctctcgatgatctggatgtccatggtgattttgtcggtcgcatccttcgagtggttcttctggggcttttctctcgctttctccaccagctctagcaacaagttcattggtaaccttgacaactttggtctgatcaacgtcgacattgggccttctacaggagggaccgggcttccacagctgctcttctgcatctaccagatgatgttcgccgccatcacccctgtgattgcctgcggtgcgtttgccgaccgtgctcgattgggtcccgttctcattttcgccttctgctggtgcactattgtctacaatcccatcgcctattggacatggaacgtcggcaagggttgggccaacgtcatgggtggtctcgacttcgccggtggtacacctgttcacatctcttcgggtaccgctgcgctcgccatctcgatcttcctcggcaagcgtaaggggtacggcacggagcagttggcctaccgaccccacaacgttgcctacgtcatcttgggaaccgtgctgctgtggtttggctggttcggcttcaacggtggttcggctcttggtgccaaccttcgtgctgttcaggccatgatggtcactcaggtggctacctcggtcggtggtctcacctggatgttctgggactggaggctggagcgcaagtggtcggctgtcggtttctgctctggtgccatctcgggtctggtcgctatcacgccagcttctggttacgtcggaacgcccgcagctgttgcctttggcgtgctcggtggtacggcttgcaactttgccactggtctcaagaaccttttcggttacgatgatgctctcgacatctttgctgctcacggtattggtggtattgtgggcaacttgcttactggtatctttgccgacaaccgcgttgcgtcgtttgacggtaccgctccgatccctggtggttggatcaacaagaactggattcagcttggttatcagcttgccgactcggctgccggtttcggttggtcgtttgtggttacgctcatcctgctgttcgccatcgaccgcatccctggctgccacttccgatctagcgaggaggacgagtctctgggtatcgatctcactcagatcggagaagaggtcatggtgatgcctctgcttcacgactttgttcgcccagaggacggcgcagagattcatcacgctactgcatccaccgatctcaagttctcgcctgctcacagcgagaaggacctcgaggctgctcgtccacagcctactgctgtctaa

SEQ ID NO: 1803 - protein, 487 aa, Ustilago maydis 521
MVNASYTPSGDLITYYDDQGTPTELIYNLGNMSWIIVSTALVFIMIPGLGFFYAGLLRKKSALSMIWMSMVILSVASFEWFFWGFSLAFSTSSSNKFIGNLDNFGLINVDIGPSTGGTGLPQLLFCIYQMMFAAITPVIACGAFADRARLGPVLIFAFCWCTIVYNPIAYWTWNVGKGWANVMGGLDFAGGTPVHISSGTAALAISIFLGKRKGYGTEQLAYRPHNVAYVILGTVLLWFGWFGFNGGSALGANLRAVQAMMVTQVATSVGGLTWMFWDWRLERKWSAVGFCSGAISGLVAITPASGYVGTPAAVAFGVLGGTACNFATGLKNLFGYDDALDIFAAHGIGGIVGNLLTGIFADNRVASFDGTAPIPGGWINKNWIQLGYQLADSAAGFGWSFVVTLILLFAIDRIPGCHFRSSEEDESLGIDLTQIGEEVMVMPLLHDFVRPEDGAEIHHATASTDLKFSPAHSEKDLEAARPQPTAV

SEQ ID NO: 1804 - DNA, 1491 bp, Cryptococcus neoformans var. neoformans B-3501A
  CDS (1)..(1491)
atggtcaacgtgacctatacagactcgtcttcggacatgatttacactgccgacgatggcactcagtatctttacaatctcggtgacatgtctttcgtcatcgccgccatggccctcgtctggatcatggttcccggtgtcggtctcttttactctggcctgttaagacggaagaatgcattatcaatgatcttcctgtctatggctggtgttgccgtcgggtctttccagtggttcttctggggttactcacttgctttttctgatactggttccaaatacattggcgacttgcgatactttggtctgaagggagttctcgcagagccttctgccggttctgaccgaatccctgctcttctcttctgtgtctaccaatgcatgttctgccttatcactggtgtcctcgccattggtggtttcgctgaacggtctcgtatcggtcccgttatggtcttcctcttctgctggctcaccctcgtctactgccctctcgcttgctggacatggaaccccaacggctggtcttttgtcatgggcggtctcgactttgctggtgggacccccgttcacatctcttctggtactgcctctctggctatcgccttgtacctcggcaagcgtcgaggctacggcactgaacgactcgcctacaagccccacaacactgctttcgttgttatcggcaccgttttcctctggttcggttggttcggcttcaatggtggttccgctctttctgccaacttgagggctgttcaggcttgtatcgtcaccaacctttctgcctctgtcggtggtttggtctggatgttcttggactacaggcttgaacgcaaatggtccgctgttggcttctgctccggtgctatttctggtttggtcggtatcacccctgctgctggctacgtcggttccccagctgctcttgccatcggtgcgattaccgccatcgcctgtaactttgccaccaagctcaagtttctcattggcgttgatgagactctcgatgtctttgcttctcacgggattggcggcatggtcggttgcttccttaccggtctcttcgcccaaggttctgtggccggctttgacggtatcaccgatatccccggtggctgggtcagccattactggatacaggctggttaccagatggccgatttgaccgctggtttcgcttacacctttgtcatgaccaccatcatctgctggttacttcacttcatccctggattgaggttgagggctagcgaagaggccgaaatcatcggtattgacgatgcttacctcggcgaatttgcttacgactatgttggcacagatcccgagctccgtcttcacagaattgactccaagccccaattcacttcaggggacgttattgctgaagtttctgccagcaacgggcatgagtctagcaccaccgaaaaggttgaccctcacgcgacgggtaacgccgctgcaggtggtggacgtgtcgatgtttaa

SEQ ID NO: 1805 - protein, 496 aa, Cryptococcus neoformans var. neoformans B-3501A
MVNVTYTDSSSDMIYTADDGTQYLYNLGDMSFVIAAMALVWIMVPGVGLFYSGLLRRKNALSMIFLSMAGVAVGSFQWFFWGYSLAFSDTGSKYIGDLRYFGLKGVLAEPSAGSDRIPALLFCVYQCMFCLITGVLAIGGFAERSRIGPVMVFLFCWLTLVYCPLACWTWNPNGWSFVMGGLDFAGGTPVHISSGTASLAIALYLGKRRGYGTERLAYKPHNTAFVVIGTVFLWFGWFGFNGGSALSANLRAVQACIVTNLSASVGGLVWMFLDYRLERKWSAVGFCSGAISGLVGITPAAGYVGSPAALAIGAITAIACNFATKLKFLIGVDETLDVFASHGIGGMVGCFLTGLFAQGSVAGFDGITDIPGGWVSHYWIQAGYQMADLTAGFAYTFVMTTIICWLLHFIPGLRLRASEEAEIIGIDDAYLGEFAYDYVGTDPELRLHRIDSKPQFTSGDVIAEVSASNGHESSTTEKVDPHATGNAAAGGGRVDV

SEQ ID NO: 1806 - DNA, 1293 bp, Leptospira interrogans serovar Copenhageni str. Fiocruz L1-130
  CDS (1)..(1293): transl_table=11
ttggggataggaatgattatgaaatggaccaagagactgctcttattgctcaccctacttcttccatttgttttatttgggcaagaagctagcactcccgtagcggacaaaggagatacggtctggatgattgtagcatccgccctcgtattttttatgatacctgggcttgcattgttttatggaggtcttgtaagatctaaaaacgttctttcgactatgatgcatagttttgtagcaatcttagttttgaccctgcagtggaccatctttggatatagtttcgctttttccggaaccaatccttatttcggaaactttgatcttgcctttctaaatggaatcgatgaaaacactttagaattaacaattcctaaatatattcactttctttttcaaggtatgttcgcattaatcacacccgccttaatttctggagcaattgcagaaagagtaaaattcggcggttatataatttttattcttctttggtccactcttgtttatgatccagttgcacattgggtttgggcggcagacggttggctttttaaaatgagcgctttagattttgctggtggaaccgtagttcatcttatctcaggaattgcaggtcttgcagccgcaatcgttctgggtaaaagaaaaggagaaggacccgctctgatcgctcccaacaatcttacttatactttaatcggagccggtttactttggttcggttggttcggttttaacgctgggtccggacttgcggtaaacggaattaccgccagagcatttttagttactttaatcgcacctgcagccgcaggagttgcttggcttgtaatcgaatatttccatactaaaaaagcaaccgccctcggagccgcttcgggtattgtggccggtttggttgtaattactcccgcttctggttttgtaggagttcaaggagcaatcatcatgggacttcttgtaagtccggtatgctacgcagcgattcttttaaaaggaaaactaggatacgatgatagtttggacgcatttggaattcacggcgtaggtggtgcgttaggcgcggttcttacaggagttttcactcttacactcggcgcaggtgttgcgagtaaaggagatcaaattttggttcaactcattagcgtcgctgcaaccggagcttattcttttatcgtttctatgattctagtatttttgatcgataaaacaatcggctttcgtatttccgaagaaaaagaaattactggactggattcggaaattcacggagaaaaaggttatatcctttaa

SEQ ID NO: 1807 - protein, 430 aa, Leptospira interrogans serovar Copenhageni str. Fiocruz L1-130
MGIGMIMKWTKRLLLLLTLLLPFVLFGQEASTPVADKGDTVWMIVASALVFFMIPGLALFYGGLVRSKNVLSTMMHSFVAILVLTLQWTIFGYSFAFSGTNPYFGNFDLAFLNGIDENTLELTIPKYIHFLFQGMFALITPALISGAIAERVKFGGYIIFILLWSTLVYDPVAHWVWAADGWLFKMSALDFAGGTVVHLISGIAGLAAAIVLGKRKGEGPALIAPNNLTYTLIGAGLLWFGWFGFNAGSGLAVNGITARAFLVTLIAPAAAGVAWLVIEYFHTKKATALGAASGIVAGLVVITPASGFVGVQGAIIMGLLVSPVCYAAILLKGKLGYDDSLDAFGIHGVGGALGAVLTGVFTLTLGAGVASKGDQILVQLISVAATGAYSFIVSMILVFLIDKTIGFRISEEKEITGLDSEIHGEKGYIL

SEQ ID NO: 1808 - DNA, 1341 bp, Thermus thermophilus HB27
  CDS (1)..(1341): transl_table=11
atgcggaaaggaaccctcaacggcatcgcggccctaggtttatcgggactggccctggcggagggggtagacggggcggacacggcctggatgctggtctccacggccctggtcctcctcatgaccccggccctggccttcttctacggggggctcgtccggagcaaaaacgccttgaacaccatgatgatgagcttcgtcgccctggccttcgtgggcgtgggctgggcgctcctcgggtacaccctggccttcggggagggcggccccctcctggggggtctcgggcacctcttcctcaggggggtgggcctcgaggcccaaggcaccatcccccacgtcctcttcctggccttccaggggaccttcgccattatcaccgccgccctggtctcgggcgctctggtggagaggatgcgctttcccgcctacctggccttcctcaccctctgggggcttttcgtctacgccccgatcgcccactgggtctggggcggggggtttttgggggccctaggcgccctggacttcgccggagggacggtggtgcacatcaacgccggcgtcgccgccctggtgggcgccctggtcctcggcgcgcggaaggactacgggcggcaggccattctgccccataacgtccccttcaccctcctgggggcagccctcctctggttcggctggttcggcttcaacgggggaagcgccctggcggccaacgcctcggcggccctggccttcgcgaacaccatgctggcccccgcggccaccctcttggtctggaccctcctggacctcctccgcaccggcaaggccacggcggtgggggcggccacggccatcgtggtgggcctggtggccgtgaccccggccgcaggcttcgtctcccctctctccgccctcctcatcggggcgcttgccgccttccccagctactacgtcctcctctggcgggcgaggacccggctggacgacagcctggacgtcttcgccggccacggggtcggggggatcaccggggccctcctcaccggcatcttcgccgagaaagcctggaacggggtggcggacggcctcctcttcggcaatcccgcgcagctcgggatccaggcggcggcggtcctggccgccgtcgtgtactccgccttgggaaccttcgccctcctcaagctggtgggcctcctcacccccttgcgggcaggccccaaggaggaaggggtgggcctggacgtgacccagcacggcgaggaggcctacacctcgggcgagggggcgatcctcgtcctctcggaaaaggcccccgcggtcccgagcctcaggccccagggaggtgaggcatga

SEQ ID NO: 1809 - protein, 446 aa, Thermus thermophilus HB27
MRKGTLNGIAALGLSGLALAEGVDGADTAWMLVSTALVLLMTPALAFFYGGLVRSKNALNTMMMSFVALAFVGVGWALLGYTLAFGEGGPLLGGLGHLFLRGVGLEAQGTIPHVLFLAFQGTFAIITAALVSGALVERMRFPAYLAFLTLWGLFVYAPIAHWVWGGGFLGALGALDFAGGTVVHINAGVAALVGALVLGARKDYGRQAILPHNVPFTLLGAALLWFGWFGFNGGSALAANASAALAFANTMLAPAATLLVWTLLDLLRTGKATAVGAATAIVVGLVAVTPAAGFVSPLSALLIGALAAFPSYYVLLWRARTRLDDSLDVFAGHGVGGITGALLTGIFAEKAWNGVADGLLFGNPAQLGIQAAAVLAAVVYSALGTFALLKLVGLLTPLRAGPKEEGVGLDVTQHGEEAYTSGEGAILVLSEKAPAVPSLRPQGGEA

SEQ ID NO: 1810 - DNA, 1209 bp, Desulfovibrio vulgaris subsp. vulgaris str. Hildenborough
  CDS (1)..(1209): transl_table=11
atgaacgcggccgataccgccttcatccttatctgcgcggcactggtgatgttgatgactcccggcctcgccctgttctatggcggcctcgtcagggccaagaacgtgctctcgacaaccatgcacagtttcgttctcgtgggcgtggcctcggtggtgtgggccatcatcgggtatacactcgccttcgggccggatgtggcaggtgtcatcggaggactcgaccacctgttcctcaaaggtgtgggcatggaaccttcagaggctgccaagaccataccgcatctcgcgttcatggtgttccagtgcatgttcgcggtcatcacgcccgcgctcatctcgggtgcctatgccgagcgtatcagtttccgggccatgctgctgttctcggtgctgtggcttgttctggtgtacgcgcccatggcccactgggtgtggggcgggggctggatgttcaagatgggtgcgctcgactttgccggtggcgcggtcgtgcacatgagttctgccgctgccgcgcttgccgccgcgcatgtgctcggaagacgcgagggctatggccgtgaacccttcgtgccccataaccttcccatgacggttctcggtgcgggcatcctgtggttcggctggttcggcttcaatgcgggtagcgcccttgccgccaatggtcttgccgccatggccttcgtcaccacgcaccttgccaccgccgcaggcgtcatgggctggctcgccgtagagtggatgcatagcggcaagcccaccacgctgggtgctgcctccggtgccgttgccggtctcgttgccatcacgcccgctgctggcttcgtagaacccatgcccgccatgatcatcggtttcgggggcgggatgctctgctacggcggcgttctgatgaagaaggtcttcaagtacgacgacgcgctcgacgtggtcggcgtgcatggcgtgggcggtacgtggggtgcccttgcaacgggattgttcgccagcgaggccgtgaacggcgtcaatggtctcttctacggcaatcccggtcagctgtggacgcagttcctttcggtggtggctacctggctgttctgctacctcatgagtcgcggtatcttccacgcggtggacgccctgatggggctgcgcgtgacggtcgatgccgaacgcgcgggactggatgtgagcgaacacaacgagcgggcctacgagcagtaa

SEQ ID NO: 1811 - protein, 402 aa, Desulfovibrio vulgaris subsp. vulgaris str. Hildenborough
MNAADTAFILICAALVMLMTPGLALFYGGLVRAKNVLSTTMHSFVLVGVASVVWAIIGYTLAFGPDVAGVIGGLDHLFLKGVGMEPSEAAKTIPHLAFMVFQCMFAVITPALISGAYAERISFRAMLLFSVLWLVLVYAPMAHWVWGGGWMFKMGALDFAGGAVVHMSSAAAALAAAHVLGRREGYGREPFVPHNLPMTVLGAGILWFGWFGFNAGSALAANGLAAMAFVTTHLATAAGVMGWLAVEWMHSGKPTTLGAASGAVAGLVAITPAAGFVEPMPAMIIGFGGGMLCYGGVLMKKVFKYDDALDVVGVHGVGGTWGALATGLFASEAVNGVNGLFYGNPGQLWTQFLSVVATWLFCYLMSRGIFHAVDALMGLRVTVDAERAGLDVSEHNERAYEQ

SEQ ID NO: 1812 - DNA, 1206 bp, Listeria monocytogenes str. 4b F2365
  CDS (1)..(1206): transl_table=11
atggaatcagtatttatgttcttttgtactttattggtttggttaatgacaccaggtattgcattattttacggtgggatggttcgacgcaaaaatgtgttgagtacggccatgtatagttttagttcaatggcaattatatctatcctttgggtgatagttgggtattcattagctttcgcccctggaaacggctttataggaagttttgactggaccttcctccataatgttggcttcgcagcaaacgatacttactcagatgctattccacatattctattcatgatgtttcaaatgactttcgcaattttgactgtagctatcatttctggggcatttgcagaaagaatgaatttctccgcttatttgattttcattatcttatggtcgttacttgtttattcccctgttgctcactgggtttggggtgacggtggttggttacgtaatctcggtgcacttgatttcgccggtgggaatgttgttcatattagttcaggtgtaacagggttagttcttgcaattatgattggacgtagaaaagaagccgattctgcttcacctcataatttacctttagcgcttattggtggtattctagtttggtttggttggtatggttttaatgttggtagcgcccttacaattgataatgtggctatgatagcttttgttaatacgaatacagctgctgctgcaggtattatcggttggggtttggttgaatggttgacgaataaaaagccaactatgcttggaaccatttccggagcaattgctggtttagtatccattacccctgccgctggatttgttaccgttccaagttcacttatcattggtttcctcggcggagcactatgcttctgggctgtgttctggttgaaaggaaaagtaaaatatgatgatgcacttgatgcattcggacttcatggaatcggaggtatttggggtggtatcgcaaccggccttttcgccacaacaaaagtaaatgaagctggagcagacggattattctacggcaatgcttctctcgtagtaaaacaattaatcgccattggttcaacggtagcatatgtggctatagcgacagcaataatcgtcgtaattatcaaactatttttaccaatccgtgtaaacgaagaacaagaatataaaggacttgatttgacgctgcacggcgaaaaagcatatcaagaataa

SEQ ID NO: 1813 - protein, 401 aa, Listeria monocytogenes str. 4b F2365
MESVFMFFCTLLVWLMTPGIALFYGGMVRRKNVLSTAMYSFSSMAIISILWVIVGYSLAFAPGNGFIGSFDWTFLHNVGFAANDTYSDAIPHILFMMFQMTFAILTVAIISGAFAERMNFSAYLIFIILWSLLVYSPVAHWVWGDGGWLRNLGALDFAGGNVVHISSGVTGLVLAIMIGRRKEADSASPHNLPLALIGGILVWFGWYGFNVGSALTIDNVAMIAFVNTNTAAAAGIIGWGLVEWLTNKKPTMLGTISGAIAGLVSITPAAGFVTVPSSLIIGFLGGALCFWAVFWLKGKVKYDDALDAFGLHGIGGIWGGIATGLFATTKVNEAGADGLFYGNASLVVKQLIAIGSTVAYVAIATAIIVVIIKLFLPIRVNEEQEYKGLDLTLHGEKAYQE

SEQ ID NO: 1814 - DNA, 1233 bp, Bacillus anthracis str. Sterne
  CDS (1)..(1233): transl_table=11
atgaatatgggagatacggtttttatgtttgtagcgacagtaatggtcatgttaatgacaccaggattggcacttttttatggaggtatggttcgcagtaaaaacgtactcagtacgacaatgcatagttatagcgcgatggctatcgtttcgattcaatggattgtaattggttattctttatcattcggaccagattggcacggacttatcggcacactcgattggttcggtttaaatggagttacctacgcaccaaatccagactattcatctactattcctcacaatttatttatgatgtttcaactcatgttcgctattttaactcctgctttaatttcaggtgcatttgccgaaagaatgcgattttcagctttccttattttcatccttctatggacaacgatcgtttacaatcctgtcgctcattgggtatggggcgttggcggatggctaagagaacttggcgcgttagacttcgctggcggtaatgtcgttcatattacatctggtgtggctggcctcgtattagctattttccttggaaaacgaaaaaacataaacggtacttctcctcatcatttaccatttacgatgctaggcgctgggctgctatggttcggttggttcggttttaacgtcggaagcgcattatctttaaatgatgtagctttaactgcatttattaatacgaatatagccgctgctgcctccgcattaacttggatgctttcagagtggttctttcaatcaaaaccaactgcgatgggagctgcttgtggcgccgtttccggtctagtcgctattacaccagcttgcgggttcgttacacctttctccgctcttcttatcggagcgattggcggcgtattatgcttcggagcagtctttttcttaaaaacaaaattcggatacgacgatacactcgatgcattcggatgtcacggcatcggcggaacttggggcggtattgcgacaggactatttgcaactactaccgtaaacggcgatggcgctaacggattattttacggaaacgccgcgttgctgtttaaacaatttgtagcaatcggcgcaacatatgcattcacaattataatgacgtacgccattattaaagcaatcaacttcttcctccctgtccgggtcgatgagcacgaggaacatatgggacttgatatttcgatgcatggagagaaagcttatgagtatactgagcgagtgaactaa

SEQ ID NO: 1815 - protein, 410 aa, Bacillus anthracis str. Sterne
MNMGDTVFMFVATVMVMLMTPGLALFYGGMVRSKNVLSTTMHSYSAMAIVSIQWIVIGYSLSFGPDWHGLIGTLDWFGLNGVTYAPNPDYSSTIPHNLFMMFQLMFAILTPALISGAFAERMRFSAFLIFILLWTTIVYNPVAHWVWGVGGWLRELGALDFAGGNVVHITSGVAGLVLAIFLGKRKNINGTSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTTVNGDGANGLFYGNAALLFKQFVAIGATYAFTIIMTYAIIKAINFFLPVRVDEHEEHMGLDISMHGEKAYEYTERVN

SEQ ID NO: 1816 - DNA, 1233 bp, Bacillus thuringiensis serovar konkukian str. 97-27
  CDS (1)..(1233): transl_table=11
atgaatatgggagatacggtttttatgtttgtagcgacagtaatggtcatgttaatgacaccaggattagcacttttttatggagggatggttcgcagtaaaaacgtactcagtacgacaatgcatagttatagtgcaatggctatcgtttcgattcaatggattgtaattggttattctttatcattcggaccagattggcacggacttatcggcacactcgattggttcggtttaaatggagttacctatgcaccaaatccagactactcatctactattcctcacaatttatttatgatgtttcaactcatgttcgctattttaactcctgctttaatttcaggtgcatttgccgaaagaatgcgattttcagctttccttattttcatccttctatggacaacgatcgtttacaatcctgttgctcattgggtatggggcgttggcggatggctaagagaacttggcgcgttagacttcgctggcggtaatgtcgttcatattacatctggtgtggctggcctcgtattagctattttccttggaaaacgaaaaaacataaacggtacttctcctcatcatttaccatttacaatgctaggcgctgggctgctatggtttggttggttcggttttaacgtcggaagcgcattatctttaaatgatgtggctttaactgcatttattaatacgaatatagccgctgctgcctccgcattaacttggatgctttcagagtggttctttcaatcaaaaccgactgcgatgggagctgcttgtggcgccgtttccggtctagtcgctattacaccagcttgcgggttcgttacacctttctccgctcttcttatcggagcgattggcggcgtattatgcttcggagcagtctttttcttaaaaacaaaattcggatacgacgatacactcgatgcattcggatgtcacggcatcggtggaacttggggcggtattgcgacaggattatttgcaactactgccgtaaacggcgatggcgctaacggattattttacggaaatgccgcgttgctgtttaaacaacttgtagcaatcggcgcaacatatgcattcacaattatcatgacgtacgccattattaaagcaatcaacttcttcctccctgtccgggtcgatgagcacgaggaacatatgggacttgatatttcgatgcatggggagaaagcttatgagtatactgagcgagtgaactaa

SEQ ID NO: 1817 - protein, 410 aa, Bacillus thuringiensis serovar konkukian str. 97-27
MNMGDTVFMFVATVMVMLMTPGLALFYGGMVRSKNVLSTTMHSYSAMAIVSIQWIVIGYSLSFGPDWHGLIGTLDWFGLNGVTYAPNPDYSSTIPHNLFMMFQLMFAILTPALISGAFAERMRFSAFLIFILLWTTIVYNPVAHWVWGVGGWLRELGALDFAGGNVVHITSGVAGLVLAIFLGKRKNINGTSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTAVNGDGANGLFYGNAALLFKQLVAIGATYAFTIIMTYAIIKAINFFLPVRVDEHEEHMGLDISMHGEKAYEYTERVN

SEQ ID NO: 1818 - DNA, 1401 bp, Acinetobacter sp. ADP1
  CDS (1)..(1401): transl_table=11
atgaaaaaaatgcttttagcgctaagtctatctggtgcgcttttaggtggttcggctgcgtgggcagaaaatgcggcatcagcaccggcaactgaagaaacaacaaccgttgtagctacaacgactgaagcacctgtaactggctcggcagaagcaccttccgccgctactgctacaccagcgccagcagcaacacccaaaatggattcgggtgatacagcatggattctgatttctactgctttagttcttttaatgaccattcctggtttagcacttttttatggtggtatggtacgtaagaaaaacgtattaagcactatggcacatagctttgtcgctgctgcaattgtcagtattgtttgggtggtgattggttataccttggcatttagtactacaggcaatgcctttgttggtggtctggataaaatcatgctgtcgggtattaccacagaggccttgagtggtaccattcctgagattctttttgttattttccaaatgacctttgcgattattactgttgccattattagtggctcggttgctgaacgtatgaagtttggagcctttgttgcatttatcaccatttgggtcatcgtggtgtatgcgccaattacccactgggtatggggtggtggctggttgggtagcgatggcgcacttgactttgctggtggtaccgttgttcatatcaattcgggtgttgctggtctggttgctgcgtatatgctcggtaagcgtattgggctgggtaaagaatcaatggcaccacacaaccttgcactcacagtgattggcgcaagcttgctctgggtaggttggttcggtttcaatggtggttctgcacttgctgcaaatggtgctgcaggctatgccttggtgacgactcaggttgcagcagcagcagcggcaatttcttggggtattgttgagaaaattgttcgcggtaaaacttcattgcttggtcttctttcaggtgcagttgcaggtctggttgtgattacaccggctgcaggctttgttactgtaagtggcgcgttgatcatgggattgattggtggtgtcgtttgcttctggggaatttctggcctaaaacgtatgttgaaagcagacgactcattggatgcatttggtctgcatgccgtaggtggtatggcaggtgcaatcttgacggctgtatttgcaagtccattcatcatgggtgacaaagcgccagcaagtgtgacacatcagctctggattcaaatagaaggtgtattggctacaattgcatatagtgctgtgttgacctttattatcttgaaagtcattgatgtcgtgattggaattcgtgctaactctgatgatgagcgtatgggtctcgatttgagccagcatggcgaacgtgtagaataa

SEQ ID NO: 1819 - protein, 466 aa, Acinetobacter sp. ADP1
MKKMLLALSLSGALLGGSAAWAENAASAPATEETTTVVATTTEAPVTGSAEAPSAATATPAPAATPKMDSGDTAWILISTALVLLMTIPGLALFYGGMVRKKNVLSTMAHSFVAAAIVSIVWVVIGYTLAFSTTGNAFVGGLDKIMLSGITTEALSGTIPEILFVIFQMTFAIITVAIISGSVAERMKFGAFVAFITIWVIVVYAPITHWVWGGGWLGSDGALDFAGGTVVHINSGVAGLVAAYMLGKRIGLGKESMAPHNLALTVIGASLLWVGWFGFNGGSALAANGAAGYALVTTQVAAAAAAISWGIVEKIVRGKTSLLGLLSGAVAGLVVITPAAGFVTVSGALIMGLIGGVVCFWGISGLKRMLKADDSLDAFGLHAVGGMAGAILTAVFASPFIMGDKAPASVTHQLWIQIEGVLATIAYSAVLTFIILKVIDVVIGIRANSDDERMGLDLSQHGERVE

SEQ ID NO: 1820 - DNA, 1293 bp, Erwinia carotovora subsp. atroseptica SCRI1043
  CDS (1)..(1293): transl_table=11
atgaaaatgaaaaaactactctcttcattaggtctcggtgtggcggcattactcccgtcctgggcaatggctgcgacaccgacaattgataaagcggataacgcttttattatgatttgtaccgtgttggtactttttatgactataccaggcatcgcactgttttatggcggcctgatccgttcgaagaacgtactgtccatgatgacgcaggtgagtgtaacgttcgcgatggtctgtatcttgtgggtggtttacggatatagcctggccttcagtgaaggtaacgccttcttcggtggtttcagtacgtttatgctgaaaggcatcgggattgagtccatcagcggtacctactatcagtttgtgcatgtggcttatcaggcttccttcgcctgtatcaccgttgcgttgattgtcggggcgatcgctgagcgtattcgtttctctgcggtgctgatttttgttgggctgtggctgacgttctcctacctgccgatgacgcacatggtatggggcggtggctatctggctatggatggcgcgttagactttgctggcggtacggtcgttcacatcaacgccgcggttgctgggttggttggtgcttacctgctgggcaaacgtgctggctttggtaaagaagccttcaaaccgcataacctgccgatggtgtttattggtacggcgattctgtatatcggctggtttggtttcaatgcggggtctgcgggtgctgctaacggtgtcgccgctctggctttcctgaacactgttgttgcgactgctgctgcgattctggcatgggttggtggtgagtggttggtacgcggtaaaccttctctgctgggcgcgtgctctggctgtatcgcaggtctggtggcaattaccccagcagcgggtacggttggcgtgggtggcgccttgatcatcggtctggctggtggtgttgcgggcctgtggggcgtaacagtactgaaaagatggctgcgtgtggatgacccgtgtgatgtgttcggtgttcacggcgtgtgcggtatcgttggttgtatcttgacgggggtattcacgtcggcatcgctgggtggaacaggctatgctgaaggtgtgacaatggcgcaccaggtttgggtacagctgttcagcgtgattgtttgtctggtgtggtctggcgtggtggcatttgtcgccttcaaggttgcggatatgatcgttggtctgcgtgtacctgaagagcaagagcgcgaaggtctggacgttaacagccatggcgagagcgcttacaaccaataa

SEQ ID NO: 1821 - protein, 430 aa, Erwinia carotovora subsp. atroseptica SCRI1043
MKMKKLLSSLGLGVAALLPSWAMAATPTIDKADNAFIMICTVLVLFMTIPGIALFYGGLIRSKNVLSMMTQVSVTFAMVCILWVVYGYSLAFSEGNAFFGGFSTFMLKGIGIESISGTYYQFVHVAYQASFACITVALIVGAIAERIRFSAVLIFVGLWLTFSYLPMTHMVWGGGYLAMDGALDFAGGTVVHINAAVAGLVGAYLLGKRAGFGKEAFKPHNLPMVFIGTAILYIGWFGFNAGSAGAANGVAALAFLNTVVATAAAILAWVGGEWLVRGKPSLLGACSGCIAGLVAITPAAGTVGVGGALIIGLAGGVAGLWGVTVLKRWLRVDDPCDVFGVHGVCGIVGCILTGVFTSASLGGTGYAEGVTMAHQVWVQLFSVIVCLVWSGVVAFVAFKVADMIVGLRVPEEQEREGLDVNSHGESAYNQ

SEQ ID NO: 1822 - DNA, 1212 bp, Bacillus licheniformis ATCC 14580
  CDS (1)..(1212): transl_table=11
atgcagatgggggatacagtatttatgttcttttgcgctttgctcgtgtggctgatgacgccgggcatcgctttattttacggaggccttgtaaggagcaaaaatgtgctcagcaccgttatgcacagtttatcttcaattgccatcgtttctatcatatggattttgttcggctattcactcgctttcgctcccggaaacccattgatcgggggtttggattggatcggactgcacggtgtcggttttgaacccaatgccgattattcggagacgatcccgcatacgctttatatgatgttccaattgacatttgccgtcctgacgactgcgattatttccggaagctttgcggagcgcatgcgctttccggcctttattcttttctcggtgctctgggcggttttcgtttattcgcctgtcgcccactgggtatggggcggaggctggcttgacgagctgggagctattgattttgccggcggaaacgtcgttcacatttcttccggggtagccggtctggtcgttgcgattgttctcggcaagcggaaaaatatgagcgacaccgcccctcacaacctccttctgaccctgctcggggcgactttgatctggttcggatggttcggtttcaatgtcggaagcgcgctgacgatcgatgaagtcgccatgaccgcttttatcaacacgaatacggctgcggccgcggggctgatcggctggattttggcagaatggctgattaataagaagccgacgatgctcggcgccgtctcgggagcgattgcgggactcgtcgcgattacgcctggcgcaggttttgtcacgccattctcatctgtatggatcgggcttatcggaggaatcgtctgtttctggggggtgttttcgctcaagaaaaaattcgggtacgatgatgcgctcgatgccttcggacttcacgggctcggcgggacatggggcggaatcgcgacaggtttgttcgcgacgacatctgtcaacgcagacggtgccaacgggcttttttacggagacatcagtctcctttggaaacagctgattgcgattgctgcaacatatttgtttgtcgcaatcgtcacatacgctattattaagatagtcagtatcttttttaaactccgtgcctcagaggatgaagaatcattgggcctcgatcttacgctgcacggcgaaaaagcgtatcaagattaa

SEQ ID NO: 1823 - protein, 403 aa, Bacillus licheniformis ATCC 14580
MQMGDTVFMFFCALLVWLMTPGIALFYGGLVRSKNVLSTVMHSLSSIAIVSIIWILFGYSLAFAPGNPLIGGLDWIGLHGVGFEPNADYSETIPHTLYMMFQLTFAVLTTAIISGSFAERMRFPAFILFSVLWAVFVYSPVAHWVWGGGWLDELGAIDFAGGNVVHISSGVAGLVVAIVLGKRKNMSDTAPHNLLLTLLGATLIWFGWFGFNVGSALTIDEVAMTAFINTNTAAAAGLIGWILAEWLINKKPTMLGAVSGAIAGLVAITPGAGFVTPFSSVWIGLIGGIVCFWGVFSLKKKFGYDDALDAFGLHGLGGTWGGIATGLFATTSVNADGANGLFYGDISLLWKQLIAIAATYLFVAIVTYAIIKIVSIFFKLRASEDEESLGLDLTLHGEKAYQD

SEQ ID NO: 1824 - DNA, 1233 bp, Bacillus cereus E33L
  CDS (1)..(1233): transl_table=11
atgaatatgggagatacggtttttatgtttgtagcgacagtaatggtcatgttaatgacaccaggattagcacttttttatggagggatggttcgcagtaaaaacgtactcagtacgacaatgcatagttatagtgcaatggctatcgtttcgattcaatggattgtaattggttattctttatcattcggaccagattggcacggacttatcggcacactcgattggttcggtttaaatggagttacctacgcaccaaatccagactactcatctactattcctcacaatttatttatgatgtttcaactcatgttcgctattttaactcctgctttaatttcaggtgcatttgccgaaagaatgcgattttcagctttccttattttcatccttctatggacaacgatcgtttacaatcctgttgctcattgggtatggggcgttggcggatggctaagagaacttggcgcgttagacttcgctggcggtaatgtcgttcatattacatctggtgtggctggcctcgtattagctattttccttggaaaacgaaaaaacataaacggtacttctcctcatcatttaccatttacaatgctaggcgctgggctgctatggtttggttggttcggttttaacgtcggaagcgcattatctttaaatgatgtagctttaactgcatttattaatacgaatatagccgctgctgcctccgcattaacttggatgctttcagagtggttctttcaatcaaaaccgactgcgatgggagctgcttgtggcgccgtttccggtctagtcgctattacaccagcttgcgggttcgttacacctttctccgctcttcttatcggagcgattggcggcgtattatgcttcggagcagtctttttcttaaaaacaaaattcggatacgacgatacactcgatgcattcggatgtcacggcatcggcggaacttggggcggtattgcgacaggactatttgcaactactaccgtaaacggcgatggcgctaacggattattttacggaaacgccgcgttgctgtttaaacaacttgtagcaatcggcgcaacatatgcattcacaattataatgacgtacgccattattaaagcaattaacttcttcctccctgtccgggtcgatgagcacgaggaacatatgggacttgatatttcgatgcacggagagaaagcttatgagtatactgagcgagtgaactaa

SEQ ID NO: 1825 - protein, 410 aa, Bacillus cereus E33L
MNMGDTVFMFVATVMVMLMTPGLALFYGGMVRSKNVLSTTMHSYSAMAIVSIQWIVIGYSLSFGPDWHGLIGTLDWFGLNGVTYAPNPDYSSTIPHNLFMMFQLMFAILTPALISGAFAERMRFSAFLIFILLWTTIVYNPVAHWVWGVGGWLRELGALDFAGGNVVHITSGVAGLVLAIFLGKRKNINGTSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTTVNGDGANGLFYGNAALLFKQLVAIGATYAFTIIMTYAIIKAINFFLPVRVDEHEEHMGLDISMHGEKAYEYTERVN

SEQ ID NO: 1826 - DNA, 1335 bp, Burkholderia mallei ATCC 23344
  CDS (1)..(1335): transl_table=11
atggccgacgacgcgtcgtcggctcccgccgccgcatcggccgcaacggcttccgacacgtcggccggcgccgccgcgtccgccgcaccgaccgcgccgttctcggtcgattcgtcgaagatcaactcgggcgacaccgcgtggatgctcacgtcgaccgcgctcgtgctgttcatgacgatcccgggcctcgcgctcttctacggcggcatggtccgcaagaagaacgtgctcgcgaccgtgatgcagagcttcgcgatcaccgcgctgatcacggtcctctggacggtggtcggctacagcctcgcgttcacgccgggcaacggcttcatcggcggcttctcgcgcgtgttcctgtccgggatgaactacatccacggcgacaaggcgacgacgctcaccgtcagccatctcgcgtcgacgatcccggaatcggtctacttcgtctaccagatgacgttcgcgatcatcacgccggcgctcatctgcggcgcgttcgccgaccggatgaaattctcggcgatgctcgtcttcatgacgctgtggtcgctgatcgtctacgtgccgatcgcgcacatggtctgggagccgacgggctggctgtcggcggacggcgtgctcgacttcgcgggcggcacggtcgtgcacatcaacgccggcatcgcgggcctcgtgtcgtgcctcatgctcggcaagcgcgtcggctacggccgcgaagcgatggcgccgcacaacctggtgctgacgctgatcggcggctcgatgctgtgggtgggctggttcggcttcaacgcgggctccgcggtggccgcggacggccgcgccggcttcgcgatgctgacgacgcaagtcgccaccgcgtgcgccgcgctcggctggatgttcgccgaatggatcgccaagggtaagccttcggtgctcggcatcgtgtcgggcgcggtcgcgggtctcgtcgcgatcacgccggccgccggcttcgtcggcgtcgcgggcgcgctcgtgatcggcatcgcggcgggcgtcgtctgcttctggtcggcgacgtggctcaagcacaagctcggctacgacgattcgctcgacgcgttcggcgtgcacggcgtgggcggcattctcggcgcgctgctcacgggcgtgttcgcggtcaaggacatcggcggcgcggacggcagcctgctgctgcaggccaagggcgtcgcgatcacgctcgtctacagcggcatcgtcagcttcgtgctgctgaaggtgatcgacatcgtgatcggcctgcgcgtgaccgaggaagaggagcgcgaaggcctcgacgtgatcctgcacggcgagcacgtcgaataa

SEQ ID NO: 1827 - protein, 444 aa, Burkholderia mallei ATCC 23344
MADDASSAPAAASAATASDTSAGAAASAAPTAPFSVDSSKINSGDTAWMLTSTALVLFMTIPGLALFYGGMVRKKNVLATVMQSFAITALITVLWTVVGYSLAFTPGNGFIGGFSRVFLSGMNYIHGDKATTLTVSHLASTIPESVYFVYQMTFAIITPALICGAFADRMKFSAMLVFMTLWSLIVYVPIAHMVWEPTGWLSADGVLDFAGGTVVHINAGIAGLVSCLMLGKRVGYGREAMAPHNLVLTLIGGSMLWVGWFGFNAGSAVAADGRAGFAMLTTQVATACAALGWMFAEWIAKGKPSVLGIVSGAVAGLVAITPAAGFVGVAGALVIGIAAGVVCFWSATWLKHKLGYDDSLDAFGVHGVGGILGALLTGVFAVKDIGGADGSLLLQAKGVAITLVYSGIVSFVLLKVIDIVIGLRVTEEEEREGLDVILHGEHVE

SEQ ID NO: 1828 - DNA, 1488 bp, Burkholderia pseudomallei K96243
  CDS (1)..(1488): transl_table=11
atgtccctgttgatggccggctcgctgcttgcgggcggcatcggcgccgcgatggccgacgacgcgtcgtcggctcccgccgccgcatcggccgcaacggcttccgacacgtcggccggcgccgccgcgtccgcaccggccgcgtccgccgcaccggccgcaccggcggcacccgccgcgtcggcgcccgcggccgcgtccgccgccgcgccggcttcggccgccgccgcgcccgccgcgccgaccgcgccgttctcggtcgattcgtcgaagatcaactcgggcgacaccgcgtggatgctcacgtcgaccgcgctcgtgctgttcatgacgatcccgggcctcgcgctcttctacggcggcatggtccgcaagaagaacgtgctcgcgaccgtgatgcagagcttcgcgatcaccgcgctgatcacggtcctctggacggtggtcggctacagcctcgcgttcacgccgggcaacggcttcatcggcggcttctcgcgcgtgttcctgtccgggatgaactacatccacggcgacaaggcgacgacgctcaccgtcagccatctcgcgtcgacgatcccggaatcggtctacttcgtctaccagatgacgttcgcgatcatcacgccggcgctcatctgcggcgcgttcgccgaccggatgaaattctcggcgatgctcgtcttcatgacgctgtggtcgctgatcgtctacgtgccgatcgcgcacatggtctgggagccgacgggctggctgtcggcggacggcgtgctcgacttcgcgggcggcacggtcgtgcacatcaacgccggcatcgcgggcctcgtgtcgtgcctcatgctcggcaagcgcgtcggctacggccgcgaagcgatggcgccgcacaacctggtgctgacgctgatcggcggctcgatgctgtgggtgggctggttcggcttcaacgcgggctccgcggtggccgcggacggccgcgccggcttcgcgatgctgacgacgcaagtcgccaccgcgtgcgccgcgctcggctggatgttcgccgaatggatcgccaagggtaagccttcggtgctcggcatcgtgtcgggcgcggtcgcgggtctcgtcgcgatcacgccggccgccggcttcgtcggcgtcgcgggcgcgctcgtgatcggcatcgcggcgggcgtcgtctgcttctggtcggcgacgtggctcaagcacaagctcggctacgacgattcgctcgacgcgttcggcgtgcacggcgtgggcggcattctcggcgcgctgctcacgggcgtgttcgcggtcaaggacatcggcggcgcggacggcagcctgctgctgcaggccaagggcgtcgcgatcacgctcgtctacagcggcatcgtcagcttcgtgctgctgaaggtgatcgacatcgtgatcggcctgcgcgtgaccgaggaagaggagcgcgaaggcctcgacgtgatcctgcacggcgagcacgtcgaataa

SEQ ID NO: 1829 - protein, 495 aa, Burkholderia pseudomallei K96243
MSLLMAGSLLAGGIGAAMADDASSAPAAASAATASDTSAGAAASAPAASAAPAAPAAPAASAPAAASAAAPASAAAAPAAPTAPFSVDSSKINSGDTAWMLTSTALVLFMTIPGLALFYGGMVRKKNVLATVMQSFAITALITVLWTVVGYSLAFTPGNGFIGGFSRVFLSGMNYIHGDKATTLTVSHLASTIPESVYFVYQMTFAIITPALICGAFADRMKFSAMLVFMTLWSLIVYVPIAHMVWEPTGWLSADGVLDFAGGTVVHINAGIAGLVSCLMLGKRVGYGREAMAPHNLVLTLIGGSMLWVGWFGFNAGSAVAADGRAGFAMLTTQVATACAALGWMFAEWIAKGKPSVLGIVSGAVAGLVAITPAAGFVGVAGALVIGIAAGVVCFWSATWLKHKLGYDDSLDAFGVHGVGGILGALLTGVFAVKDIGGADGSLLLQAKGVAITLVYSGIVSFVLLKVIDIVIGLRVTEEEEREGLDVILHGEHVE

SEQ ID NO: 1830 - DNA, 1443 bp, Methylococcus capsulatus str. Bath
  CDS (1)..(1443): transl_table=11
atgaaaaacattccgacttccctggtgactctggcgtgtctcggtttcagtgccgccgcgcaggccgaaggcgccaccgagatcgtcgagaccgtggtcgagacggtgcagcaggccgctacccccgccgttccgaccccggacaagggtgacacggcctggatgatcgtcgccacggtgctggtgaccctaatggtcattccggggctggcgttgttctatggcggtatggtccgcgccaagaacatgctgtctgtgctgatgcaggtcttcgtgatcttttcgctgatggccgtactctgggccgtctacggttacagcatcgcgtttaccgaagggggcgtcttcttcggcagtctggacaaggccttcctcgccggcgtgacgcccgattcgaccgccgccaccttcagcaagggtgtggtgatccccgaactgatctacgtcgcgttccagttgaccttcgcctgcatcacgccggccctgatcgtcggtgcctttgccgagcgcatgaagttcagcgcggtgctgctgttcatggtgttgtggttcaccttctcctatctgccgatcgcccacatggtgtggtactgggccggccccgacgcctacaccgatgccgcggcgggtgaaaaggcgaccgctaccgccggcttcctgtttcaaaagggtgcgctggatttcgccggcggcaccgtggttcacatcaatgcgggcatcgccggcctggtaggctgtctgctggtgggtaaacgcatcggctacaagaaggagtcgatggcgccgcacagcgttcctatgaccatgatcggcgcctcgctcctttgggtcggttggtttggcttcaacgccggttccaacctggaggccaccggtaccgcggctttggccttcgtcaacaccatgctggccaccgccgccgcgacgctggcgtggtcggccgtcgaatggatcgcgcgcggcaagcccagcatgctgggcggtgcttcgggtgcggtcgccggcctggtggccatcacgccggcctgcgggttcatcggtccgatgggttcgatcgtgctgggtttggcggccggcgcggtgtgcttctggtccgtgaccaccctcaagaatgcgctgggctatgacgactcgctcgacgtgttcggtgtccacggcgtgggcggtatcatcggcgcgctgggcaccggcatcttcgcctctcccgccctcggcggtgccggggtctacgactatgtggccaacgccgtcgccgaatacgacatggtgagccaggtcatcagccagtcctggggcgtgggcgtcaccatcgtctggagcggcgtggtctccctgatcgcctacaagatcgtcgatctgctcgtcggccttcgggtttccgaggagaccgagcgtgagggattggacatccgtgagcacggcgaaaccgcctatcacccctga

SEQ ID NO: 1831 - protein, 480 aa, Methylococcus capsulatus str. Bath
MKNIPTSLVTLACLGFSAAAQAEGATEIVETVVETVQQAATPAVPTPDKGDTAWMIVATVLVTLMVIPGLALFYGGMVRAKNMLSVLMQVFVIFSLMAVLWAVYGYSIAFTEGGVFFGSLDKAFLAGVTPDSTAATFSKGVVIPELIYVAFQLTFACITPALIVGAFAERMKFSAVLLFMVLWFTFSYLPIAHMVWYWAGPDAYTDAAAGEKATATAGFLFQKGALDFAGGTVVHINAGIAGLVGCLLVGKRIGYKKESMAPHSVPMTMIGASLLWVGWFGFNAGSNLEATGTAALAFVNTMLATAAATLAWSAVEWIARGKPSMLGGASGAVAGLVAITPACGFIGPMGSIVLGLAAGAVCFWSVTTLKNALGYDDSLDVFGVHGVGGIIGALGTGIFASPALGGAGVYDYVANAVAEYDMVSQVISQSWGVGVTIVWSGVVSLIAYKIVDLLVGLRVSEETEREGLDIREHGETAYHP

SEQ ID NO: 1832 - DNA, 1413 bp, Synechococcus elongatus PCC 6301
  CDS (1)..(1413): transl_table=11
atgttcgacaaacgatggcgaactctgggtttgactgcagcactggctggcatttctgcatttctgctggcccatccaactctggcagcaactgcacctcagctaacgctggagcagctcaatagcaacgtcactgccgccaagactggaactgacacgctactcctcctaatcggctcagccctcgtccttttgatgacaccggggctagcctttttctatggcggttttggcagagcccagaacgtcctaaatatcatgatgatgagcttcttgatgatggggctcgtcggcatgacttgggtgatttatggctacagtctcgctttcgacaccagtttagggagtccctttatcggcggttttagtaacctgtttttcaatggtgtcggtggcaagtttggcattgatcctgtctgggccggcgatgagttgatgatctccggtatgtctgcctccagctttgcgctgtttcaaggcatgttcgcaatcattacgcccgctctgatttctggagcgctggtagagcgggtcaattttaaggcttggttctggttcggcttgctctggtccacgcttgtctacatccctatggcgcacatggtctggggaagcaatggctttatctatggccagattggcgccctcgactttgccggcagcaccgttgtccatattgcctctggggtgggtgccctagtgtccgtggcaatgatcggcccgcgtcgcgtcttcccgaatcgtctgtcgccgccgcacaatgtgccctttattttgttgggggcaggtctgctttggttcggctggtttggatttaacggcgcgagctacttcgctgcccaaggcgccggttttgccttcctcaccaccaatacggcagcagcaacagccatgctgacttggctattactcgagcagattgacctcgggaagcccaccgccgtaggcgccgcaaccggcgcggtggctggtctagtcggaatcacaccgtctgctgggttcattcctgtttgggcggcacttcccatcggtgccttgacagccctagtctgctttctgttcgtcgccaaagttaagagccggatccgactggatgattccctagatgcttttggggtacacggcgttggcggaaccgtcggcgctattctcacgggcatttttgcccagaaggatttcctcgttgagaaagctttcccaacccagttcaaggtgatctcccagggtcctttggccatgacttgggcacagatccaagccgtgttgattacctatctctttgttggcatcgctaccttcgtgatctggacgatcctgaaatcggtcatgcgtgtccgcgccacggaggaacaggagttggaagggctggactttgccctacacggcgaagatgcctacagcaaagagcgctag

SEQ ID NO: 1833 - protein, 470 aa, Synechococcus elongatus PCC 6301
MFDKRWRTLGLTAALAGISAFLLAHPTLAATAPQLTLEQLNSNVTAAKTGTDTLLLLIGSALVLLMTPGLAFFYGGFGRAQNVLNIMMMSFLMMGLVGMTWVIYGYSLAFDTSLGSPFIGGFSNLFFNGVGGKFGIDPVWAGDELMISGMSASSFALFQGMFAIITPALISGALVERVNFKAWFWFGLLWSTLVYIPMAHMVWGSNGFIYGQIGALDFAGSTVVHIASGVGALVSVAMIGPRRVFPNRLSPPHNVPFILLGAGLLWFGWFGFNGASYFAAQGAGFAFLTTNTAAATAMLTWLLLEQIDLGKPTAVGAATGAVAGLVGITPSAGFIPVWAALPIGALTALVCFLFVAKVKSRIRLDDSLDAFGVHGVGGTVGAILTGIFAQKDFLVEKAFPTQFKVISQGPLAMTWAQIQAVLITYLFVGIATFVIWTILKSVMRVRATEEQELEGLDFALHGEDAYSKER

SEQ ID NO: 1834 - DNA, 1227 bp, Dehalococcoides ethenogenes 195
  CDS (1)..(1227): transl_table=11
atggacagcggcgatacgacttggttacttgtctctaccgctctggtcatgctgatgactccgggcgtggctctgttttacggaggcatggtccggcgcaaaaatctggtttccacccttatgatgagctttggggctatggctctgggtggagtgctctgggttttgatcggctacagtcttggtttcggtaacgatatcaacggtctggtaggcggtctgaacttcctgggtttaaatggtgtggggcaagatccatctgacacttatgctaccacagtacctcatctggccttcatgatgttccagggtatgtttgccattatctctctggcccttattaccggtgcggtagtagagagaatccgctttagtgctttgctcctgtttggggcactctggctttgccttatctattcgcccattgcccactgggtctggggtgatggtggttggttattcaatctgggtgttttggactttgccggcggtactgttgtacacatcaacgctggtgtttctgcaatggctttggtattggcactgggtgcccgccgcggtttccttaaagaacagatggaacccaataacctgcccatggttatgctgggtgcggctctgctctggttcggttggttcggtttcaacggcggcagcgctttaactgccggtggtctggcttcaaatgcttttgttactactaacactgcggctgccagtgcagctctgtgctggatattccttagttggcgtcatcgccggccgtcgcttctgggtgcagttaccggtgcagttgccggtttggtagccattacccctgcggctggttttgtaacacctttggcggctatcgctatcggtgcggtggcagctctggtttgctacggtgctatgatattcaagatgaaacgcggatttgatgattcactggatgttatggcagtacacggtgtaggcggtatctggggtgctttggcaacaggtatctttgccagcgtggcggtaaactctgccggtgctgacggtctgttgtccggtaacgtggaactgttccttaaacaagctttgggtgtggctgttacaggcggctttgccttcgtgggcagcttcataattgccaaggtggtagataagctggtaggcctgcgggtcaaagaacccgaagaaatgatagggcttgatattgcccagcactctgaacgggcttatggtgggagtttaagatga

SEQ ID NO: 1835 - protein, 408 aa, Dehalococcoides ethenogenes 195
MDSGDTTWLLVSTALVMLMTPGVALFYGGMVRRKNLVSTLMMSFGAMALGGVLWVLIGYSLGFGNDINGLVGGLNFLGLNGVGQDPSDTYATTVPHLAFMMFQGMFAIISLALITGAVVERIRFSALLLFGALWLCLIYSPIAHWVWGDGGWLFNLGVLDFAGGTVVHINAGVSAMALVLALGARRGFLKEQMEPNNLPMVMLGAALLWFGWFGFNGGSALTAGGLASNAFVTTNTAAASAALCWIFLSWRHRRPSLLGAVTGAVAGLVAITPAAGFVTPLAAIAIGAVAALVCYGAMIFKMKRGFDDSLDVMAVHGVGGIWGALATGIFASVAVNSAGADGLLSGNVELFLKQALGVAVTGGFAFVGSFIIAKVVDKLVGLRVKEPEEMIGLDIAQHSERAYGGSLR

SEQ ID NO: 1836 - DNA, 1338 bp, Pseudomonas syringae pv. syringae B728a
  CDS (1)..(1338): transl_table=11
atgactctgcgtcaattcgcagggctcggtgccctgttgtccctcgcattacctggtcttgccctggcggctgatccagtggccgagccggtgctgaactctggcgacactgcatggatgctgacctcgaccgctctggtcctgttcatgaccatccccggtctcgcgctgttctacggcggcatggttcgttccaagaacattctgtcggtgatgatgcagtgcttcgccatcaccggtctgatcagcatcctgtgggtcgtctacggctacagcatcgcgtttgacacaaccggtatggaagcgggcgtcgtcaacttcaattccttctttggcggtatgggtaaagcgttcctggcaggcatcacgccggcaagcattaccggtcctgctgcgttgttccctgaggcggtgttcgtcaccttccagatgaccttcgcgatcatcacccctgccctaattgtcggcgccttcgcagaacgcatgaagttctccgcgatgctggtgttcatgggtatctggttcactctggtctacgcgccaatcgcccacatggtctggggcggcgtcggtggcctgttgtgggactggggcgttctggacttcgctggcggtaccgtcgtacatatcaacgccggtgtagccggtcttgtagcgtgcctggtactgggcaagcgcaaaggcttcccgaccacgccgatggcgccgcacaacctgggttacaccctgatcggcgcagcgatgctctgggtcggctggttcggcttcaacgccggttccgccgctgcggccaacggtactgccggtatggccatgctggtcactcaaatcgctaccgcggccgccgcattgggctggatgtttgccgagtggctgactcacggtaagccaagtgctctgggtattgcctctggtgtggttgccggcctggttgccgttacccctgcggccggtaccgtcggcccgatgggcgcgctgatcatcggtctggcagcaggcgtgatctgcttcttctgcgcgaccagcctcaagcgcaagctgggctacgacgactccctggatgcgttcggcgttcacggcatcggcggtatcgtcggcgccatcctgaccggtgtgttcgcagcacctgcactgggcggcttcggcaccgtgaccgacatcggtgctcaggtctggattcagttcaagggcgtcgcgttcaccgttgtctacaccgcaatcgtgaccttcatcatcctcaaggtgctggatgcggtcatgggtctgcgcgtcaccgacgaggaagagtctgtcggtctggaccttgcgcaacacaacgagcgtggctacaacttgtaa

SEQ ID NO: 1837 - protein, 445 aa, Pseudomonas syringae pv. syringae B728a
MTLRQFAGLGALLSLALPGLALAADPVAEPVLNSGDTAWMLTSTALVLFMTIPGLALFYGGMVRSKNILSVMMQCFAITGLISILWVVYGYSIAFDTTGMEAGVVNFNSFFGGMGKAFLAGITPASITGPAALFPEAVFVTFQMTFAIITPALIVGAFAERMKFSAMLVFMGIWFTLVYAPIAHMVWGGVGGLLWDWGVLDFAGGTVVHINAGVAGLVACLVLGKRKGFPTTPMAPHNLGYTLIGAAMLWVGWFGFNAGSAAAANGTAGMAMLVTQIATAAAALGWMFAEWLTHGKPSALGIASGVVAGLVAVTPAAGTVGPMGALIIGLAAGVICFFCATSLKRKLGYDDSLDAFGVHGIGGIVGAILTGVFAAPALGGFGTVTDIGAQVWIQFKGVAFTVVYTAIVTFIILKVLDAVMGLRVTDEEESVGLDLAQHNERGYNL

SEQ ID NO: 1838 - DNA, 1338 bp, Pseudomonas fluorescens Pf-5
  CDS (1)..(1338): transl_table=11
atgactctgcgtaaattcgcagggctaggagcccttttgtccctcgtaatgccaggcctggccatggcggcagacgaagcggcggctccagtcctcaactccggcgataccgcctggatgctgacctccacagccctggtgctgttcatgaccattcctggcctggcgctgttctacggcggcatggtgcggtcgaaaaacattctttcggtaatgatgcagtgcttcgccattaccggcctgatcactgtcctgtggttcatctatggctacagcatggcgttcgacaccaccgggatggaagccggcgtggtcaacctcaattccttcgtgggcggcttctccaaggccttcctggcgggcatcaccccggccagcctgaccggcccggctgcgctgttccctgaagcggtgttcgtcaccttccagatgaccttcgccatcatcactccagcgctgatcgtcggtgccttcgccgagcggatgaaattctccgccatgctgatcttcatgggcgtgtggttcaccctggtgtatgcgccgatcgcccatatggtctggagcggtccgggctcgctgctgggcgactggggcgtgctggactttgccggcggcaccgtagtgcacatcaacgccggtatcgcgggcctggtggcctgcctggtgctgggcaagcgcaagggtttcccgaccacgccgatggcgccacacaacctgggttacaccctgatgggcgcagccatgctgtggatcggctggttcggcttcaacgccggttccgccgctgccgccaacggcaccgccggcatggccatgctggtaacgcagatcgcgacggctgccgccgccttgggctggatgtttgccgagtggatcacccacggcaagcctagcgcgctgggcatcgcttcgggtgtggtcgcaggcctggtggcaatcactccggctgccggtaccgttggcccgatgggcgccctgatcatcggtctggcggccggtgtggtgtgcttcttctgcgccaccagcctcaagcgcaagctgggatatgacgattccctggacgcctttggcgtgcacggcatcggcggtattctcggtgcgatcctcaccggtgtgttcgctgctccgtccctgggtggcttcggcaccgtgaccgatgttgccgctcaggtctggatccaggccaagggcgtgggtttcacggtgatctacaccgcgatcgtcaccttcatcatcctcaaggttctggacgcggtcatggggctgcgggtgagcgaggaagaagaggcggtcggcctcgatctggcacaacacaacgagcgtggttacaacctgtaa

SEQ ID NO: 1839 - protein, 445 aa, Pseudomonas fluorescens Pf-5
MTLRKFAGLGALLSLVMPGLAMAADEAAAPVLNSGDTAWMLTSTALVLFMTIPGLALFYGGMVRSKNILSVMMQCFAITGLITVLWFIYGYSMAFDTTGMEAGVVNLNSFVGGFSKAFLAGITPASLTGPAALFPEAVFVTFQMTFAIITPALIVGAFAERMKFSAMLIFMGVWFTLVYAPIAHMVWSGPGSLLGDWGVLDFAGGTVVHINAGIAGLVACLVLGKRKGFPTTPMAPHNLGYTLMGAAMLWIGWFGFNAGSAAAANGTAGMAMLVTQIATAAAALGWMFAEWITHGKPSALGIASGVVAGLVAITPAAGTVGPMGALIIGLAAGVVCFFCATSLKRKLGYDDSLDAFGVHGIGGILGAILTGVFAAPSLGGFGTVTDVAAQVWIQAKGVGFTVIYTAIVTFIILKVLDAVMGLRVSEEEEAVGLDLAQHNERGYNL

SEQ ID NO: 1840 - DNA, 1338 bp, Colwellia psychrerythraea 34H
  CDS (1)..(1338): transl_table=11
atgtcagttattgaattatttactatggaaacaactatgagcaaagcattaatcttgtgtttaaccttacttagcttttttatctcaggcactgcttgggcggaagaagggcaactaaatggcgcaaacaccagttggattttaacatctaccgcattggtattattgatgaccttaccgggcgttgctcttttttacggtggcttggttcgtaaaaagaatgtgttatcaatattaatgcaatgttttgctatcggctcaatctcatcaattttatggctattagtaggctatagcttagcttttggtgagggtaatgcttttatcggtgattttagtaaagtgatgatgcatggtattcctaaagatgctttgtcaggagatatccctgaaagtttatttatgctgtttcaaatgacttttgccattattacgccagtgcttattattggtggttttgcagagcgtatgaagttctctgcggtattactctttagtggtatttggttacttgctgtttatgcacctattactcattgggtatggggcggcggttggttagcacaaatgggcatttatgattttgccggtggtattgttgtacatattacggcgggtactgcggcattagttgccgctcttgttatcggtccacgtcgaggttttcctaaaacacctatgttgccacataacttaaccatgactgttactggtgctggtatgttatgggttggttggtttggctttaatggtggtagtgcactagccgctaacggtgatgcttctatggctatgcttgttacacatatttctgccgcagcaggtacattaacttgggcagctattgagtggaaaaaatttggtaaagccagtgttttaggtgctgttaccggtatggtcgcaggtttaggtaccattacgcctgcctctggttttgtcggccctggtggcgcgttaattattggtattagtgcaggctttgtttgtttttattcaacggtttatattaaacaaaaattaaaaattgatgattcgttagatgtatttcctgtacatggtgttggtggtattttaggtacgttattagtcggtgttttctcagcgaccagtcttggtgtatttagtggttttggttttgctgaaggcattgctacgatggcggaacaaattggtgttcagcttatcggcatattctctacactgatttataccgcagtcgttacttatattatccttaaattggtcggtttgatgacggatggtttacgtgttggtgaagagcaagagtctaacggtttagatcaggctgaacatgaagaagtcggttaccacttgtag

SEQ ID NO: 1841 - protein, 445 aa, Colwellia psychrerythraea 34H
MSVIELFTMETTMSKALILCLTLLSFFISGTAWAEEGQLNGANTSWILTSTALVLLMTLPGVALFYGGLVRKKNVLSILMQCFAIGSISSILWLLVGYSLAFGEGNAFIGDFSKVMMHGIPKDALSGDIPESLFMLFQMTFAIITPVLIIGGFAERMKFSAVLLFSGIWLLAVYAPITHWVWGGGWLAQMGIYDFAGGIVVHITAGTAALVAALVIGPRRGFPKTPMLPHNLTMTVTGAGMLWVGWFGFNGGSALAANGDASMAMLVTHISAAAGTLTWAAIEWKKFGKASVLGAVTGMVAGLGTITPASGFVGPGGALIIGISAGFVCFYSTVYIKQKLKIDDSLDVFPVHGVGGILGTLLVGVFSATSLGVFSGFGFAEGIATMAEQIGVQLIGIFSTLIYTAVVTYIILKLVGLMTDGLRVGEEQESNGLDQAEHEEVGYHL

SEQ ID NO: 1842 - DNA, 1338 bp, Pseudomonas syringae pv. phaseolicola 1448A
  CDS (1)..(1338): transl_table=11
atgactctgcgtcaattcgcagggctcggtgccctgttgtccctcgcattacctggtcttgccctggcggctgacccagtggccgagccggtgctgaactctggcgacactgcatggatgctgacctcgaccgctctggtcctgttcatgaccatccccggtctcgcgctgttctacggcggtatggttcgctcgaagaatattctgtccgtgatgatgcagtgtttcgccatcaccggtctgatcagcatcctgtgggtcgtgtacggctacagcattgcgttcgatacaaccggcatggaagcgggcgtcgtcaacttcaattccttctttggcggtatgggtaaagcgttcctggcaggcatcacgccagcaagcattaccggtcctgctgcgttgttccctgaggcggtgttcgtcaccttccagatgaccttcgcgatcattacccctgccctgattgtcggcgctttcgcagaacgcatgaagttctccgcaatgctggtgttcatgggtatctggttcactctggtctacgcgccaatcgcccacatggtctggggtggcgtcggtggcctgatgtgggactggggcgttctcgacttcgctggtggcaccgtggtgcacatcaacgccggtgtagccggtctggtggcctgcctggtactgggcaagcgcaaaggcttcccgaccacgccgatggcaccgcacaacctgggttataccctgatcggcgcagcaatgctctgggtcggctggttcggtttcaacgccggttccgccgctgcggccaacggcactgccggtatggcgatgctggtgactcaaatcgctaccgctgccgccgcactgggctggatgttcgccgagtggctgacccacggcaagccaagcgctctgggcatcgcgtcgggcgtggttgccggtctggtcgctattaccccggctgccggtacagtcggcccgatgggcgctctgatcatcggtctggcggcaggcgtgatctgcttcttctgcgctaccagcctcaagcgcaagcttggctacgacgactccctggatgcgttcggcgttcacggtatcggcggtatcgtcggcgcgatcctgaccggcgtgttcgcagcacctgcactgggcggcttcggcactgttactgacatcggtgcccaggtctggattcagttcaagggcgtcgcgttcaccgtcgtttacaccgcaatcgtgaccttcatcatccttaaagtcctggatgctgtaatgggtctgcgggttaccgacgaggaagagtctgtcggtctggaccttgcgcaacacaacgagcgtggctacaacttgtaa

SEQ ID NO: 1843 - protein, 445 aa, Pseudomonas syringae pv. phaseolicola 1448A
MTLRQFAGLGALLSLALPGLALAADPVAEPVLNSGDTAWMLTSTALVLFMTIPGLALFYGGMVRSKNILSVMMQCFAITGLISILWVVYGYSIAFDTTGMEAGVVNFNSFFGGMGKAFLAGITPASITGPAALFPEAVFVTFQMTFAIITPALIVGAFAERMKFSAMLVFMGIWFTLVYAPIAHMVWGGVGGLMWDWGVLDFAGGTVVHINAGVAGLVACLVLGKRKGFPTTPMAPHNLGYTLIGAAMLWVGWFGFNAGSAAAANGTAGMAMLVTQIATAAAALGWMFAEWLTHGKPSALGIASGVVAGLVAITPAAGTVGPMGALIIGLAAGVICFFCATSLKRKLGYDDSLDAFGVHGIGGIVGAILTGVFAAPALGGFGTVTDIGAQVWIQFKGVAFTVVYTAIVTFIILKVLDAVMGLRVTDEEESVGLDLAQHNERGYNL

SEQ ID NO: 1844 - DNA, 1542 bp, Ralstonia eutropha JMP134
  CDS (1)..(1542): transl_table=11
atgacaacctggttcaagcgaatcctgacggcgggcgcgatggcgctggccatcggcacggccggcgtcggcctgtccacccatgccgtcgcgcaggacaagccggcggccgaggcctccgcgccggccgccgccgctgcgcctgcagcggcacccgctgctgcggctgcccccgcggctgcaaccactgccgccgcaccggccgaggccgctgccgctccggcagcacccgttccaaacaagggcgacactgcctggctgctcgtgagcacggcgttcgtgatcctgatgacgctgccgggcctggcgctgttctatggcggtctggtccgttccaagaacatgctgtcggtgctgatgcagtgcctggtgatcttctcggtggtgtcgctgctgtgggccgtctacggctacagctttgcgttcaccgagggcaatgccttcttcggcggaaccgaccggctattcatgaagggcctgacggttgacgccgtggcggctaccttcagcaagggcgtggtggtgccggagctgggctactttgcattccagtgcgccttcgcggccatcacctgcgggctgatcatcggcgcctttgccgagcgcgccaagttctcggccgtgctggtgttcgtggtgctgtggttcacgttctcgtacatccccatcgcccatatggtctggttctggccgggtccggacgccttcactgacgctgccgccggtactgctgcgacggccaagtcgggctggctgttccagaagggcgcgctggacttcgccggcggcaccgtggtccacatcaacgccgctgtggctggcctggttggcgccttcatgttcggcaagcgcatcggcttcggccgcgaggcgatccgtccgcacagcctgaccttcaccatggtcggcgcctcgctgctgtggttcggctggttcggcttcaatgccggctcggcgctggaagccaacggctcggccgcactggccttcgtcaacacgctgctggccacctgcgccgcggtgctgtcctggaccttcggcgagtggatcagcaagggcaagccgtcgatgctgggcggtgcctcgggtgccgtggcgggcctggtggccatcacgccggcagctggcttcgtcggcccgatgggttcgatcgcgatcggcctgatcgccggcctgctgtgcctgtggggcgtgaccggcctgaagcgcatgctgggcatggacgactcgctcgatgtgttcggcgtgcacggcgtgggcggcatcctgggtgcgctgctgaccggcgtgttcgcttcgccgagcctgggcggcaccggcatctacgactacgtggccaacaaggtggccgacgactattcgatcgccggccaggtctggatccagttccagggcgtgctgaccacgatcgtctggtccggtgtggtggccttcgtggcatacaagctggtggatatgctgatcggcctgcgggtgccggaagaagaagagcgcgagggcctggatatcacctcgcacggcgaaaccgcctatgaagtctga

SEQ ID NO: 1845 - protein, 513 aa, Ralstonia eutropha JMP134
MTTWFKRILTAGAMALAIGTAGVGLSTHAVAQDKPAAEASAPAAAAAPAAAPAAAAAPAAATTAAAPAEAAAAPAAPVPNKGDTAWLLVSTAFVILMTLPGLALFYGGLVRSKNMLSVLMQCLVIFSVVSLLWAVYGYSFAFTEGNAFFGGTDRLFMKGLTVDAVAATFSKGVVVPELGYFAFQCAFAAITCGLIIGAFAERAKFSAVLVFVVLWFTFSYIPIAHMVWFWPGPDAFTDAAAGTAATAKSGWLFQKGALDFAGGTVVHINAAVAGLVGAFMFGKRIGFGREAIRPHSLTFTMVGASLLWFGWFGFNAGSALEANGSAALAFVNTLLATCAAVLSWTFGEWISKGKPSMLGGASGAVAGLVAITPAAGFVGPMGSIAIGLIAGLLCLWGVTGLKRMLGMDDSLDVFGVHGVGGILGALLTGVFASPSLGGTGIYDYVANKVADDYSIAGQVWIQFQGVLTTIVWSGVVAFVAYKLVDMLIGLRVPEEEEREGLDITSHGETAYEV

SEQ ID NO: 1846 - DNA, 1194 bp, Methanosarcina barkeri str. Fusaro
  CDS (1)..(1194): transl_table=11
atgactattgaagcagcagacacagtatgggtactcatctcgtctgcacttgtattgttaatgcttcccggacttgcactgttctatggcgggcttgtccagcgtaaaaacgttttgagcagcatgatgcattcatttgttgcaatgggcgtcatggctctggaatgggtattgataggttactcacttgcatttgcagacggtaactggtttgtaggtggccttggacatgtattcctgaaagggatagatgtatattcagtaactggtacaattccgacttatgcatatgttgcgtttcagggaatgtttgcaataattacacctgctctgatttcaggtgcaattgtaggacgtgtgaagtttaaatcttatatcgcattcattgctctctggggacttatcgtatatgcacctgtctgccactgggtctggggtggtgggttccttacaggggaagctcttgactttgcaggcggtacagttgtgcacataacctcaggtgtctcctcacttgcaattcttacataccttggaaagagacgtggttttggggtagattcattaaagccacataatgttactttgacgcttcttggaactggtcttctctggttcggatggttcgggtttaacgcaggttcatcacttgctgcaaatgagattgcatctctcgcattcattacaacacttgtagccccagcagctgcaggatttatctggatggcccttgaatggtatcacttagggtatccaacagctctgggatttgcaacagggattcttgcaggacttgttgcaataactccaagtgcaggctttgtcacgccaatggcagcaattcctataggtgcgatcacaagtttcgtgtgctacaatgctgtaggactcaaagaaaggcttggatatgatgactcgctggatgcctttggagtacatggtgttggtggaatagtaggcgcactcctagtaggtgtatttgcaagtgtaggagggaccggtctcttacttgggaattccagccaaatgttaatccagcttcaaggcgttgtcgtcacaattgtttatgcagctgtcgggactctccttattggattcatacttaacagaactatagggcttaaagtcagcgaaagtgaagaaaacatcggacttgacaagacgcagcatggtgaagttgcatataacatctga

SEQ ID NO: 1847 - protein, 397 aa, Methanosarcina barkeri str. Fusaro
MTIEAADTVWVLISSALVLLMLPGLALFYGGLVQRKNVLSSMMHSFVAMGVMALEWVLIGYSLAFADGNWFVGGLGHVFLKGIDVYSVTGTIPTYAYVAFQGMFAIITPALISGAIVGRVKFKSYIAFIALWGLIVYAPVCHWVWGGGFLTGEALDFAGGTVVHITSGVSSLAILTYLGKRRGFGVDSLKPHNVTLTLLGTGLLWFGWFGFNAGSSLAANEIASLAFITTLVAPAAAGFIWMALEWYHLGYPTALGFATGILAGLVAITPSAGFVTPMAAIPIGAITSFVCYNAVGLKERLGYDDSLDAFGVHGVGGIVGALLVGVFASVGGTGLLLGNSSQMLIQLQGVVVTIVYAAVGTLLIGFILNRTIGLKVSESEENIGLDKTQHGEVAYNI

SEQ ID NO: 1848 - DNA, 1227 bp, Dehalococcoides sp. CBDB1
  CDS (1)..(1227): transl_table=11
atggacagcggcgatacgacttggttacttgtctccaccgctttggtcatgctaatgaccccgggcgtggctctgttttatggaggcatggttcggcgcaaaaatctggtttccactcttatgatgagctttggggcaatggctctgggtggtgtactctgggtcttgatcggttacagccttggtttcggcaacgacatcaacgggttggtaggcggtctgaacttctttggcttaagtggtgtggggcaggatccgtctgatacttatgccaccacagtacctcatctggccttcatgatgttccagggtatgtttgctattatctctctggcacttattaccggtgcagtagtagagagaatccgttttagcgctttgctcatgtttggagcactctggctttgccttatatattcacctattgcccactgggtttggggcgatggtggttggctttttaatctgggtgttctggactttgccggtggtacggttgtgcatatcaatgccggtgtttctgctatggctctggttttggcacttggtgcccgacgcggtttccttaaagaacagatggagcccaacaacctgcccatggttatgctgggtgcggctttactctggtttggttggttcggtttcaacggcggcagtgccttgaccgccggtggtttagcttcaaacgctttcgttactaccaacactgcggctgccagtgcagctctttgctggatattccttagttggcggcatcgccggccgtccttgctgggtgcagttaccggtgcggttgccggactggtagctattactcctgcggctggttttgtaacacctatggcggctattgccatcggtgcagtggcggctctggtttgctacgctgctatgatattcaagatgaaacgcggatttgacgattcactggatgttatggcggtacacggtgtaggcggtatctggggtgctttggcaacaggtatcttcgccagtctggcggtcaactctgccggtgcagacggacttctttccggaaatgtggaattattccttaagcaagccctgggtgtggctgttactgcagggtttgcctttggaggcagcttcataatagccaaagttgtagataagctggtcggactgagggtgaaagaacccgaagaactcataggtcttgatattgcccaacacgctgaacgggcttacggggggagtgtcagatga

SEQ ID NO: 1849 - protein, 408 aa, Dehalococcoides sp. CBDB1
MDSGDTTWLLVSTALVMLMTPGVALFYGGMVRRKNLVSTLMMSFGAMALGGVLWVLIGYSLGFGNDINGLVGGLNFFGLSGVGQDPSDTYATTVPHLAFMMFQGMFAIISLALITGAVVERIRFSALLMFGALWLCLIYSPIAHWVWGDGGWLFNLGVLDFAGGTVVHINAGVSAMALVLALGARRGFLKEQMEPNNLPMVMLGAALLWFGWFGFNGGSALTAGGLASNAFVTTNTAAASAALCWIFLSWRHRRPSLLGAVTGAVAGLVAITPAAGFVTPMAAIAIGAVAALVCYAAMIFKMKRGFDDSLDVMAVHGVGGIWGALATGIFASLAVNSAGADGLLSGNVELFLKQALGVAVTAGFAFGGSFIIAKVVDKLVGLRVKEPEELIGLDIAQHAERAYGGSVR

SEQ ID NO: 1850 - DNA, 1407 bp, Thiobacillus denitrificans ATCC 25259
  CDS (1)..(1407): transl_table=11
atgaaaaaactctttgcttcgttcggcctgatcctcgcgctgctggcgccgggcctcgcggccgcgcaggacgcggccgtgccgatggatggcgccgcagcagtcgaaacggcgccggcggctgtagcgccggcagccgcagttccggccgaaacagccgcgacgccggtcccagacaagggcgacacgacctggatgatggtctcgacgttgctcgtcgtcctgatgatcgtcccgggcgtcgcactcttctacggcgggctcgtgcgcgccaagaacatgctgtcggtgctgacgcaggtgatggcgatcttctgcctgatatcggtgctgtgggcggtctatggctactcgctggcgttcggcgacggcggcggcatgaactgggcgatcggcgacctctccaagctcttcctcgccgggatcacgcccgacagcaccgccgcgaccttctccgacggcgtcgtcattcccgaattcaccttcgtcgccttccagctgaccttcgccgcgatcacggtcgcactgatcgtcggcgggctcgccgagcgcgtgaaattctcggcgctgctcgtgttcgcggtgctgtggttcaccttctcctacctgccgatcgcgcacatggtgtgggcgaccggcggctatctgttcgagaagggcgacctcgacttcgcgggcgggaccgtggtccacatcaacgcgggcgtcgctgcgctcgtcggcgcgatcgtactcggcaagcgcatcggctacggccgcgacgcgatgccgccgcacaacctgccgatgacgatgatcggcgcgtcgctgctgtgggtcggctggttcggcttcaacgccggctccaacctcgaagcgaccggcggcgcggcgctcgccttcatcaacacgatactcgcgaccgccgcggcagggctggcgtggatgttcgccgagtggatggtgcgcggcaagccttcgttgctcggcgtcgcgtcgggcgtggttgccgggctcgtcgcgatcacgcccgcagcgggcctggtcgggccgatgggcgggatcgtgctcggcgcggtcgccggcgtcgtctgcctgtggggcgtcagcgggctcaagtcggcgctcggctacgacgacagcctcgacgtcttcggcatccacggcatcggcggcatcatcggcgcgatcggcaccggcatcttcgtctcgccgacgctcggcggcgtcggggtcgacggctacacgctcgccggccaggtcatgacacaggcgagcggcgtgctgatcacgatcgtgtggtcggcggtcgtcagcttcgtcgccttcaagctcatcgacgtgaccctcggcttgcgcgtcgccgaagaacaggagcgcgagggactcgacaccgcgtcgcacggcgagcgcgcgtactccgtctag

SEQ ID NO: 1851 - protein, 468 aa, Thiobacillus denitrificans ATCC 25259
MKKLFASFGLILALLAPGLAAAQDAAVPMDGAAAVETAPAAVAPAAAVPAETAATPVPDKGDTTWMMVSTLLVVLMIVPGVALFYGGLVRAKNMLSVLTQVMAIFCLISVLWAVYGYSLAFGDGGGMNWAIGDLSKLFLAGITPDSTAATFSDGVVIPEFTFVAFQLTFAAITVALIVGGLAERVKFSALLVFAVLWFTFSYLPIAHMVWATGGYLFEKGDLDFAGGTVVHINAGVAALVGAIVLGKRIGYGRDAMPPHNLPMTMIGASLLWVGWFGFNAGSNLEATGGAALAFINTILATAAAGLAWMFAEWMVRGKPSLLGVASGVVAGLVAITPAAGLVGPMGGIVLGAVAGVVCLWGVSGLKSALGYDDSLDVFGIHGIGGIIGAIGTGIFVSPTLGGVGVDGYTLAGQVMTQASGVLITIVWSAVVSFVAFKLIDVTLGLRVAEEQEREGLDTASHGERAYSV

SEQ ID NO: 1852 - DNA, 1413 bp, Anabaena variabilis ATCC 29413
  CDS (1)..(1413): transl_table=11
gtgtttcagaaaattttgataactggggtgattaccctactactgctgacaattcctgttatgggtagtgcttgggcgcaagtcccagcaacggctccacctgctgatacaggagatacagcatttatgctgatttcatcagccctagtcttgctgatgacaccaggattggcatttttctacggtggatttgtacgatcgcgcaatattctcaatacattgatgatgagttttgtattgatggcgatcgtcggcgttacttgggttttatggggttatagtctgtcatttgcgccaggactgccatttattggtggtttacagtggtttgggttaaacggtgtggggctagaaaccacaggttatctgcaaggttcagagccgacaaatgtggtttcttatgccgggacgattccccatcaggcatacatgatatatcaagccatgtttgccattatcaccccagccttaatttctggagcgatcgccgaacggatgagtttccgtgcctattgcctatttgtgctactgtggtcaacctttgtttacacgcctctagcccacatggtttgggcaaaaggtggattattaggtttgtacggtggcttaggcgcgctcgacttcgccggcggtacagtagttcatattagctctggggtttctgccctcgtggccgcaatagtcctgggaccgaggaaaacccatcccgatcgcctcagccctccccacaacgtaacatttattttgttgggtgctggtttgctatggtttggctggttcggttttaatgctgggagtgccttatctgttgctagtagcacttctggcagtttcattactaatccagccacaactgcctttgttgccaccaatacctcagccgcagctggggctttaatgtggctaattctagaaggagtattacgcggtaaacccaccgccgtaggtgcagccacaggcgcagttgccggtttagtagggattaccccagccgccggctttgtcacccctctagcgtcaattttgataggttgtatcacagcttttgtttgcttctatgccgtaagtttcaaacacaagttaaatgttgacgatgccttagatacctacccggtgcatggtgttggtggaacagttggcgcaattctcacagccttgtttgccaccgccgaagttaactcaggcggtaaaaacggcgtactcaagggtaattttggtgaactaggtgtggaactggccgccattgtcatcgcctatgtaattgcagcagttggcacttggataattttgaagatcattgatgctagcgttggcttacgggtgaaagaagaagccgaatatcaaggtttggatatcaacgaacacggagaagaagcatacaactccgagtttagcgatcgcatcgtaccgtaa

SEQ ID NO: 1853 - protein, 470 aa, Anabaena variabilis ATCC 29413
MFQKILITGVITLLLLTIPVMGSAWAQVPATAPPADTGDTAFMLISSALVLLMTPGLAFFYGGFVRSRNILNTLMMSFVLMAIVGVTWVLWGYSLSFAPGLPFIGGLQWFGLNGVGLETTGYLQGSEPTNVVSYAGTIPHQAYMIYQAMFAIITPALISGAIAERMSFRAYCLFVLLWSTFVYTPLAHMVWAKGGLLGLYGGLGALDFAGGTVVHISSGVSALVAAIVLGPRKTHPDRLSPPHNVTFILLGAGLLWFGWFGFNAGSALSVASSTSGSFITNPATTAFVATNTSAAAGALMWLILEGVLRGKPTAVGAATGAVAGLVGITPAAGFVTPLASILIGCITAFVCFYAVSFKHKLNVDDALDTYPVHGVGGTVGAILTALFATAEVNSGGKNGVLKGNFGELGVELAAIVIAYVIAAVGTWIILKIIDASVGLRVKEEAEYQGLDINEHGEEAYNSEFSDRIVP

SEQ ID NO: 1854 - DNA, 1338 bp, Pseudomonas fluorescens PfO-1
  CDS (1)..(1338): transl_table=11
atgactctgcgtaaattcgcagggctaggagccctgttgtctatcgtaatgcccggcctggccatggcggcagacgaagtggcagctccagtcctgaactccggcgacaccgcctggatgctcacctccacagccctcgtgctgttcatgaccattcccggcctcgcgctgttctacggcggcatggtccggtcgaaaaacattctttccgtgatgatgcagtgctttgccattaccggtctgatcagcgtcctgtgggtcatttatggctacagcatcgcgttcgacaccaccggcatggagcagggcgtcgtcaacttcaattcgttcgtgggcggtttcggcaaggcgttcctggccggtgtcacgccagcgagcctgaccggcccggcggcgctgttccccgaggcggtcttcatcaccttccagatgaccttcgcgatcatcaccccggcgctgatcgtcggtgcattcgccgagcggatgaagttctccgcgatgctgatcttcatgggcatctggttcaccctggtttatgcaccgatcgcgcacatggtctggtccggcaacggcggcctgatgtgggactggggcgtactcgacttcgcgggcggcaccgtggtgcacatcaacgccggtgtggccggtctgattgcctgcctggtactgggtaaacgcaaaggcttcccgaccacgccgatggcgccacacaatctgggttacaccctgatgggcgcggcgatgctgtgggtcggctggttcggcttcaacgccggttccgctgcggccgccaacggcaccgccggcatggcgatgctggtgacccagatcgcgaccgccgctgctgcactgggctggatgttcgccgagtggatcacccacggcaaacctagcgcactgggtatcgcatccggcgtcgttgcaggtctggtggcgatcactccggccgctggcaccgtgggcccgatgggtgccctggtcatcggtctggcggcaggcgtggtgtgcttcttctgcgccaccaccctgaaacgcaaactcggttatgacgactccctggacgccttcggcgtgcacggtatcggcggtatcctcggcgcgatcctgaccggtgtgttcgccgcaccgtcgctgggtggcttcggcaccgtcaccgacatcgccgcacaagtctggattcagtgcaaaggcgtcggcttcaccgtgatctataccgcgatcgtcaccttcatcatcctcaaggtgctggatgccgtgatgggtctgcgcgtgaccgaggaagaagaatcggtcggcctggatctggcacaacacaacgagcgtggctacaacctgtaa

SEQ ID NO: 1855 - protein, 445 aa, Pseudomonas fluorescens PfO-1
MTLRKFAGLGALLSIVMPGLAMAADEVAAPVLNSGDTAWMLTSTALVLFMTIPGLALFYGGMVRSKNILSVMMQCFAITGLISVLWVIYGYSIAFDTTGMEQGVVNFNSFVGGFGKAFLAGVTPASLTGPAALFPEAVFITFQMTFAIITPALIVGAFAERMKFSAMLIFMGIWFTLVYAPIAHMVWSGNGGLMWDWGVLDFAGGTVVHINAGVAGLIACLVLGKRKGFPTTPMAPHNLGYTLMGAAMLWVGWFGFNAGSAAAANGTAGMAMLVTQIATAAAALGWMFAEWITHGKPSALGIASGVVAGLVAITPAAGTVGPMGALVIGLAAGVVCFFCATTLKRKLGYDDSLDAFGVHGIGGILGAILTGVFAAPSLGGFGTVTDIAAQVWIQCKGVGFTVIYTAIVTFIILKVLDAVMGLRVTEEEESVGLDLAQHNERGYNL

SEQ ID NO: 1856 - DNA, 1317 bp, Carboxydothermus hydrogenoformans Z-2901
  CDS (1)..(1317): transl_table=11
atgaagaagaaatttttatccttgctttttggcctaatccttttacctaatttatctttagccggagagccagggtataacccgggagatgttacctttgtactgctttcagcggcgttggtctttttaatgactccggggcttgccctgttttatggtggaatggtacgccggaaaaatgttttaaatacggtggcgatgagttttattgcgatagtggtagtttcactgcaatggattttaataggctataccctttcttttgggaatgatgtaaaaggaattatcggagatttttcttaccttggattaaaaaacgtaatgggtcttactgtttctaaccttcccggatacgtgtttgttgttttccaattaatgtttgccatcataacagcagctattatttcaggttcggtggtagaaaggatgagctttgctgcctggatcttatttattgctctctggacgacattagtctatgacccccttgcccatatggtctggggtggtgggatgctttttaagctaccgactttagattttgctggaggaacggtggtgcatataagttcgggaatatcgggcttggtggcagcacttatattaggtaaaagaaaagaaggggaaaatgctcccttaatgccgcataatttaccgcttaccattttaggggcggggcttctctggtttggctggtttggatttaatgcgggaagtgcccttgcagccaataatctcgcagcgctggcgtttattaacaccaatacttcggcggtaatggctgctctggcctgggccttagcggagtggctccatcgccggaaggttacggttttaggtattgccaccggggcggtggctgggctggtggcggttactccggcggcaggctttgttaccccaacatcttccgtttttattggcttagtcggtggggtcctggtctatattgcggtaggcatattaaaggctaagtttaattatgacgattctttggatgcttttggctgtcacggggtaggcggtatctggggagcagttgctacgggcatttttgccactaaagcggtaaacccggcgggagctgatggagtactttacggaaattttggtcaactattaaaccagttagctggagtagggttagcgattgcattagcggtagttggaactgttataattttaaagttaatcggtattttcctacctttgcgggttaaagatgaagcggaaagcataggcttggatattacagttcatggggaagatgcttataaagatttaatttttaccgggaagtcggttccgttttcttaa

SEQ ID NO: 1857 - protein, 438 aa, Carboxydothermus hydrogenoformans Z-2901
MKKKFLSLLFGLILLPNLSLAGEPGYNPGDVTFVLLSAALVFLMTPGLALFYGGMVRRKNVLNTVAMSFIAIVVVSLQWILIGYTLSFGNDVKGIIGDFSYLGLKNVMGLTVSNLPGYVFVVFQLMFAIITAAIISGSVVERMSFAAWILFIALWTTLVYDPLAHMVWGGGMLFKLPTLDFAGGTVVHISSGISGLVAALILGKRKEGENAPLMPHNLPLTILGAGLLWFGWFGFNAGSALAANNLAALAFINTNTSAVMAALAWALAEWLHRRKVTVLGIATGAVAGLVAVTPAAGFVTPTSSVFIGLVGGVLVYIAVGILKAKFNYDDSLDAFGCHGVGGIWGAVATGIFATKAVNPAGADGVLYGNFGQLLNQLAGVGLAIALAVVGTVIILKLIGIFLPLRVKDEAESIGLDITVHGEDAYKDLIFTGKSVPFS

SEQ ID NO: 1858 - DNA, 1515 bp, Burkholderia sp. 383
  CDS (1)..(1515): transl_table=11
atgcgcaaacttctgatgtccctgctgatggccggctcgctgatcgcggccggcgtcggctccgcgctcgccgacgacgcggcgtccgccgcggccgcgtccgcccccgccgcaatggcttccgacgcttcggctgccgccgctccggccgcttcggcaccggctgccaccgacgcatccgccacggccgctgccgccgcaccggcctcgggcgccaccgatgcatcggccgccgctgccgcttcggccccggccgcaccggccgcgccgaccgagccgttcacggtcgattcgtcgaagatcagtgcgggcgacaccgcgtggatgctgacctccaccgcgctcgtgctgttcatgacgatccccggcctcgcgctgttctacgccggcatggtccgcaagaagaacgtgctcgcgacggtgatgcagagcttcgcgatcaccgcggtgatcacggtgctgtggacggtggtcggctacagcctcgcgttcacgccgggcaacggcttcattggcggcctgtcgcgtgcgttcctgcacgggatgacctacgtcaagggcgacaaggcgacgacgctgaccgtcagccacctggcgacgacgattccggaatcggtctacttcgtctaccagatgacgttcgcgatcatcacaccggccctgatctgcggcgcgttcgccgaccggatgaagttttcggcgatgctcgtgttcatgacgctctggtcgctgatcgtctatgtgccgatcgcgcacatggtgtgggagccgaccggctggctgtcgtcggatggcgtgctcgacttcgcgggcggcacggtggtgcacatcaacgccggtatcgcgggcctcgtgtcatgcctgatgctcggcaagcgcatcggcttcggtcgtgaatcgatggcgccgcacaacctcgtgctgacgatgatcggcggctcgatgctgtgggtcggctggttcggcttcaacgcgggttccgcagtcgcggccgacggccgtgccggtttcgcgatgctgacgacgcaagtcgcgaccgcctgcgcggcgctcggctggatgttcgccgagtggatctcgcacggcaagccgtcggtgctcggcatcgtgtcgggtgcggtcgcgggtctcgtcgcgatcacgccggcagccggcttcgtcggcgtgacgggtgcactcgtgatcggcatcgcagccggcgtcgtgtgcttctggtcggcgacgtggctcaagtcgaagctcggctacgacgattcgctcgacgcattcggcgtgcacggcgtgggcgggattctcggcgcgctgctgacaggcgtgttcgcggtcaaggacatcggcggcgccgacggcagcctgctgctgcaggccaagggcgtgctgatcacgctggtctacagcggcgtgctgagcttcgtgctgctgaagctgatcgatctcacgatcggcctgcgcgtgtcggaagaagaagagcgcgaaggcctcgacgtggtcctgcacggcgagcatgtcgaataa

SEQ ID NO: 1859 - protein, 504 aa, Burkholderia sp. 383
MRKLLMSLLMAGSLIAAGVGSALADDAASAAAASAPAAMASDASAAAAPAASAPAATDASATAAAAAPASGATDASAAAAASAPAAPAAPTEPFTVDSSKISAGDTAWMLTSTALVLFMTIPGLALFYAGMVRKKNVLATVMQSFAITAVITVLWTVVGYSLAFTPGNGFIGGLSRAFLHGMTYVKGDKATTLTVSHLATTIPESVYFVYQMTFAIITPALICGAFADRMKFSAMLVFMTLWSLIVYVPIAHMVWEPTGWLSSDGVLDFAGGTVVHINAGIAGLVSCLMLGKRIGFGRESMAPHNLVLTMIGGSMLWVGWFGFNAGSAVAADGRAGFAMLTTQVATACAALGWMFAEWISHGKPSVLGIVSGAVAGLVAITPAAGFVGVTGALVIGIAAGVVCFWSATWLKSKLGYDDSLDAFGVHGVGGILGALLTGVFAVKDIGGADGSLLLQAKGVLITLVYSGVLSFVLLKLIDLTIGLRVSEEEEREGLDVVLHGEHVE

SEQ ID NO: 1860 - DNA, 1467 bp, Geobacter metallireducens GS-15
  CDS (1)..(1467): transl_table=11
atgaagtttaaactatcatttgtcgcattgctggcaactgtcgcgctctcgctcccggtcgccctcctggcagaggaggtgaagaccgccgctccggcacaggctgccctgtcctcggcccagacggctgcccttgcgcccgctgtcaccgcggcgcccgccgctgctccggccacccctgccgcaccgaaaaacgtcgatccggttctcaataccggcgacaccgcctggatgctcgtctccgccgccatggtcctcttcatgattccgggccttgccttcttctacggcggcatggtccggggcaagaacgtcctctcgacgatcatgcactcctttgtcgccatggggatcgtcggtgtgcaatgggcggtgattggctactccctctccttcggccctgacatcggcggcggcctcctcgggaacctgagcaaggcgctcctgaacggtctcatcaccttcaaggatggcaacccggtctacgccctctttcagaacgtgccgaccgcaccgggggccatccctgagtacgtcttcgccatgttccagtgcatgttcgccatgattaccgttgccctcatctccggcgccctggccgagcgggtgaagttctccgcctactgcgtcttcgtgctcctctggaccaccctggtgtacgaccccttggcccactgggtctggatgagcgacggctggctcttcaagaaaggcgctctcgacttcgccggcggcacggttgttcacctctcctccggtatctcggccctggcgtttctcatcttcctcggcaagcggcacgggtttccccacgagcggatggcgccccacagcctgccgctgactatgctcggcgtcggcatgctctggttcggctggttcggcttcaacgccggttccgccatcgtcggggccaactgctccgacgcggcgggggggctggccggtctcgcctttgccaccacgaccatcgcgccggctgccggcggcctttcctggatgatcgcggaatggattcacgcgggcaaaccttccgccctcggtttcggttccggtgtcgttgccggcctggtcgtcattacccccgctgccggtttcgtgcaacccggggccgccatcctcatgggacttgcggcgggcgtggtctgctatggtggcgtgctgctgaaggccaagctcaagtacgacgactccctcgacgccttcggtgtccacggagtgggggggaccttcggcgccctcaccaccggtatcttcgccaccgtcggcgccacggggctcctctccggcaatgtctcccagttcttaacccaggtgattgcagtcgtggccgccggcgcctatgccttcatcgtcacccttgttattgcctttgtcctccacaagaccatcgggctccgcgtggaaaaggaagacgagatcatggggctcgaccagacccagcattccgagtcggcctacaactga

SEQ ID NO: 1861 - protein, 488 aa, Geobacter metallireducens GS-15
MKFKLSFVALLATVALSLPVALLAEEVKTAAPAQAALSSAQTAALAPAVTAAPAAAPATPAAPKNVDPVLNTGDTAWMLVSAAMVLFMIPGLAFFYGGMVRGKNVLSTIMHSFVAMGIVGVQWAVIGYSLSFGPDIGGGLLGNLSKALLNGLITFKDGNPVYALFQNVPTAPGAIPEYVFAMFQCMFAMITVALISGALAERVKFSAYCVFVLLWTTLVYDPLAHWVWMSDGWLFKKGALDFAGGTVVHLSSGISALAFLIFLGKRHGFPHERMAPHSLPLTMLGVGMLWFGWFGFNAGSAIVGANCSDAAGGLAGLAFATTTIAPAAGGLSWMIAEWIHAGKPSALGFGSGVVAGLVVITPAAGFVQPGAAILMGLAAGVVCYGGVLLKAKLKYDDSLDAFGVHGVGGTFGALTTGIFATVGATGLLSGNVSQFLTQVIAVVAAGAYAFIVTLVIAFVLHKTIGLRVEKEDEIMGLDQTQHSESAYN

SEQ ID NO: 1862 - DNA, 1206 bp, Desulfovibrio desulfuricans G20
  CDS (1)..(1206): transl_table=11
atgaacgcggcagataccgctttcattcttgtctgttcggctctggtgatgtttatgacaccggggctggcgttgttttacggggggcttgtcagatcgcgcaatgtgctcagcaccaccatgcacagcgtggctttgctcggcattgcctcacttgtctggtgggcagtggggtattctctggcgttcggcagtgaccacgggggcattatcggcgggctggagtatctttttctgcataacgtaggcacggaaccgggtcctgtcgataatctgccgcatctgctgttcatggtttttcagtgcatgtttgccgttatcacaccggcgttgatttcgggtgcctatgccgagcgtatccgtttcggggcgatggtgctgttttctgttttatggcttgtgctggtgtatgcgcccatggcgcactgggtttggggcggcggatggatggcccggctgggtgcgcttgattttgccgggggggccgtggtgcatatgagctctgccgctgctgcgctggcggctgccaatgtgctgggactgcgccgcggatacgggcgcgaggcatttattccgcacaatctgcccatgacagtactgggagcaggtattctgtggttcggctggttcggttttaacgccggaagcgcgctggcggccaacggcgcggcagccaatgcatttgtaaccacacatcttgccgcggctgcggctctggtgggctggcttgccgtggaaaaactgcatggcggcagagcaaccacccttggtgcggcttcgggagccgtggcgggactggttgccattactcccgccgcagggtttgtcacaccggcttcagcggtgttcatcgggctggccggcggagtgctgtgttacggcggtgtgtttctcaagcacaagctgcgttatgatgacgctcttgatgtggtggggattcatggtgttgggggcacgtggggcgcgctggcaaccggaatttttgccgatgccgccgtgggcggggcagacggtctgctgcacggcaacgcatatcagctctgggtgcagtttgtctcggttgtggctacatggctgttttgctatgttgccagctggttgcttttcaaggctgtcgatgcggtcatgggactcagggtctccggtgaagccgagcttgccggtcttgatgtgagtgaacacaacgaaaccgcctaccagatgtaa

SEQ ID NO: 1863 - protein, 401 aa, Desulfovibrio desulfuricans G20
MNAADTAFILVCSALVMFMTPGLALFYGGLVRSRNVLSTTMHSVALLGIASLVWWAVGYSLAFGSDHGGIIGGLEYLFLHNVGTEPGPVDNLPHLLFMVFQCMFAVITPALISGAYAERIRFGAMVLFSVLWLVLVYAPMAHWVWGGGWMARLGALDFAGGAVVHMSSAAAALAAANVLGLRRGYGREAFIPHNLPMTVLGAGILWFGWFGFNAGSALAANGAAANAFVTTHLAAAAALVGWLAVEKLHGGRATTLGAASGAVAGLVAITPAAGFVTPASAVFIGLAGGVLCYGGVFLKHKLRYDDALDVVGIHGVGGTWGALATGIFADAAVGGADGLLHGNAYQLWVQFVSVVATWLFCYVASWLLFKAVDAVMGLRVSGEAELAGLDVSEHNETAYQM

SEQ ID NO: 1864 - DNA, 1413 bp, Synechococcus elongatus PCC 7942
  CDS (1)..(1413): transl_table=11
atgttcgacaaacgatggcgaactctgggtttgactgcagcactggctggcatttctgcatttctgctggcccatccaactctggcagcaactgcacctcagctaacgctggagcagctcaatagcaacgtcactgccgccaagactggaactgacacgctactcctcctaatcggctcagccctcgtccttttgatgacaccggggctagcctttttctatggcggttttggcagagcccagaacgtcctaaatatcatgatgatgagcttcttgatgatggggctcgtcggcatgacttgggtgatttatggctacagtctcgctttcgacaccagtttagggagtccctttatcggcggttttagtaacctgtttttcaatggtgtcggtggcaagtttggcattgatcctgtctgggccggcgatgagttgatgatctccggtatgtctgcctccagctttgcgctgtttcaaggcatgttcgcaatcattacgcccgctctgatttctggagcgctggtagagcgggtcaattttaaggcttggttctggttcggcttgctctggtccacgcttgtctacatccctatggcgcacatggtctggggaagcaatggctttatctatggccagattggcgccctcgactttgccggcggcaccgttgtccatattgcctctggggtgggtgccctagtgtccgtggcaatgatcggcccgcgtcgcgtcttcccgaatcgtctgtcgccgccgcacaatgtgccctttattttgttgggggcaggtctgctttggttcggctggtttggatttaacggcgcgagctacttcgctgcccaaggcgccggttttgccttcctcaccaccaatacggcagcagcaacagccatgctgacttggctattactcgagcagattgacctcgggaagcccaccgccgtaggcgccgcaaccggcgcggtggctggtctagtcggaatcacaccgtctgctgggttcattcctgtttgggcggcacttcccatcggtgccttgacagccctagtctgctttctgttcgtcgccaaagttaagagccggatccgactggatgattccctagatgcttttggggtacacggcgttggcggaaccgtcggcgctattctcacgggcatttttgcccagaaggatttcctcgttgagaaagctttcccaacccagttcaaggtgatctcccagggtcctttggccatgacttgggcacagatccaagccgtgttgattacctatctctttgttggcatcgctaccttcgtgatctggacgatcctgaaatcggtcatgcgtgtccgcgccacggaggaacaggagttggaagggctggactttgccctacacggcgaagatgcctacagcaaagagcgctag

SEQ ID NO: 1865 - protein, 470 aa, Synechococcus elongatus PCC 7942
MFDKRWRTLGLTAALAGISAFLLAHPTLAATAPQLTLEQLNSNVTAAKTGTDTLLLLIGSALVLLMTPGLAFFYGGFGRAQNVLNIMMMSFLMMGLVGMTWVIYGYSLAFDTSLGSPFIGGFSNLFFNGVGGKFGIDPVWAGDELMISGMSASSFALFQGMFAIITPALISGALVERVNFKAWFWFGLLWSTLVYIPMAHMVWGSNGFIYGQIGALDFAGGTVVHIASGVGALVSVAMIGPRRVFPNRLSPPHNVPFILLGAGLLWFGWFGFNGASYFAAQGAGFAFLTTNTAAATAMLTWLLLEQIDLGKPTAVGAATGAVAGLVGITPSAGFIPVWAALPIGALTALVCFLFVAKVKSRIRLDDSLDAFGVHGVGGTVGAILTGIFAQKDFLVEKAFPTQFKVISQGPLAMTWAQIQAVLITYLFVGIATFVIWTILKSVMRVRATEEQELEGLDFALHGEDAYSKER

SEQ ID NO: 1866 - DNA, 1296 bp, Rhodospirillum rubrum ATCC 11170
  CDS (1)..(1296): transl_table=11
atgatgagagccttcacgttcctccccgccgccctggtcgcccttctggcgccggccctggcctatgcccaggatgcggcccccaccctggattcgggcaataccgcctggatgctgacctcgaccgcgctggtccttctgatgaccatcccgggcctcgcgcttttctatgccggcatggtccgcaagaagaacgtgctggcgaccatgatgcagagcttcatcatcaccgcgctggtcagcgtcgtgtggatggtggccggctactcgatcgcctttggcaccggcaacgcctatttcggtgacttctcgaagttcctgctgtcggacatcagcattgacagcctgaacggcaccttccccgaaacggtgttcgtcgtcttccagatgaccttcgccatcatcaccccggccctgatcaccggcgccttcgccgaacgcatgaagttctcggcgatgctgtggttcatcggcctgtgggtgctgatcgtctacgcgccgatctgccattgggtgtggagttcctcgggcttcctgttcaacgccggcgtccttgattacgcgggcggcaccgtggttcacatcaacgccggcgtggccggtctggtctgcgccctcgtcttgcgtcgtcgcgccggcttcggcagcgagaacatggccccctataacctgtcgctggccgtgatcggcgccgccctgctgtgggtgggctggttcggcttcaacgccgggtccgccgtcgccgccgatggccgtgccggcatggccatgctggcgacccagcttggcgccgccggtgccaccttgtcgtggatcgccgccgaatggctggtgcgcggcaagcccagcgtgctgggcgcggtttcgggcgccgtcgccggtctggtcgccatcaccccggcctcgggcttcgttctgcccggtggcgccctggtcatcggcctggtggccggcgtcgtctgcttctggggcgcgacttggctgaagaagaccctgggctatgacgacagcctggacgccttcggcgtgcatggcatcggcggtctggtcggcgccctgctgaccggcgtcttcgccgcccagagcgttggtggcgaagccgccgtcggcctgctcgaaggcaatcccggtcaggtcctcacccaggcctggggctgccttgccaccatcgtgtggacggccgtcgcctcctacgtgatcttgaaggtcattgatctggccatcggcctgcgggtttcgcccgagcaggaaagcgaaggcctcgacatctcgctgcacggcgagcgcctgcagtaa

SEQ ID NO: 1867 - protein, 431 aa, Rhodospirillum rubrum ATCC 11170
MMRAFTFLPAALVALLAPALAYAQDAAPTLDSGNTAWMLTSTALVLLMTIPGLALFYAGMVRKKNVLATMMQSFIITALVSVVWMVAGYSIAFGTGNAYFGDFSKFLLSDISIDSLNGTFPETVFVVFQMTFAIITPALITGAFAERMKFSAMLWFIGLWVLIVYAPICHWVWSSSGFLFNAGVLDYAGGTVVHINAGVAGLVCALVLRRRAGFGSENMAPYNLSLAVIGAALLWVGWFGFNAGSAVAADGRAGMAMLATQLGAAGATLSWIAAEWLVRGKPSVLGAVSGAVAGLVAITPASGFVLPGGALVIGLVAGVVCFWGATWLKKTLGYDDSLDAFGVHGIGGLVGALLTGVFAAQSVGGEAAVGLLEGNPGQVLTQAWGCLATIVWTAVASYVILKVIDLAIGLRVSPEQESEGLDISLHGERLQ

SEQ ID NO: 1868 - DNA, 1404 bp, Moorella thermoacetica ATCC 39073
  CDS (1)..(1404): transl_table=11
ttgttcctggctgccgggaccgtcctggcccggccggcgctggcggcagccggggacgcggttgataccggcgataccgcttttatcttagtagccagcgccctggtcatgttgatgacccccggcctggccttcttttacggcggtatggtccgccagaagaacgtcctgggtatcatcatgcaatgcctggccactctggcccttatttccgtccagtgggtcctgtggggctattccctggcctttggtcccgaccatctccacctgctgggagggctggactgggcggggttccggggcgtcggtctggaacccaatcccctttacgccgccaccatcccccaccaggtattcgccatgttccagctcatgttcgcaataatcaccccggccctgataaccggtgcctttgccgagcgaatgcgcttcccggccttcctgctctttaccttaatgtgggctaccctggtctatgaccccctggcccactgggtctggggcgcggggggctggctgcgggaactcggcgccctggactttgccggcggcacggtggtgcatatcagcgccggcgtggccgggctggtctgcgccctggtcctgggacgccggcgggattacggccggatccccctgccgccccacaacctccccatgaccgttttgggcgccgcgctgttatggttcggctggttcggttttaatgccggcagcgccctaggggccaacggtctggccggtaacgccttcgtcactaccaatacggctgccggggccgccatcctgggctggctggcggtagagtggctgctccacggcaaacccaccgccctgggagcggccagcggcgcggtggcaggcctggtcgccatcaccccggcggccggtttcgtcactcccccggcggccctggtaatcggcggtatcggcggcgccctttgttgcctgtcagtggccgtggccaaggttaaactgggctacgacgattccctggacgcctttggctgccacggcgtcggcggtacctggggggccattgccaccggcatctttgccaccaaagccgtgaaccccgccggggccgacggcctgctttacggcaacgcccatttgctgggggtacaggtggtaggcgtggcggcggcctggatctttaccgccgcagtgacctacggcattctcaaggtcgtctccctgttgacacctctgcgggtcacagccgaggaagaggaagccggcctggatctctcccagcacggcgaaagcgcctatcccgacaccggcctggcagccctggaggtagcagagggtaaacgggttaccgccccgggagaactggcggtaaattggatggtgagccagggtaacccggccggaaccggtcttttccgccaggaataa

SEQ ID NO: 1869 - protein, 467 aa, Moorella thermoacetica ATCC 39073
MFLAAGTVLARPALAAAGDAVDTGDTAFILVASALVMLMTPGLAFFYGGMVRQKNVLGIIMQCLATLALISVQWVLWGYSLAFGPDHLHLLGGLDWAGFRGVGLEPNPLYAATIPHQVFAMFQLMFAIITPALITGAFAERMRFPAFLLFTLMWATLVYDPLAHWVWGAGGWLRELGALDFAGGTVVHISAGVAGLVCALVLGRRRDYGRIPLPPHNLPMTVLGAALLWFGWFGFNAGSALGANGLAGNAFVTTNTAAGAAILGWLAVEWLLHGKPTALGAASGAVAGLVAITPAAGFVTPPAALVIGGIGGALCCLSVAVAKVKLGYDDSLDAFGCHGVGGTWGAIATGIFATKAVNPAGADGLLYGNAHLLGVQVVGVAAAWIFTAAVTYGILKVVSLLTPLRVTAEEEEAGLDLSQHGESAYPDTGLAALEVAEGKRVTAPGELAVNWMVSQGNPAGTGLFRQE

SEQ ID NO: 1870 - DNA, 1410 bp, Burkholderia thailandensis E264
  CDS (1)..(1410): transl_table=11
atggccgacgacgcgtcgtcggcacccgccgccgcatcggccgcaacggcttccgacacgtcggcgagcgccgccgtcgcgtccgcgccggccgccgcttccgcggccgcttcggccgccgcgccggcttcggccgccgccgcgcccgccgcgccgaccgcgccgaccgcgccgttctccgtcgattcgtcgaagatcaattcgggcgacaccgcgtggatgctcacgtcgaccgcgctcgtgctgttcatgacgatcccgggcctcgcgctcttctacggtggcatggtccgcaagaagaacgtgctcgcgaccgtgatgcagagcttcgcgatcaccgcgctgatcacggtcctctggacggtggtcggctacagcctcgcgttcacgccgggcaacggcttcatcggcggcttctcgcgcgtgttcctgtccgggatgaactacatccacggcgacaaggcgacgacgctcaccgtcagccacctcgcgcagacgatcccggaatcggtctacttcgtctatcagatgacgttcgcgatcatcacgccggccctcatctgcggcgcgttcgccgaccggatgaagttctcggcgatgctcgtcttcatgacgctctggtcgctgatcgtctacgtgccgatcgcgcacatggtctgggagccgacgggctggctgtcgtcggacggcgtgctcgacttcgcgggcggcacggtcgtgcacatcaacgccggcatcgcgggcctcgtgtcgtgcctcatgctcggcaagcgcgtcggctacggccgcgaagcgatggcgccgcacaacctcgtgctgacgctgatcggcggctcgatgctgtgggtcggctggttcggcttcaacgcgggctccgcggtggccgccgacggccgcgccggcttcgcgatgctgacgacgcaagtcgccaccgcgtgcgcggcgctcggctggatgttcgccgagtggatcgcgaagggtaagccttcggtgctcggcatcgtgtcgggcgcggtcgcgggtctcgtcgcgatcacgccggcggccggcttcgtcggcgtcgcgggcgcgctcacgatcggcgtcgcggcgggcgtcgtgtgcttctggtcggcgacgtggctcaagcacaagctcggctacgacgattcgctcgacgcgttcggcgtgcacggcgtgggcggcattctcggcgcgctgctgacgggcgtgttcgcggtcaaggacatcggcggcgtcgacggcagcctgctgctgcaggcaaagggcgtcgcgatcacgcttgtctacagcggcatcgtcagcttcgtgctgctgaaggtgatcgacctcgtgatcggcctgcgtgtgacggaagaagaagaacgagaaggcctcgacgtgatcctgcatggcgagcacgtcgaataa

SEQ ID NO: 1871 - protein, 469 aa, Burkholderia thailandensis E264
MADDASSAPAAASAATASDTSASAAVASAPAAASAAASAAAPASAAAAPAAPTAPTAPFSVDSSKINSGDTAWMLTSTALVLFMTIPGLALFYGGMVRKKNVLATVMQSFAITALITVLWTVVGYSLAFTPGNGFIGGFSRVFLSGMNYIHGDKATTLTVSHLAQTIPESVYFVYQMTFAIITPALICGAFADRMKFSAMLVFMTLWSLIVYVPIAHMVWEPTGWLSSDGVLDFAGGTVVHINAGIAGLVSCLMLGKRVGYGREAMAPHNLVLTLIGGSMLWVGWFGFNAGSAVAADGRAGFAMLTTQVATACAALGWMFAEWIAKGKPSVLGIVSGAVAGLVAITPAAGFVGVAGALTIGVAAGVVCFWSATWLKHKLGYDDSLDAFGVHGVGGILGALLTGVFAVKDIGGVDGSLLLQAKGVAITLVYSGIVSFVLLKVIDLVIGLRVTEEEEREGLDVILHGEHVE

SEQ ID NO: 1872 - DNA, 1233 bp, Syntrophus aciditrophicus SB
  CDS (1)..(1233): transl_table=11
atgaatgcgggagatacagcttgggtgcttatatccaccgtactggtttttgtcatgacgcccggcctggcttttttctatggcggcctggtgcgtcggaaaaatgttctgtccattctcatgcagtgcttcatcatcatgtgcgtgatcagtctgcagtgggtcctgtacggatactcgctggccttcggcccggatacgggttgggggctcatcggcggtctttcgtgggtggggctctccggcgtgggaggttcgcccaacggcgattatgcgtcgaccattccccacctcgctttcatgatgtttcaggcgatgttcgccattatcacccccgcgctgatcatcggcgccttcgcggaaagggtcaggttctcggcttttctcgtgatgacggttctctgggccaccctggtctacgatccgctggctcactgggtctggggcagtggaggctggatgagaaacctgggagcgctcgatttcgcgggaggaatcgtggttcatgtcagttcggggatttccgccctggtcatggcgattctgctggggaaacggatcggctatgaaaaagagcctttccggccgcacaatctgccctttacggtcctgggaggcgcgctgctgtggttcggctggttcggcttcaatgcgggaagcgctctcggggcgaatgaactggcggccaatgcctttgtgacgaccaataccgcaacagcggccgccggcctgacctgggcactgatcgaatggcggctttccggcgccccgaccgtcctgggggccgtgaccggcgccgtggccggtctggtagccgtcacgccggcctgtggatttgtaaccccggtcaacgccatttttatcggggtgagcgtcagtgtgatctgctatgccgccatcgccgtcgtcaagggccggctgggttatgacgattccctggatgctttcggtgttcacggagtcggcggggcctggggaacgattgccaccggacttctcgcggaaaaggcggtcaatgccgccggggcggacggcctgtttttcggcggtctgcatcagtttcttgttcagttgatgctggtgggcgttaccgttctgtatgccggggtcgttaccttcatcctcttcaaggttgtggatgcccttctcggcatgaaagtggacaggaaaagtgaaatcctggggctggatctcagccagcaatgcgaatcggcctacacggtcgtcgattag

SEQ ID NO: 1873 - protein, 410 aa, Syntrophus aciditrophicus SB
MNAGDTAWVLISTVLVFVMTPGLAFFYGGLVRRKNVLSILMQCFIIMCVISLQWVLYGYSLAFGPDTGWGLIGGLSWVGLSGVGGSPNGDYASTIPHLAFMMFQAMFAIITPALIIGAFAERVRFSAFLVMTVLWATLVYDPLAHWVWGSGGWMRNLGALDFAGGIVVHVSSGISALVMAILLGKRIGYEKEPFRPHNLPFTVLGGALLWFGWFGFNAGSALGANELAANAFVTTNTATAAAGLTWALIEWRLSGAPTVLGAVTGAVAGLVAVTPACGFVTPVNAIFIGVSVSVICYAAIAVVKGRLGYDDSLDAFGVHGVGGAWGTIATGLLAEKAVNAAGADGLFFGGLHQFLVQLMLVGVTVLYAGVVTFILFKVVDALLGMKVDRKSEILGLDLSQQCESAYTVVD

SEQ ID NO: 1874 - DNA, 1290 bp, Frankia sp. CcI3
  CDS (1)..(1290): transl_table=11
atggacaaattgaattcgggcgataccgcgtggatgctcatcagttccgcgatcgtgctgttcatgacgcccggactggcgttcttctacggtggcatggtccgagcgaagaacgtgctcggaatgatcatgcagaacttcttctgcatcgggatcgtcacgctgatctggtcggtcatcgggttcagcgtcgcgttcggcgagggtaacggcttctggggcggattcgacttcttcgctctccaggacctctccggcagcgacggcgcgatcccgtacgtcgtgttcgtcgccttccagctgatgttcgcgatcatcacgcccgccctcatcaccggcgcgatcgccgatcgcatgaagttcagcgccttcgcgatcttcatcccgctctggtcgctgctggtctactcgccgatcgcacactgggtgtgggcgagcaagggctggttgttcgagcgcggcgcgatggacttcgcgggcggcacggtcgtccacgccaacgccggtatcgcggcgatcgtgctggcgctggtcctcggcaagcgggccggttggccgaccggcgacttccgcccccacaacgtcccgttcgttctcctgggcaccggcatcctgtgggtcggatggttcgggttcaacgcgggttccgcgctgggcgccaacaaggtcgccggatacgccctgctcaacacccagatcgcgaccggcgtcgcgatcctcggatggctcgcggtcgagcagctgcgcgacggcaaggcgaccaccctgggagccgcctccggcgcggtcgcgggtctggtggccatcaccccggcctgtggtttcgtctctccgatgggttcgatcgccatcggcggcatcgccggcgtcgtctgcgccctggccacctcgatcaagggcaaggtcggcatcgacgactcgctcgacgtcggtgcggtccacctggtcggcggtgtgctcggagccctgctgaccggcctcttcgccaccgtcgacacgaacgaggccggcaaggacggtgtcttctacggcggcccgtggagcgtcttcggggaacaggcgctcgccgtcggcgcgacgctgggctactcggccgtcgtgacggcgatcatcgctctcgccctgaagtacaccatcggtctccggctgaacgccgacgacgagatcgccggcatggacgaggcgttgcacggggagacggcgtaccgcttcacgtccatcggcggtagcggctcgctgtccacgagcagcatcagccccgtcaaggtgcccgaggaggcccaggcatga

SEQ ID NO: 1875 - protein, 429 aa, Frankia sp. CcI3
MDKLNSGDTAWMLISSAIVLFMTPGLAFFYGGMVRAKNVLGMIMQNFFCIGIVTLIWSVIGFSVAFGEGNGFWGGFDFFALQDLSGSDGAIPYVVFVAFQLMFAIITPALITGAIADRMKFSAFAIFIPLWSLLVYSPIAHWVWASKGWLFERGAMDFAGGTVVHANAGIAAIVLALVLGKRAGWPTGDFRPHNVPFVLLGTGILWVGWFGFNAGSALGANKVAGYALLNTQIATGVAILGWLAVEQLRDGKATTLGAASGAVAGLVAITPACGFVSPMGSIAIGGIAGVVCALATSIKGKVGIDDSLDVGAVHLVGGVLGALLTGLFATVDTNEAGKDGVFYGGPWSVFGEQALAVGATLGYSAVVTAIIALALKYTIGLRLNADDEIAGMDEALHGETAYRFTSIGGSGSLSTSSISPVKVPEEAQA

SEQ ID NO: 1876 - DNA, 1359 bp, Novosphingobium aromaticivorans DSM 12444
  CDS (1)..(1359): transl_table=11
ttgagcgtgccttccatttccgaccttaggggaaccaacatgatccgcaagatgatcggtggcttggcgggaacgggcgcttcgctcttcgctgccacggctgctcacgcgcaggaggccgcagcggccactgtcgacaagggcgataccgcctggatgctgacttcgacaattctcgtgctgatgatgatcctgccgggcctggcgctgttctacggcggcctgacccggaccaagaacatgctctccacgatgacccagatcggcgccgtcgcgtgcttcgcgatgctgctgtgggtcatgtacggctatggccttgcattcggccccgaaggcaacgccttcatcagttggggcaagtggttccttgcgggcgttaccccggcaagccaggccgcgaccttcactgcgggtgtcgaaatcccggaatacgtgttcatctgcttccagatgacgtttgcggcgatcacaatcgcgctggttctcggctcggtcgtcgaacgcatgaagttttcggcggtgatggcgttcgcggccgtgtggctgaccatcgtctacttcccgatcgcacacatggtctgggcggcgggcggcctgttcttcgacatgggcgctctggatttcgccggcggtacggtcgttcacatcaacgctggcgtctcggcactggtggcctgccttatcctcggcaagcgcatcggtttccagaaggacatcatggcgcctcactcgctgaccatgaccggcatcggcaccggcctgctgtgggtgggttggttcggcttcaacgccggttcggcgcttgaagcaaacggctcggctgcgcttgccatgatcaacactttcgtcgccaccgcttcggccggtctgttctggatgcttgccgagcgtctttcgggccacaagggttcggcactcggcttctgctcgggcatcatcgccggcctcgtcgccgtgacgcctgccgccggcaactctggtcctttcggcgcgatcgttctcggtggcctcgcctcggtcgtctgcttctacatggtcaccgtggtgaagcccaagcttggctatgacgacgctctcgatgctttcggcatccatggcgtcggcggcatgatcggcgcggtcggtaccgcagtcgtctatgcgccctcgctgggtggtccgggcgccgccgactacgacatgggcgccaagctcgtcgtccagatcatggcggtcggcaccaccatcgtctgggccgcgattggcacggtcgtcgccatgtacgtcgccaaggctctgaccggcctgcgggtcaccgaagaagtcgaacgcgaaggcctcgacctcggtgagcatggcgagcgcgcctacaactactga

SEQ ID NO: 1877 - protein, 452 aa, Novosphingobium aromaticivorans DSM 12444
MSVPSISDLRGTNMIRKMIGGLAGTGASLFAATAAHAQEAAAATVDKGDTAWMLTSTILVLMMILPGLALFYGGLTRTKNMLSTMTQIGAVACFAMLLWVMYGYGLAFGPEGNAFISWGKWFLAGVTPASQAATFTAGVEIPEYVFICFQMTFAAITIALVLGSVVERMKFSAVMAFAAVWLTIVYFPIAHMVWAAGGLFFDMGALDFAGGTVVHINAGVSALVACLILGKRIGFQKDIMAPHSLTMTGIGTGLLWVGWFGFNAGSALEANGSAALAMINTFVATASAGLFWMLAERLSGHKGSALGFCSGIIAGLVAVTPAAGNSGPFGAIVLGGLASVVCFYMVTVVKPKLGYDDALDAFGIHGVGGMIGAVGTAVVYAPSLGGPGAADYDMGAKLVVQIMAVGTTIVWAAIGTVVAMYVAKALTGLRVTEEVEREGLDLGEHGERAYNY

SEQ ID NO: 1878 - DNA, 1314 bp, Novosphingobium aromaticivorans DSM 12444
  CDS (1)..(1314): transl_table=11
atgcggaaatatctggcgacggcgcttgccgccaccgtggcgttgcttccggttctggcacacgcgcaaacaggcgctgtcagcgtcgaagacgtggccgacaccggcgacacggcttggatcctcgtctcctcggccttcgtcctgatgatggcgatgccgggcctcaccctcttctacggcggcctcgtccgcgccaagggcttccttgccgtcctcgtccaggtcggcgcgatcgccgccgtggcttcggtcctctgggtcgcggtcggatacacgcttgccttcggtgacgtgtcgggcggctggatcggtggcggaaatgcgtggatgctgctgaacctcggcaacgtccgagccaacaccgccattccggaaagcgccttcgcgctgttccagatgtgtttcgcactcatcacgcccgcgctgatggtcggcgcctgggtggaccgcgcacgcttcggctgggtcgtggccttctccgccctgtggagccttatcgtctacgcgccggttgcccactgggtctggggcggcggctggcttgccacccggttcggcacactcgatttcgccggcggcatcgtggtccacaccacggccggtgtctcggcgctcgtcgtcgccatgctcctcggcaagcgcgccggcttcccccggacgctcatgctgccccacagcccctcgctgaccatggcgggcgccgcgctcctgtgggtgggctggttcggcttcaacggtggctccgcactggccgccaatgacgatgcagcctcggccatcatcaacacccacgtcgcggcctgcgtcgcggcacttgtatggctgatcatcgaaaagctcagcgtgggcaagccgacctcggtcggcttcgcgaccggcgcggtcgccggcctcgccacggttacccccgccgccgggttcatttcgcccggcgcggcaatgctcttcggcgccgccgccgcatgcgtctgctatccgatgatccagatcgtgaagcagcgcctcgagatcgacgattcgctcgatgtcttcgcggtccacggcgttggcggcatgatcggttcgcttcttctggcggtcttcctcgcgccctccttcggcggcacgggctatgccgatggcatgaacctcgcgcgccaggccgtcgcccagtttgccggtgtcggcatcgtcgcggcatggagcgcgtttgccaccgtcatctgcgccctcatggtatcgatggtcattccgatgcgcgtgaccgaggacgaggaacgcgaaggcctcgacatcaccagccacggcgaacgcgcctgggaattcgattga

SEQ ID NO: 1879 - protein, 437 aa, Novosphingobium aromaticivorans DSM 12444
MRKYLATALAATVALLPVLAHAQTGAVSVEDVADTGDTAWILVSSAFVLMMAMPGLTLFYGGLVRAKGFLAVLVQVGAIAAVASVLWVAVGYTLAFGDVSGGWIGGGNAWMLLNLGNVRANTAIPESAFALFQMCFALITPALMVGAWVDRARFGWVVAFSALWSLIVYAPVAHWVWGGGWLATRFGTLDFAGGIVVHTTAGVSALVVAMLLGKRAGFPRTLMLPHSPSLTMAGAALLWVGWFGFNGGSALAANDDAASAIINTHVAACVAALVWLIIEKLSVGKPTSVGFATGAVAGLATVTPAAGFISPGAAMLFGAAAACVCYPMIQIVKQRLEIDDSLDVFAVHGVGGMIGSLLLAVFLAPSFGGTGYADGMNLARQAVAQFAGVGIVAAWSAFATVICALMVSMVIPMRVTEDEEREGLDITSHGERAWEFD

SEQ ID NO: 1880 - DNA, 1386 bp, Desulfitobacterium hafniense Y51
  CDS (1)..(1386): transl_table=11
atgaaaagagtatgggtattattattagcgattataagcatgttggctctgcctgttgcagttttggcggaagatggtgctgtggtggatacaggggacaccagcttcattattttatcagcggccctggtttttctcatgacccccggcctggcgttattctatggcggtatggttcgtaaaaagaatgttctgagtacggtgatgcatagttttattctcatgggtgtatcttccgtactttgggtgttgatcggctttagcttggcctttggtacagaccatgccggtattatcggaagtttagagtggattggcctcagcggtgtcggtatggaacctaatggagattactcctcgaccatccccttcctcttattcatggccttccaaatgatgtttaccatcattactccggcaattatctcgggttctgttgctgaacgcatgcggttcccggcctttctgggatttatggttctgtggttgttggttgtctattatcccctggctcactcggtatggggtgtgggtggtttcctgcgtgaaatgggagcattggattttgcaggcggaactgttgtgcatatcagctcaggggttaccggtttagtcgctgctttaatcctgggcaaacgcaaagggcatggcaaagaacctatggctcctcatcaattgcctatgacggttttaggggcaggtctgctctggtttggctggtttggctttaatgccggcagtgccttaggcgccaatggattagccgccatggctctggtcacgaccaatacttcagctgccgccggtgctttagcctggatggccacagaatggatgcaccgtggtaagcccaccattttgggcgcagccagtggtgccattgcagggcttgtagcgattaccccaggagcaggtttcgtcactcccatgtcctctctggtgattggcctcgtcggtggagccatttgctacttcggagtcagtgttcttaaggcaaaacttggctatgatgattctttggatgctttcggttgtcatggaatcggtggaatctggggagctctggcaacgggtatcttcgcttcggcttctgtggggggaactgacggattgttgtatggaaatgcagctcaggtagggattcaagccatcggtgttgctgtaactattgttctggcagtcgttgccacatttataattatgaagctggtcggtatattcacacccttgcgggttactgctgaagaagaagagatgggcctggacatctccctccatggcgaagaggcttaccccgactttatcggcagtggttatcttcccacaattgtatcggctgccaaagcagtcagtgtttccacacccagcggtcagccgggaaaatag

SEQ ID NO: 1881 - protein, 461 aa, Desulfitobacterium hafniense Y51
MKRVWVLLLAIISMLALPVAVLAEDGAVVDTGDTSFIILSAALVFLMTPGLALFYGGMVRKKNVLSTVMHSFILMGVSSVLWVLIGFSLAFGTDHAGIIGSLEWIGLSGVGMEPNGDYSSTIPFLLFMAFQMMFTIITPAIISGSVAERMRFPAFLGFMVLWLLVVYYPLAHSVWGVGGFLREMGALDFAGGTVVHISSGVTGLVAALILGKRKGHGKEPMAPHQLPMTVLGAGLLWFGWFGFNAGSALGANGLAAMALVTTNTSAAAGALAWMATEWMHRGKPTILGAASGAIAGLVAITPGAGFVTPMSSLVIGLVGGAICYFGVSVLKAKLGYDDSLDAFGCHGIGGIWGALATGIFASASVGGTDGLLYGNAAQVGIQAIGVAVTIVLAVVATFIIMKLVGIFTPLRVTAEEEEMGLDISLHGEEAYPDFIGSGYLPTIVSAAKAVSVSTPSGQPGK

SEQ ID NO: 1882 - DNA, 1296 bp, Saccharophagus degradans 2-40
  CDS (1)..(1296): transl_table=11
atgaaaccccttcttcgcacgttgccattggcagcactgctattgccaagtattgccttagcagatgacttaaatggtgcaaacaccgcatggatacttaccgctactgctttagtactctttatgacgttgcccggcctgtcgcttttttacggcggtttggtgcgcacaaaaaatgtactaagtgtgcttatgcaatgcttcgccattgcgtgtatcgcatcgttaatttggtttgcattcggctatagcctcgctttctctgaaggcaatatgattattggagacctaagcaaagccttttttaatggcatgggtaaaaattcaatgtctggcgatatacccgagccactctttgctatgtttcaaatgacctttgtgattatcacccctgcgttaattgtgggtgcatttgcagagcgtatgaagttctcttcggtgctcatttctaccgttttatggatacctcttgtttacgcacctgtttgtcattgggtgtggggcggcggttggttagctagccagtttggtgtactcgactttgccggcggtactgttgtgcatattactgcgggtgtagctgcactggtaactgcacttatgattggcaatcgtaatggttttccacatacgccgatgcccccgcataacatgacaatgaccgtaacaggcgcgggtatgttgtgggtaggctggttcggttttaacgctggtagtgcgctaagcgcgggtggcgatgccgccatggcaatgctggttacgcacatatctgctgctgccggttcgttagcatggatgaccatcgaatggctcaagtttggtaagccaagcgtgttgggtattgttaccggtatggttgcaggtttaggtactattacacctgcgtctgggtttgttggccctggtggtgcgttagtcattggtataaccgctggtgtagtgtgtttttatgccacccagttaatcaaacgcaaactagttattgatgactctcttgacgttttcccagtgcacggcgttggcggtattttgggtactatgcttgccggtgtatttgcctctacaagtattggtgctttctctggccacggtttcgcagatggaatagaaacaatgggtgcgcaggtttggtctcagtttgtgggtgtcattactactattgtgttcacagcggttatgacctacatcatcattaaagttaccggttggattacaggcggtatacgtgtcgacaaagatgaagagacccaagggttagacttagtattacacgacgaagcaggttataaactttaa

SEQ ID NO: 1883 - protein, 431 aa, Saccharophagus degradans 2-40
MKPLLRTLPLAALLLPSIALADDLNGANTAWILTATALVLFMTLPGLSLFYGGLVRTKNVLSVLMQCFAIACIASLIWFAFGYSLAFSEGNMIIGDLSKAFFNGMGKNSMSGDIPEPLFAMFQMTFVIITPALIVGAFAERMKFSSVLISTVLWIPLVYAPVCHWVWGGGWLASQFGVLDFAGGTVVHITAGVAALVTALMIGNRNGFPHTPMPPHNMTMTVTGAGMLWVGWFGFNAGSALSAGGDAAMAMLVTHISAAAGSLAWMTIEWLKFGKPSVLGIVTGMVAGLGTITPASGFVGPGGALVIGITAGVVCFYATQLIKRKLVIDDSLDVFPVHGVGGILGTMLAGVFASTSIGAFSGHGFADGIETMGAQVWSQFVGVITTIVFTAVMTYIIIKVTGWITGGIRVDKDEETQGLDLVLHDEAGYKL

SEQ ID NO: 1884 - DNA, 1305 bp, Methylobacillus flagellatus KT
  CDS (1)..(1305): transl_table=11
atgaagcgatttttatccatttctaccttgctgggcggcatgctggcggcaggttccagcttggctgaagaagtagccgaggaagcgccggcaatattgaacagcggcgataccgcgtggatgatcgtagccaccgtgctcgtcatcatcatggccgtgcctggcctcgccattttctacggcggcatggcacgttccaagaacatgttatcggtactcatgcaggtgctggtgacattctcactgctgtccgtattgtgggcagtgtatggctacagcctggtcttcaccgagggcaatgccttcatcggcggcctgagcaaggcgtttctgtcgggcattacgccggatagcctggagggcaccattcctgaactgttgtttgttaccttccagatgacattcgcggccattacaccggccctgatcgtcggcggctttgccgagcgcatcaagttctctgcagtcctgctgttcatggtgctgtggatgactttctcctacctgcccatggcgcacatggtctggggcggcggctggatcggcgaaatgggcgcggctgactttgctggcggcaccgtggtgcacatgaacgcgggtattgctgccctggtcggcgccttggtactgggcaagcgcatcggcttcggcaaggaagccatgcctccgcacaacatggtcctgaccatggtcggtggctccctgctgtgggctggctggttcggcttcaatgtcggcagtgaattggctgctgacggcatggctggcctggcagtggtcaacactcagctggcaactgcctccgctgtcgttggctgggtcattgccgagtggctgagcaagggcaaaccttccatgctgggcgcaatttcgggtgccattgccggtctggttgccatcactcccgcttgtggcttcgtcggtccgatgggtgcgatcgtgctcggcttcatcgccagcctcatcagcttctggtccgtcaccaagctcaagaacgccctgggctacgatgacaccatggatgtattcggtgttcacggcatcgccggtatcgtcggtgcattgggtactggcatcttcatggcgtcatccctgggcggcgtcggttacgacgaaggcgtgaccatgggccaccagctctacgtgcaagccgtgtcagtgggcttcaccgtggtctacgtcagtatcgtcagctacatcctgttcaagatcgtggacctggtcgtcggcctgcgtgtctccgaagaggaagagcgcgagggcctggataccgcatcccacggcgagcgtgcgtaccactcctaa

SEQ ID NO: 1885 - protein, 434 aa, Methylobacillus flagellatus KT
MKRFLSISTLLGGMLAAGSSLAEEVAEEAPAILNSGDTAWMIVATVLVIIMAVPGLAIFYGGMARSKNMLSVLMQVLVTFSLLSVLWAVYGYSLVFTEGNAFIGGLSKAFLSGITPDSLEGTIPELLFVTFQMTFAAITPALIVGGFAERIKFSAVLLFMVLWMTFSYLPMAHMVWGGGWIGEMGAADFAGGTVVHMNAGIAALVGALVLGKRIGFGKEAMPPHNMVLTMVGGSLLWAGWFGFNVGSELAADGMAGLAVVNTQLATASAVVGWVIAEWLSKGKPSMLGAISGAIAGLVAITPACGFVGPMGAIVLGFIASLISFWSVTKLKNALGYDDTMDVFGVHGIAGIVGALGTGIFMASSLGGVGYDEGVTMGHQLYVQAVSVGFTVVYVSIVSYILFKIVDLVVGLRVSEEEEREGLDTASHGERAYHS

SEQ ID NO: 1886 - DNA, 1500 bp, Burkholderia xenovorans LB400
  CDS (1)..(1500): transl_table=11
atgcgcaaattattgatgtccttgctgatggccggttcgctgctcgcgggcggtatcggcgctgctctcgcggacgacgcgtccgctcccgcagccgcctcggctcccgatgcgacggcgagcgccccggcaccggacgcttcggcggcacccgctgccgccgccgcttcggcacccgccgccgatgcatccgccgcaccggctgccagcgcggccgccgcacctgctgcatcggacgccgcgccggccgcgccgaccgcaccgttctccgtcgattcctcgaagatcaattccggcgacaccgcctggatgctgacttccaccgccctcgtgctgttcatgacgatcccgggtctggcactgttctacggcggcatggtccgcaagaagaacgtgctcgcgatcctgatgcaaagcttcgcgatcacctgcgtggtgacgatcgtctggatcgtgatcggctacagccttgccttcacgccgggcagttcgttcatcggcggcttctcgcgcgtcttcatggcgggcatgagctacatcaagggcgacaaggccacgacgctgaccgtcagccatctggccccgacgatcccggaaacggtctattgcgtctatcagatgacgttcgcgatcatcaccccggcactgatcacgggcgcgtttgccgaccgtatgaagttctcggcgatgctggtgttcatgacgctgtggtcgatcatcgtctactcgccgatcgcacacatggtctgggaaccgaccggctggctggctagcgcgggcatcctcgacttcgcgggcggcacggtggtgcacatcaacgccggtattgcggcgctggtctgcgcgctggtcctcggcaagcgtatcggctacggcaaggaagcgatggcgccgcacaacctgacgctcacgctgatcggcggcgccatgctgtgggtgggctggttcggcttcaacgcgggttcggcagtggcggctgacggccgtgccggtttcgcgatgttcgcaacccaggtggcaactgccgcggcagcactcgcctggatgttcgctgaatgggccgccaagggtaagccgtcggtgctcggtatcgtgtcgggcgcagtggcaggtctggtggcgatcacgccggcttcgggcttcgtcggtacgctcggctcgctggtgatcggtatcgtggcaggcgtggtctgcttctggtcggcaacgtggctcaagcacaagctcggctacgacgattcgctcgacgcgttcggcgtgcactgcatcggcggtatcgtgggtgcgctcctgaccggcgtgttcgcggtcaaggacatcggcggcgcggacggcagcgtcatcctgcaagccaagggcgtgctgacgacgctgatctacagcggcgtggtgagctacatcctgctgaagatcatcgacatggtgatgggcattcgcgtgacggaagaacaggaacgcgaaggtctggacgtgagcctgcacggcgaacacgtcgagtaa

SEQ ID NO: 1887 - protein, 499 aa, Burkholderia xenovorans LB400
MRKLLMSLLMAGSLLAGGIGAALADDASAPAAASAPDATASAPAPDASAAPAAAAASAPAADASAAPAASAAAAPAASDAAPAAPTAPFSVDSSKINSGDTAWMLTSTALVLFMTIPGLALFYGGMVRKKNVLAILMQSFAITCVVTIVWIVIGYSLAFTPGSSFIGGFSRVFMAGMSYIKGDKATTLTVSHLAPTIPETVYCVYQMTFAIITPALITGAFADRMKFSAMLVFMTLWSIIVYSPIAHMVWEPTGWLASAGILDFAGGTVVHINAGIAALVCALVLGKRIGYGKEAMAPHNLTLTLIGGAMLWVGWFGFNAGSAVAADGRAGFAMFATQVATAAAALAWMFAEWAAKGKPSVLGIVSGAVAGLVAITPASGFVGTLGSLVIGIVAGVVCFWSATWLKHKLGYDDSLDAFGVHCIGGIVGALLTGVFAVKDIGGADGSVILQAKGVLTTLIYSGVVSYILLKIIDMVMGIRVTEEQEREGLDVSLHGEHVE

SEQ ID NO: 1888 - DNA, 1533 bp, Ralstonia metallidurans CH34
  CDS (1)..(1533): transl_table=11
atgaaaacctggttcaagcgaatcctgacggccggcgcgatgacgctggcgctcggcacggccggtctcggcctctccacccacgccgtggcgcaggacaagcccgccgcggaagcatcggccgcgacggcgtccgcaacccccgcagccgccgttgcagcaccggctgcggccacgcctgccgcggcgcccgccgaagctgccgccgcgccggctgccccggtgcccaacaagggcgacacggcctggctgctggtctccaccacattcgtgatcctgatgacgctgccgggcctggcgctgttctacggtggcctggtccgctcgaagaacatgctgtcggtgctgatgcagtgcctgatgatcttctcggtgatctcgatcctgtgggccatctacggctatagcttcgcgttcacggagggcaacgccttcttcggtggcacggaccgtctgttcatgaagggcctgacggtcgatgccgtggccgccacgttcagcaagggcgtggtggtgccggaactgggctacttcgcgttccagtgcgcgttcgcggcgatcacttgcagcctgatcatcggcgccttcgccgagcgcgccaagttctcagcggtgctggtcttcgtggtcctctggttcacgttcgcctacatcccgatggcccacatggtctggttctggcccggcccggatgcgtacaccgacgccgccgcaggcaccgccgccaccgccaaggccggctggctgttccagaagggcgcgctcgatttcgcgggcggcacggtggtgcacatcaacgcggccgtggccggtctggtgggcgcgttcatgttcggcaagcgcatcggcttcggtcgtgaagcgatccgcccgcacagcctgaccttcacgatggtgggcgcctcgctgctgtggttcggctggttcggcttcaacgccggttcggccctggaagccaacggcagcgccgcgctggccttcgtcaacacgctgttggccacggccgccgcggtggtttcctggaccttcggcgagtggatcggcaagggcaagccgtcgatgctcggtggcgcctcgggggctgtcgccggcctggtggcgattaccccggccgccggcttcgttggcccgatgggctcgatcgcgatgggcctgatcgccggcctgctgtgcctgtggggcgtgaccggtctgaagcgcctgctgggcatggacgattcgctggacgtgttcggtgtgcacggcgtgggcggtattctcggcgcgctgctgaccggtgtgttcgccgcgccgagcctgggcggtacgggcatctatgactacgttgccaacaaggtggccgacgactactcgatcgccggtcaggtctggatccagttcgaaggtgtgctgaccacgatcgtctggtccggcgtggtcgcgctggtggcctacaagctgatcgatatgctgattggcctgcgcgtgccggaagaggaagagcgcgaaggtctggatatcacctcgcacggtgaaaccgcgtatgaggtctga

SEQ ID NO: 1889 - protein, 510 aa, Ralstonia metallidurans CH34
MKTWFKRILTAGAMTLALGTAGLGLSTHAVAQDKPAAEASAATASATPAAAVAAPAAATPAAAPAEAAAAPAAPVPNKGDTAWLLVSTTFVILMTLPGLALFYGGLVRSKNMLSVLMQCLMIFSVISILWAIYGYSFAFTEGNAFFGGTDRLFMKGLTVDAVAATFSKGVVVPELGYFAFQCAFAAITCSLIIGAFAERAKFSAVLVFVVLWFTFAYIPMAHMVWFWPGPDAYTDAAAGTAATAKAGWLFQKGALDFAGGTVVHINAAVAGLVGAFMFGKRIGFGREAIRPHSLTFTMVGASLLWFGWFGFNAGSALEANGSAALAFVNTLLATAAAVVSWTFGEWIGKGKPSMLGGASGAVAGLVAITPAAGFVGPMGSIAMGLIAGLLCLWGVTGLKRLLGMDDSLDVFGVHGVGGILGALLTGVFAAPSLGGTGIYDYVANKVADDYSIAGQVWIQFEGVLTTIVWSGVVALVAYKLIDMLIGLRVPEEEEREGLDITSHGETAYEV

SEQ ID NO: 1890 - DNA, 1419 bp, Acidobacteria bacterium Ellin345
  CDS (1)..(1419): transl_table=11
atgcgtcgagtggttgcgaaacttcttctcggtctaaccttgctcgctttcgctgcgccgctggtgagcgcgcaaaccgctgcaacgcctccagatcgaatcgctcaactagaagccaaagttaccgatgccaagaattcggcggacaacgcctggatgctggtttgcgccgccctggtactgatgatgactgcgccgggactggcgctgttctatggtggcctggtgcgcaaaaagaacgtgctggcgacgatgctgcagagcttctcgatgatggcgatcatcaccgttctgtgggcgttgatcttgtatagcctggcgttcggctcgggaagttcgttcatcggcggctggcacaacgcgtttttgcacggcgtggggctggcccccgacacggattatgcgccgaccattccggcgcagacgttcatgatttaccagctgatgttcgcgatcattacgccggcgctgatcaccggcgcattcgcggaacggatgaagttcagcgcgatggcagtgttcatggtgctgtggtctctgattgtttacgcaccgatggcgcacatggtttgggggaagggcggactgctgaacgcttcgctgggcggcaggttcccgaccctggatttcgcgggtggaacggtggtgcacataacttccggtgtctcggcactggtgtgcgcgctgtatctcgggaagcgtattggatatccgaaggagccgatgccgccgcatagcgtggtgctgagctttattggcgcaggattgctttgggtgggctggtttggatttaacgcgggcagtgcgctatcggcgggaacgctggcgacgagcgcgtttgtggcgacccactttggcgcggcggcggcggtgattggctggtcggcggcagagtggctccacaacggcaagccgactacgctgggcgcgatctcgggcgcggtggcggggctggtggcgattacaccggcggcgggcttcgtcagccctatgtcagcgctgtttatcggcctgctggcaggtgccttctgcttcacgatggtcgccttcgcgaaagcgaagttcggctatgacgattcgctggacgccttcggcgtacacggcgcgggcggaacgctcggtgcaatcctgactggcgtgttcgcgtcgagcgcgatcaacccgatgttcaaggatgcgaggggcaatcccctaccctcgggtttcatcgaaggcaattatcgccagctattgaaccagggcgtgggcgtggtgattgcgtggagcctggctatcgtgggaacactcgcgattctgttcctggtggacaaattgatcggcctgcgcgtgagtgaagaacacgaggttgcaggactggatatttcgctgcacggcgaagagggctattactgggaagcttccatgagtcaaaattcgtag

SEQ ID NO: 1891 - protein, 472 aa, Acidobacteria bacterium Ellin345
MRRVVAKLLLGLTLLAFAAPLVSAQTAATPPDRIAQLEAKVTDAKNSADNAWMLVCAALVLMMTAPGLALFYGGLVRKKNVLATMLQSFSMMAIITVLWALILYSLAFGSGSSFIGGWHNAFLHGVGLAPDTDYAPTIPAQTFMIYQLMFAIITPALITGAFAERMKFSAMAVFMVLWSLIVYAPMAHMVWGKGGLLNASLGGRFPTLDFAGGTVVHITSGVSALVCALYLGKRIGYPKEPMPPHSVVLSFIGAGLLWVGWFGFNAGSALSAGTLATSAFVATHFGAAAAVIGWSAAEWLHNGKPTTLGAISGAVAGLVAITPAAGFVSPMSALFIGLLAGAFCFTMVAFAKAKFGYDDSLDAFGVHGAGGTLGAILTGVFASSAINPMFKDARGNPLPSGFIEGNYRQLLNQGVGVVIAWSLAIVGTLAILFLVDKLIGLRVSEEHEVAGLDISLHGEEGYYWEASMSQNS

SEQ ID NO: 1892 - DNA, 1392 bp, Myxococcus xanthus DK 1622
  CDS (1)..(1392): transl_table=11
atgaagaagtggttcgcgatggcccttctcgtgggtgtgggtgtgacggggttgctggtcgaaccggcggcgcagttgaagcaaggggggcccatcgacacctcggacacggcgtggatcctcacagccacggcgctggtcctgctgatgacgccgggactgtccttcttctacggcggcatggtgcggctgaagaacgtggtgtccacgctgctgcagagcttcatcgccatggcggtcatcagcctgatctgggtggtggtgggcttcagcctgtgcttcggcgacagcttccatgggctcatcggcgacccgcgaaccttcttcatgttcagcggcgtgggcggtgagacgcacccggacctggcacccaccatccccttgatgctgttcgcgctgttccagctcaagttcgccatcatcaccccggcgctcatcaccggcgcgttcgcggagcgcgtgcgcttcaaggcgtacgtgctcttcatggtgctcttcacgctcgtcatctacgcgccgctggcgcactggacgtggcacccggagggcttcctccgtcagtggggcgtgctcgacttcgcgggcggcacggtggtgcacatgtccgcgggcttcgcggcgctggctggcgcgctggtgctgggccgccgcaaggtgcacgtggagaacacgacgcacgcgcccgccaacatccccttcgtgatgctgggcacgggcatgctgtggttcggctggttcggcttcaacgcgggctcggcgatgtcggcctcgtcgctggccacgctggccttcgccaccaccaacacggcgtccgcggcggcgatgctgggatggattgccttcgactggctgcgcggccgcaagcccagcgccatgggcgcgtgcatcggcgcggtggtgggcctggtcgcggtgacgcccgcggccggcttcatcaccgtggggcagagcatcttcgtgggtctggtcgccagcttcgtgagcaacgcggcggtgcacttcaagaaccgcacccccgttgatgacacgctggacgtcttcccctgccacggactgggcggcgtggtgggcatggtgctgacgggcgtgctggccaaggacgtgggcctcatccacggcgagacgcgcaccttcatgatgcacatgctggcgctggtgctggtgtcggtgttctccttcgccggctcgttcctgctctacaagttggtggaccgcatcgtcccgctgcgcgtcacccgcgagcacgaggaagaaggcctggacctgagccagcacggcgagacggtgggcgagtccatcatcgcggccgcgccacagcccgcgctcaccgcgacgacggcggtcgccaccgagccagcgccggacgcatcccgcctgcctcagccagcctga

SEQ ID NO: 1893 - protein, 463 aa, Myxococcus xanthus DK 1622
MKKWFAMALLVGVGVTGLLVEPAAQLKQGGPIDTSDTAWILTATALVLLMTPGLSFFYGGMVRLKNVVSTLLQSFIAMAVISLIWVVVGFSLCFGDSFHGLIGDPRTFFMFSGVGGETHPDLAPTIPLMLFALFQLKFAIITPALITGAFAERVRFKAYVLFMVLFTLVIYAPLAHWTWHPEGFLRQWGVLDFAGGTVVHMSAGFAALAGALVLGRRKVHVENTTHAPANIPFVMLGTGMLWFGWFGFNAGSAMSASSLATLAFATTNTASAAAMLGWIAFDWLRGRKPSAMGACIGAVVGLVAVTPAAGFITVGQSIFVGLVASFVSNAAVHFKNRTPVDDTLDVFPCHGLGGVVGMVLTGVLAKDVGLIHGETRTFMMHMLALVLVSVFSFAGSFLLYKLVDRIVPLRVTREHEEEGLDLSQHGETVGESIIAAAPQPALTATTAVATEPAPDASRLPQPA

SEQ ID NO: 1894 - DNA, 1365 bp, Mesorhizobium sp. BNC1
  CDS (1)..(1365): transl_table=11
atgagactttccagtattgaaattgccaagcgcatggccggggcgggcgcgcttgcgttggcggctttcgccgctgtgccagctttcgcgcaggaagctgcggaaacggctgccgaggctgccgcaccggtgatggacaagggcgatgtggcctggatgatgacatcgacccttctggtgctgttcatgacgctgccggggctggcgctcttctatggcgggctggtgcgcgccaaaaatgctctttccgtgctcatgcagtgtacgatgatcgccgccgtggtcatggtggtgtgggtgctctggggctattcctttgccttcggtggcggcaccagccccttctggggcggcttcggcaagctgttcctatcgggcgtgacgatggattccaccgccgcaaccttcaccgacggcgtcgtcatccccgaatatgtcttcatctgcttccagatgacattcgcggtgatcacgccggcgctgatcgtcggcgcctttgccgaacgcatcaagttttcggcggtcgtgctcttcacggttctctgggtcaccttcgtctatttcccggtggcccatatggtgtgggacggcagcggctatctgttcaatctcggcgctctcgatttcgccggcggaaccgtggtccacatcaatgcgggcatcgccgctctcgtaggctgcatgatcgtcggcaagcgcagcggctacggcaaggatattctcgccccgcattcgatgacgcttaccatggtcggcggctccatcctgtgggtcggctggttcggcttcaatgccgggtcgaacctagaagccaccggcggcgctgcgcttgccatgatcaacactttcaccgcgactgccggtgcgattatcggctggagcgtcatcgaggctctccatcgtggcaaggcctcgatgctgggcgccgtctccggcctggttgccggcctcgtggccgttacccccgcctgcggctcggttggtccggtgggtgccattgtgctcggcgccatagccagcgcggtctgctacttcttcgtcgcagtggtgaagaacaagttcggctatgacgacacgctcgatgttttcgggatccacggcgtgggcggtatcgtcggcgcgcttggcacgggcattttcaccgcgccctggcttggcggcacgggggccgatgatttctccattgcgtcgcagctttgggtgcagttcgtggccgtgctggtcaccgtcgcatggtgcggggtggtttctgcgatcctttacaagctggttgatgccattgtcggcctgcgtccggagaaggaagccgaaacccagggtctggacctcacttcgcacggcgaggcggcctatcattactcctga

SEQ ID NO: 1895 - protein, 454 aa, Mesorhizobium sp. BNC1
MRLSSIEIAKRMAGAGALALAAFAAVPAFAQEAAETAAEAAAPVMDKGDVAWMMTSTLLVLFMTLPGLALFYGGLVRAKNALSVLMQCTMIAAVVMVVWVLWGYSFAFGGGTSPFWGGFGKLFLSGVTMDSTAATFTDGVVIPEYVFICFQMTFAVITPALIVGAFAERIKFSAVVLFTVLWVTFVYFPVAHMVWDGSGYLFNLGALDFAGGTVVHINAGIAALVGCMIVGKRSGYGKDILAPHSMTLTMVGGSILWVGWFGFNAGSNLEATGGAALAMINTFTATAGAIIGWSVIEALHRGKASMLGAVSGLVAGLVAVTPACGSVGPVGAIVLGAIASAVCYFFVAVVKNKFGYDDTLDVFGIHGVGGIVGALGTGIFTAPWLGGTGADDFSIASQLWVQFVAVLVTVAWCGVVSAILYKLVDAIVGLRPEKEAETQGLDLTSHGEAAYHYS

SEQ ID NO: 1896 - DNA, 1353 bp, Rhodococcus sp. RHA1
  CDS (1)..(1353): transl_table=11
atgaacgaagcagtcgctgcggccgataccgcctggattctggcggccttcacggcagtgagcctcatggtgcccggtctggccatgttctacggcggaatggtcagcgtgcgcaacaccctcaacatggccatgatgacgttcggcgcgttcgccgtcgtcggcgtcctgtggatcgtgttcggctactccgccgtgctgggtaactccctcggcggtctcggcgtcctgggcgaccccctcgagtacttcggctccagctcgctgctggaggcccccgccgaacccggactgccgcccgcgctggtctccggattccagctgttgttcgccggcatcaccgtcgcgctcatctccggagcgctggccgaccggatgaagttcggtgcctggatggtgttcgccggactgtgggccacgttcgtctacttccccgtcgcccactgggtgttcgcgttcgactccgaggacgggtcggtgatcggtggatggatcgcaaacacgctcggcgccgtcgacttcgccggcggcacggccgtgcatatcaatgccggcgtggccgctctcgcggtcgtcctggtcctcggggcccgcaagacgttccccgtctcgccgcgcccgcacagccttcccctgaccatgctcggcgcgggaatcctgttcttcggttggttcgggttcaacggtggctcggctctgtccgccggaaacagtgcatccgtcgtcatcctcaacacggtcgccgcgtcgtgcgccggtatctgcgcctggctcgtcgtcgagaaactgcgcgaaggccacgccacgtcgctgggcgccgcgtcgggtctgattgcggcgctggttgccatcacgccggcctgtggcgccgtctcacccctcggcgcgctcgtcgtgggaggcgcggccggcgcggtctgctgcttcgcggtctcctggaagtaccggctcggctacgacgacgcactcgacgtcgtcggcgtgcacctggtcggcggcatcctcggtaccgttctgatcggtttcctcgcagatccggctgctcccagcggcgccgcgggactcttctacggcggtggcgtcgacgtcctgtggcgccaatgtgtcgccgtggcagccgttctcgcgtactccttcgtcgtcacgctcgtgatcgtcctcgcactgaagaaattcatgggcattcgcgccgaccaggacagcgaatacgacggcctcgacgtgtccgtccacggcgagacggcctacgtactcgatgccgtcggcctcaccggcgcctccaagcacggcgccgacgcggttctcggcgcagaagcgatcacgaccagggctgcggaccctgccaaggcctga

SEQ ID NO: 1897 - protein, 450 aa, Rhodococcus sp. RHA1
MNEAVAAADTAWILAAFTAVSLMVPGLAMFYGGMVSVRNTLNMAMMTFGAFAVVGVLWIVFGYSAVLGNSLGGLGVLGDPLEYFGSSSLLEAPAEPGLPPALVSGFQLLFAGITVALISGALADRMKFGAWMVFAGLWATFVYFPVAHWVFAFDSEDGSVIGGWIANTLGAVDFAGGTAVHINAGVAALAVVLVLGARKTFPVSPRPHSLPLTMLGAGILFFGWFGFNGGSALSAGNSASVVILNTVAASCAGICAWLVVEKLREGHATSLGAASGLIAALVAITPACGAVSPLGALVVGGAAGAVCCFAVSWKYRLGYDDALDVVGVHLVGGILGTVLIGFLADPAAPSGAAGLFYGGGVDVLWRQCVAVAAVLAYSFVVTLVIVLALKKFMGIRADQDSEYDGLDVSVHGETAYVLDAVGLTGASKHGADAVLGAEAITTRAADPAKA

SEQ ID NO: 1898 - DNA, 1347 bp, Rhodococcus sp. RHA1
  CDS (1)..(1347): transl_table=11
gtgcctgcaatcgacgccggagcaaccgcctggcttctgatcagtaccgcgctggtccttctgatgacgccggggctcgccctgttctacggcggaatggtccgttccaccggcgtactgaacatgatcatgatgagcttcgtgtcgatcgcgctggtcacggtcgcgtggctggtggccgggtactccctcatcttcggtgacgacatcggcggcggactgatcggcgggctggagcacctggggatggtgggcatcgaccccaccaccgtccacgggcaggtgcccgagatcctgttcgccacgttccagctgacgttcgcgatcatcaccgccgcactgatcagcggtgcgatcgccgatcgggccaagttctcggcctggatgatcttcgtgcccgtctgggccctcgtcgtctacgcacccgtcgcgcactgggtgtggaacccgcagggctggatcgcgcagttcggtgccctcgactacgcgggcggactggtcgtcgagatcgtgtccggagcgtcgggcctggcgttggcgctggtcctgggcccgcgtctcggtttccggtccgagtcgatgcgtccccacaaccttccgctggtgttgctgggcgtcggcctgctgtggttcggctggttcggtttcaacgccggctccgcgctcgccgccgacggcaccgccgccgcgatcttcctgaacaccctcgtcgccgggtgcaccggtctgctcggctggctgctcgtcgaacagaagcgggacggtcaccccaccacgttcggtgcggcgtccggcgtcgtcgccggcctggtcgcgatcaccccgtcctgcggcaccgtgagcatggtcggggcactcgtcgtcggcgccgtcgccggtgtggtctgctcgttcgccgtcggctggaagttccgtgtcgggtacgacgactcgctcgatgtcgtgggagtccacctgatgggcggcatcgtcggcaccctcctgatcggactgctggccaccgaggtcatgaccagcggaccggaaggcctcttctacgggggcgggttcgcgcaactcggtaagcaggtgctcgccgtggtggtcgtcgccttgtacgcgttcggcgtgacgtacgcgctgggcaaactgatcgaccggatcttcgggttccgggtgagcgcggaggacgagtcgtccggcatcgacctcgcgttgcacgccgaatcggcgtacgaacacggtgtgctcgggcacggtccgggcggcggtggtcagggcaacagtgtcttcccgtggatgcacgaggccgaacgccggcggcacctggacgccgaacggaagcagaacccctccgattccgagtag

SEQ ID NO: 1899 - protein, 448 aa, Rhodococcus sp. RHA1
MPAIDAGATAWLLISTALVLLMTPGLALFYGGMVRSTGVLNMIMMSFVSIALVTVAWLVAGYSLIFGDDIGGGLIGGLEHLGMVGIDPTTVHGQVPEILFATFQLTFAIITAALISGAIADRAKFSAWMIFVPVWALVVYAPVAHWVWNPQGWIAQFGALDYAGGLVVEIVSGASGLALALVLGPRLGFRSESMRPHNLPLVLLGVGLLWFGWFGFNAGSALAADGTAAAIFLNTLVAGCTGLLGWLLVEQKRDGHPTTFGAASGVVAGLVAITPSCGTVSMVGALVVGAVAGVVCSFAVGWKFRVGYDDSLDVVGVHLMGGIVGTLLIGLLATEVMTSGPEGLFYGGGFAQLGKQVLAVVVVALYAFGVTYALGKLIDRIFGFRVSAEDESSGIDLALHAESAYEHGVLGHGPGGGGQGNSVFPWMHEAERRRHLDAERKQNPSDSE

SEQ ID NO: 1900 - DNA, 1368 bp, Rhodococcus sp. RHA1
  CDS (1)..(1368): transl_table=11
gtggatttccccactatcggtgcaccggacaccggggacacagcgtggatgctgaccagcgccgcgctcgtgttgctcatgactccgggtcttgcgttcttctacggcggcatggtgcgggccaagagcgtgctgaacatgctcatgatgagcatcagcgcgatgggtgtcgtcggcatcctgtgggttctctacggctactccatggccttcggtgaggacaagggaaaccttgtcggtgatccgttccagtacttcgggctcaaaggactgatcggcgggtcgtacctcgccgagaccgacgatgccggttcggtgatcgccgattccgcgatcccgctcgtcggcaccatccccgcgacggtcttcgtcgcgttccaggccatgttcgcgatcatcaccgtggccctcatctcgggtgccgtggcggatcgcctgcgcttcggttcctggctgctgttcgccggcctctgggcgacggtcgtgtacttccccgtggcgcactgggtcttcgccttcgacggcgtcaccgcagagaccggtggctggatcgccaacaagctcgccgcggtcgacttcgcgggtggtaccgccgtccacatcaacgccggcgccgccggcctcgtcctcgcgatcatcctcggcaagcgcaagggatggccgggcaccccgttccgtccgcacaacctgcccttcgtgatgctcggcgccggcctcctctggttcggctggttcggtttcaacgccggttcggccgtcggttccaacggcatcgccggagcaaccttcatcaccaccgtcatcggaacgtgcgcggccatgctcgcctggctcctggtcgagcggattcgcgacggccacgccaccacactcggtgcggcgtccggaatcgtggccggcctggttgccatcacgccttcctgctcgtcggtgaacgtcctcggcgcgctcgccatcggcgtcgtcgcaggcgcactctgcgcgctcgcggtcggactcaagttccgcttcgggttcgacgactcgctcgacgtcgtcggtgtccacctcgtcggcggcatcgtcggaacgctgatggtcggcctggtcgcaacggctgaggcgcccgcgggtgttgtcggactgttctatggtggaggcctcgaccaactctggcgtcaggcagtgggcgccggagcagtactgctttactcgctcgtcggtacggccgtcgtcgcgttgatcgtgaagttcacgatcggtctgcggctcagcgacgagggtgaatcacttggagtggacgagtcggaacacgcagaaactggctacgatttcgccgctctcggcggaaactcggcgactgctcgtgtatccggcaaggagggatga

SEQ ID NO: 1901 - protein, 455 aa, Rhodococcus sp. RHA1
MDFPTIGAPDTGDTAWMLTSAALVLLMTPGLAFFYGGMVRAKSVLNMLMMSISAMGVVGILWVLYGYSMAFGEDKGNLVGDPFQYFGLKGLIGGSYLAETDDAGSVIADSAIPLVGTIPATVFVAFQAMFAIITVALISGAVADRLRFGSWLLFAGLWATVVYFPVAHWVFAFDGVTAETGGWIANKLAAVDFAGGTAVHINAGAAGLVLAIILGKRKGWPGTPFRPHNLPFVMLGAGLLWFGWFGFNAGSAVGSNGIAGATFITTVIGTCAAMLAWLLVERIRDGHATTLGAASGIVAGLVAITPSCSSVNVLGALAIGVVAGALCALAVGLKFRFGFDDSLDVVGVHLVGGIVGTLMVGLVATAEAPAGVVGLFYGGGLDQLWRQAVGAGAVLLYSLVGTAVVALIVKFTIGLRLSDEGESLGVDESEHAETGYDFAALGGNSATARVSGKEG

SEQ ID NO: 1902 - DNA, 1299 bp, Haemophilus somnus 129PT
  CDS (1)..(1299): transl_table=11
atgaaaaaatttattttactcggattattactttctttttcttcatcaagcattgctgagttatctgattggattaagccgatttcggatatctcctccggagatactgcatgggtgatgatatctgcaatcttggttttatttatgactatccccggtttagcattattttatgggggaatggttcgtaaaaagaatgtgctgtcgacaatggcacaaagttttgcggtaagcggtttgatagccgttatttggttgtgttttggttatagtctttcatttacaccaaataatgcttttattggcggaatggatcgtttttttctgcaaggtttaaatgtgtttactgaacagaaaatgcttactgtttatcctggagctggaacgattccggaatctgtttttatgatttttcaaatgacctttgccattattgctggagcgatcattacaggtgcgactgtagagcgtatgaaattttcggcattattgttatttgttggattatggtcacttttgatttatgttcctaccgcacattgggtatggggaataggtggttggctagtaaatgatggggtattggattatgccggtggtaccgttattcatattaatgcaggtgtggcaggattggttgctgcaattgtcatcggtaaacgggtcggttacagacatgaagtgatgatgccgcacaatttagtattaactcttataggtacggcaatgttgcagattggttggtttgggtttaatgcgggttcggcacttgctgctgatgcaagagcgggtatggcattggcaactactcagatttcagcctcggtcggagcattaacttggatattagtcgaagtattttgtaaacacaagccgtctgcgttgggtttggcatcaggagcggtagctgggttggttggtattacgcccgccgctggttttgtatcggtacaaagtgctttattcataggtatgataacaagtgcggtctgttttgtcggtgtaatgaaactcaaatattggtttaggtatgatgatacgctcgatgcgtttggtattcacggtttaggcgggattgttggagcggtgttgacaggcatattcgtatctcctgatatttcagctaccgaaactacactttggacacaaattgagagtgtactgattactatcatttttagtgcatcaggtagttttgttttattaaaaataattgacaaaaccgtagggttacgagtggagcgagatgaagaacgtcaaggtttggatttaagttgccatggtgaaagaatagaatag

SEQ ID NO: 1903 - protein, 432 aa, Haemophilus somnus 129PT
MKKFILLGLLLSFSSSSIAELSDWIKPISDISSGDTAWVMISAILVLFMTIPGLALFYGGMVRKKNVLSTMAQSFAVSGLIAVIWLCFGYSLSFTPNNAFIGGMDRFFLQGLNVFTEQKMLTVYPGAGTIPESVFMIFQMTFAIIAGAIITGATVERMKFSALLLFVGLWSLLIYVPTAHWVWGIGGWLVNDGVLDYAGGTVIHINAGVAGLVAAIVIGKRVGYRHEVMMPHNLVLTLIGTAMLQIGWFGFNAGSALAADARAGMALATTQISASVGALTWILVEVFCKHKPSALGLASGAVAGLVGITPAAGFVSVQSALFIGMITSAVCFVGVMKLKYWFRYDDTLDAFGIHGLGGIVGAVLTGIFVSPDISATETTLWTQIESVLITIIFSASGSFVLLKIIDKTVGLRVERDEERQGLDLSCHGERIE

SEQ ID NO: 1904 - DNA, 1401 bp, Shewanella sp. MR-4
  CDS (1)..(1401): transl_table=11
atgacccaacagacaaccgcacttaacgctaagctccagcacggcacgaatacccaaatcagcctgcacactaagctcgctcagccaaacgcccgttattcaaaattgggttatcaggcattattggcgctgttcgccagcggctttgcaggcacggctttggccgatgaggcgcagctcagcggcgccaacactgcctggattttaagctcatctgccctagtcctattgatgacactcccagggctggcgctgttttacggcggtctggtgcgcagtaaaaacgtgctatcgattttaatgcagtgtttttctatcgccgctatcgcctccgtgctgtggtttgtggtgggttactctatcgccttcgataccggcaacggttttatcggcgggcttggcaaagcttttctagccagcattggtcgcgatagtgtcagtggggatattcccgaacctttatttatgcttttccaaatgaccttcgcgattatcacgccagcgctgatcatcggtggctttgccgagcggatgagattctccgctgtactgatgttttcaagcgcttggttgctgttagtctatgcacctatcacccactgggtgtggggcggcggctggttggccgagcttggcctgtatgactttgcaggcggtacagtcgtacacattactgctggggtagcggcactggtggcggcaaaagtgttagggccgcgtaagggattcttaaactcggccattatgccccataacttgaccatgacagtgacaggcgcgggcatgttgtgggtaggctggtttggctttaatggcggcagcgctttaggcgccaatggcactgcggccatggcgattctcgcgacccatctagccgcgtcgatgggcgccatcacgtgggcaggtatcgagtggtataaattcggtaaggccagtgcactcggtatcgtcaccggcatggtggcaggccttggcactatcactcctgcatcgggttatgtcggccctgctggcgcgttagttatcggttttcttggcggcgtggtctgcttcttttcaactgtgtacattaaacaaaagcttaagattgacgactcactcgatgtgttcccagtgcacggtgtcggcggtattctcggtactttgctggcgggagtatttagttcgactcagcttgggatcttcagcggttatggttttgccagtgtcaaccacactatgctcgaccaactcggggcgcaggccattggcgttatcgctacgttcagctatacagcgattgtaacgtggttattgtttgtggtgattggcaaaatcctcggtggacttcgcgtcagcacagagcaggaagtgaatggcctagacctttccgaacatgaagaaacaggctatagcctgtag

SEQ ID NO: 1905 - protein, 466 aa, Shewanella sp. MR-4
MTQQTTALNAKLQHGTNTQISLHTKLAQPNARYSKLGYQALLALFASGFAGTALADEAQLSGANTAWILSSSALVLLMTLPGLALFYGGLVRSKNVLSILMQCFSIAAIASVLWFVVGYSIAFDTGNGFIGGLGKAFLASIGRDSVSGDIPEPLFMLFQMTFAIITPALIIGGFAERMRFSAVLMFSSAWLLLVYAPITHWVWGGGWLAELGLYDFAGGTVVHITAGVAALVAAKVLGPRKGFLNSAIMPHNLTMTVTGAGMLWVGWFGFNGGSALGANGTAAMAILATHLAASMGAITWAGIEWYKFGKASALGIVTGMVAGLGTITPASGYVGPAGALVIGFLGGVVCFFSTVYIKQKLKIDDSLDVFPVHGVGGILGTLLAGVFSSTQLGIFSGYGFASVNHTMLDQLGAQAIGVIATFSYTAIVTWLLFVVIGKILGGLRVSTEQEVNGLDLSEHEETGYSL

SEQ ID NO: 1906 - DNA, 1401 bp, Shewanella sp. MR-7
  CDS (1)..(1401): transl_table=11
atgacccaacagacacccgcacttaacactaaaatcgagcgcagcacaaatacccaaaccagccagcacgcaaagtccgcgaagccaaacgcccattattcaaaattgggttatcaggcattattagcgctgttcgccagcggttttgcgggcacagcgttggccgatgaggcgcagctcagcggcgccaacacagcatggattttaagctcatcagccctcgtcctattgatgacactcccagggctggcgctgttttacggtggtctagtgcgcagtaaaaacgtgctatcgattttaatgcagtgtttttctatcgccgctatcgcctccgtgctgtggtttgtggtgggttactctatcgccttcgataccggcaacgggtttatcggcgggcttggcaaagcttttctagccagcattggtcgcgatagtgtcagtggggatattcccgaacctttatttatgcttttccagatgaccttcgcgattatcacgccagcgctgatcatcggtggttttgccgagcggatgaggttctccgccgtactgatgttttcaagcgcttggttgctgttagtctatgcacctatcacccactgggtatggggcggcggctggttggccgagcttgggctgtatgactttgctggcggtacagtcgtacacattaccgctggggtagcggcactggtggcggcaaaagtgttagggccgcgtaagggatttttaaactcggccattatgccccataacttgaccatgacagtgacaggcgcgggcatgctgtgggtaggctggtttggctttaatggcggcagcgccctaggcgccaatggcactgcggcaatggcgattctcgcgacccatttagccgcctcgatgggcgctatcacgtgggcagggatcgagtggtataaattcggtaaggccagtgcactcggtatcgtcaccggcatggtggcaggccttggtactatcactcctgcatcgggttatgtcggccctgctggcgcgttagttatcggttttcttggcggcgtggtttgcttcttttcaactgtgtacattaaacaaaagcttaagattgacgactcactcgatgtgttcccagtgcatggtgtcggcggtattctcggtactttgctggcgggggtatttagttcgactcagcttgggatcttcagcggttatggctttgccagtgtgaaccacactatgctcgaccaactcggggcgcaagccattggcgttatcgctacgttcacctatacagcgattgtaacttggttattgtttgtggtgattggcaaaatcctcggcggacttcgcgtcagcacagagcaggaagtgaatggcctagatctttccgaacacgaagaaacaggctatagcctgtag

SEQ ID NO: 1907 - protein, 466 aa, Shewanella sp. MR-7
MTQQTPALNTKIERSTNTQTSQHAKSAKPNAHYSKLGYQALLALFASGFAGTALADEAQLSGANTAWILSSSALVLLMTLPGLALFYGGLVRSKNVLSILMQCFSIAAIASVLWFVVGYSIAFDTGNGFIGGLGKAFLASIGRDSVSGDIPEPLFMLFQMTFAIITPALIIGGFAERMRFSAVLMFSSAWLLLVYAPITHWVWGGGWLAELGLYDFAGGTVVHITAGVAALVAAKVLGPRKGFLNSAIMPHNLTMTVTGAGMLWVGWFGFNGGSALGANGTAAMAILATHLAASMGAITWAGIEWYKFGKASALGIVTGMVAGLGTITPASGYVGPAGALVIGFLGGVVCFFSTVYIKQKLKIDDSLDVFPVHGVGGILGTLLAGVFSSTQLGIFSGYGFASVNHTMLDQLGAQAIGVIATFTYTAIVTWLLFVVIGKILGGLRVSTEQEVNGLDLSEHEETGYSL

SEQ ID NO: 1908 - DNA, 1329 bp, Pseudomonas aeruginosa UCBPP-PA14
  CDS (1)..(1329): transl_table=11
atgactctgcgtaagatcgcagggctaggagccctattgtccctcgctttgccgggcgtcgccctggccgctgaggaacccgtcctgaacagcggcgacaccgcctggatgctgatctccactgcgctcgtcctgctcatgaccatccccggtctggcgctgttctacggcggcatggtgcgagcgaagaacgtgctgtcgatcatgatgcagtgcttcgccatcaccggcctgatcaccattctctgggtggtctatggctacagcctggcgttcgataccgccgggatggagaagggcgtcctcaacttcaattccttcgtcggcgggctggacaaggccttcctcagcggtctcaccgccgacggcctgacttccgccaccgcgctgttcccggaaagcgtgttcatcaccttccagatgaccttcgcgatcatcacaccggcgctgatcgtcggcgccttcgccgagcgcatgaagttctcggcgatgctgatcttcatggcggtctggttcaccgtggtctacgcgccgatcgcgcacatggtctggagcggcgacggcgccctgatgtgggactggggcgtgctggacttcgccggcggcaccgtggtgcacatcaacgccggtatcgccggcctggtcgcctgcctggtgctgggcaagcgcaagggctacccgaccacgccgatggcgccgcacaacctcggctacaccctggtcggggcggccatgctgtggatcggctggttcggtttcaacgccggttccgccgccgccgccaacggcaccgccgggatggccatgctggtgacccagatcgctaccgccgccgcggccctggcctggatgttcgccgagtggatcacccacggcaagccgagcgccctgggcatcgcgtccggcgtggtcgccggtctggtggcgatcaccccggccgccggcaccgccggtccgatgggcgcgctggtgatcggcctggcctccggggtgatctgcttcttcgccgccaccagtctcaagcgcgcgctgaaatacgacgattccctcgacgccttcggcgtacatgcggtcggcggtatcgtcggcgcgctgctcaccgggatcttcgcggcgccgtcgctgggcggcttcggcagcgtggaggacatcggcgcgcagttcttcgtgcagttcaagggcgtggccttcaccgtggtctacaccgccgtggtgaccttcgtgatcctcaaggtgctggacctggtcatgggcctgcgggtcaccgaggaagaggaagcggtcggcctcgacctggcgctgcacaacgagcgcggctacaacctgtaa

SEQ ID NO: 1909 - protein, 442 aa, Pseudomonas aeruginosa UCBPP-PA14
MTLRKIAGLGALLSLALPGVALAAEEPVLNSGDTAWMLISTALVLLMTIPGLALFYGGMVRAKNVLSIMMQCFAITGLITILWVVYGYSLAFDTAGMEKGVLNFNSFVGGLDKAFLSGLTADGLTSATALFPESVFITFQMTFAIITPALIVGAFAERMKFSAMLIFMAVWFTVVYAPIAHMVWSGDGALMWDWGVLDFAGGTVVHINAGIAGLVACLVLGKRKGYPTTPMAPHNLGYTLVGAAMLWIGWFGFNAGSAAAANGTAGMAMLVTQIATAAAALAWMFAEWITHGKPSALGIASGVVAGLVAITPAAGTAGPMGALVIGLASGVICFFAATSLKRALKYDDSLDAFGVHAVGGIVGALLTGIFAAPSLGGFGSVEDIGAQFFVQFKGVAFTVVYTAVVTFVILKVLDLVMGLRVTEEEEAVGLDLALHNERGYNL

SEQ ID NO: 1910 - DNA, 1197 bp, Leuconostoc mesenteroides subsp. mesenteroides ATCC 8293
  CDS (1)..(1197): transl_table=11
atgaacagtggtgatttagcatgggttttagtttcagctgcattagtctgggtaatgacacctggattagccttgttctacggtggcttaggtgagcgtagaaacttgttacacacgatgtttattccagttatgattattggaattgcttcgttagtatggtttgttgttggatatacgttatcatttggtggtagtggaaatgtgattggtaattttaaacatttgttcttaacgaatgtttcattcacgcattctactaaagatttaacaattcctgacggtgcatttgccctgttccaaggtatgtttccgataataacagccgcaattattactggatccgtcattggtcgagttagaattaaagcattgctcgtatttattgcactttggttgattttcatttactcaccgttagcgcacatggtttggggcggtggcttcttggctcagttaggcgcaattgattttgctggtggaactgttgttcatatttctagtggtgtaactggattggtgctggctttgatgattggacatcgtcatattgacaagcacatacctgtacgaccttcttatgttttgattggtggcgctttgttatgggttggatggtttggtttcaactctggatcagctcttgcagcaaatggcacagctgttctagcattagttaacacatggttagcatcagcggcagctgtattgacttggggtcttgttgaatataagtatcatggacgtgctacattatccggtattactagtggtggtgttgctggtctagttgctattacgcctgctgctggttttgtggcaccatgggcagctgtagtgatgggactcttagctggttttataggctttgctggtatcacatttgttaaaaatagttttggatatgatgatacattagatgcttttggtattcatggtattggcggcgccgtgggtgcaatattgacaggtgtatttgctgataaaagtgttggcggtgttgctggtctaatcaacgggaatatatcattggttggtaagcagttagtcgcaattttatttactatcgcatttgctgcgattggcacatatgttttagctaaaataacagaactcattgctgcaccactgcgtttgacagctgatgaagaagctgaaggttatgacgcaattatgcatgatttgactgtggaataa

SEQ ID NO: 1911 - protein, 398 aa, Leuconostoc mesenteroides subsp. mesenteroides ATCC 8293
MNSGDLAWVLVSAALVWVMTPGLALFYGGLGERRNLLHTMFIPVMIIGIASLVWFVVGYTLSFGGSGNVIGNFKHLFLTNVSFTHSTKDLTIPDGAFALFQGMFPIITAAIITGSVIGRVRIKALLVFIALWLIFIYSPLAHMVWGGGFLAQLGAIDFAGGTVVHISSGVTGLVLALMIGHRHIDKHIPVRPSYVLIGGALLWVGWFGFNSGSALAANGTAVLALVNTWLASAAAVLTWGLVEYKYHGRATLSGITSGGVAGLVAITPAAGFVAPWAAVVMGLLAGFIGFAGITFVKNSFGYDDTLDAFGIHGIGGAVGAILTGVFADKSVGGVAGLINGNISLVGKQLVAILFTIAFAAIGTYVLAKITELIAAPLRLTADEEAEGYDAIMHDLTVE

SEQ ID NO: 1912 - DNA, 1416 bp, Solibacter usitatus Ellin6076
  CDS (1)..(1416): transl_table=11
ttggcaaccctcgagattggtcccacgatgaaccattattcaaaactcactttagtttctgtacttgcagccaccgcggggttggcgcagaccgctccggatttgacaacgaaactggcggcgatggaagcagcgacgaagagcgcgcaaagcgccggcgacaatgcctggatgctggtcagttcggccctggtcctgatgatgaccgctcccggactggcgttgttctatggcggcctggtacgccgcaagaacgtgctgggcacgatgatgcacagctttatcctgatggcggtagtcacggtgatctgggctgtggcggggtacagcctggccttcggcggatcttcgccctatctggggaattttcagttcgcgttcctcgatggcgtaggcacggcgcctaacgccgattacgcggcgacgattccgcacgccacgttcatggtgtatcaactgatgttcgcgatcattacccccgcgctgatttcaggggctttcgccgagcgcatgaagttcagcgcgatgctgctcttcacggttctgtggacgctggtagtctacttcccgatggcccacatggtgtggggcaagggcggcctgctcaacgcattctcgggcgggaagatcccgtgcctcgattttgcgggtggcacggtggtccacatcaccagcggagtctcggcgttggtctgcgcgctgtacctgggcaagcgggtgggttatccctcgtcggcgatgaagccccataacctggtgatcagcaccatcggagccggcatgctgtgggtgggctggttcggcttcaacgcaggcagcgctctcgccgcttcgggcctcgcgaccagcgccttcgtcgcgacgcacttcggcgccgcggcggcaacccttgcgtggctggcggtggaatggatcgacgccggcaagccgagcatgctgggcgcgatttcgggctgcgtcgccggcctggtcgcgatcacgccggcctccggcttcgtgaagcccttcccggccatgatcatcggcgcctgcgcgggtctgctctgttacttcatggttacgcgcgtgaagcgtaagttcggttatgacgacgcgctggacgccttcggcgttcacggcgcgggcggcaccctgggcgcgatcctgaccggcgtgttcgccaccaatttcatcaacgacggtttgaagaatgccgctggccagccgcaggcgctcgggctggtggacggtaacggcggccaggtgatgaaccaaatcctgggtatcgcaatttcatggggcctggcgatcgtgggcacgctcgtgattctgaaattcgtggacgccgtgattggcgtgcgggtcacgaaggagcaggagagcgacgggctggatctcagcatgcacaacgaagaagggtacgttttcgagaattag

SEQ ID NO: 1913 - protein, 471 aa, Solibacter usitatus Ellin6076
MATLEIGPTMNHYSKLTLVSVLAATAGLAQTAPDLTTKLAAMEAATKSAQSAGDNAWMLVSSALVLMMTAPGLALFYGGLVRRKNVLGTMMHSFILMAVVTVIWAVAGYSLAFGGSSPYLGNFQFAFLDGVGTAPNADYAATIPHATFMVYQLMFAIITPALISGAFAERMKFSAMLLFTVLWTLVVYFPMAHMVWGKGGLLNAFSGGKIPCLDFAGGTVVHITSGVSALVCALYLGKRVGYPSSAMKPHNLVISTIGAGMLWVGWFGFNAGSALAASGLATSAFVATHFGAAAATLAWLAVEWIDAGKPSMLGAISGCVAGLVAITPASGFVKPFPAMIIGACAGLLCYFMVTRVKRKFGYDDALDAFGVHGAGGTLGAILTGVFATNFINDGLKNAAGQPQALGLVDGNGGQVMNQILGIAISWGLAIVGTLVILKFVDAVIGVRVTKEQESDGLDLSMHNEEGYVFEN

SEQ ID NO: 1914 - DNA, 1311 bp, Magnetococcus sp. MC-1
  CDS (1)..(1311): transl_table=11
atgatgcgtttctcatcacatctccttaagggcggcgctctatttgccctacttttaatcacgcccacgtgggcttgggccgccgaacaggggttggataaagccgataccgcctggatcttaaccaccaccgccttggtgctctttatgaccctgcccggcttggccctgttttatggcggcttggtgcgctctaaaaacattctctccatccttatgcagtgttttgccatcgcctgtttggtctcggtgctctggttggccgggggttacagtctggcctttgagcatggggggcccctcaatggtgtcatcggttcactgcaaaaagccttttttgcaggtgttgcccacaataccgtcaagggtagcctgcccgaaggggtgtttgccgcctttcaaatgacctttgccattattaccccagcgttggtgatcggtggttttgccgaacgcattcgatttgccgtcatcctgccctttacagcgctatggctattgttggtctacattccagtgtgtcattgggtctggggtggcggttggatgcaagctgccggggtgatggattttgccgggggtgtggtggtacacatcaccgccggggtggccgctttggtggcggccctggtattggggccgcgcaacggttttcaaaaaaccgtcatgtttccccataacctaaccatgacctacgccggggctgccatgctttgggtgggctggttcggttttaatgggggttcggccctcaccgccgatggttcagcagggtgggcgattttggcgacccacatgggggccgccgcagggtcgctggcctggatgggtatggagtggatgcgccatggcaaacccagcgtattgggtattgtcaccggcatggtggctggtttgggcaccgtaaccccagcctctggttacattagcccctttgggggctttgcaatcggcctcattgctggtgtggtctgctatctggccaccatgatggtgaaacagcgttggaaaatagatgactccctggatgtctttcccgtacacggcgtgggcggtatgatcggtacactcatgacggccctatttgccgctccgctatttgggggccatggcttggcttccaatgcgcaaattttaccgcaacttgccacccaaggggtggcggtgggggtgacggcgctctataccgccgtggtcacttggctaatctttaaagggttggctcaagtgatgcaactgcgggtgagcagggatcaagagaccgagggccttgatttggtcgaccatgacgaacggggttataacctctaa

SEQ ID NO: 1915 - protein, 436 aa, Magnetococcus sp. MC-1
MMRFSSHLLKGGALFALLLITPTWAWAAEQGLDKADTAWILTTTALVLFMTLPGLALFYGGLVRSKNILSILMQCFAIACLVSVLWLAGGYSLAFEHGGPLNGVIGSLQKAFFAGVAHNTVKGSLPEGVFAAFQMTFAIITPALVIGGFAERIRFAVILPFTALWLLLVYIPVCHWVWGGGWMQAAGVMDFAGGVVVHITAGVAALVAALVLGPRNGFQKTVMFPHNLTMTYAGAAMLWVGWFGFNGGSALTADGSAGWAILATHMGAAAGSLAWMGMEWMRHGKPSVLGIVTGMVAGLGTVTPASGYISPFGGFAIGLIAGVVCYLATMMVKQRWKIDDSLDVFPVHGVGGMIGTLMTALFAAPLFGGHGLASNAQILPQLATQGVAVGVTALYTAVVTWLIFKGLAQVMQLRVSRDQETEGLDLVDHDERGYNL

SEQ ID NO: 1916 - DNA, 1311 bp, Magnetococcus sp. MC-1
  CDS (1)..(1311): transl_table=11
atgaaatccatcaaacgaaccctgctgccagccgccgctttggctatgggcagcattctgcccgctaccgcttgggccgaagatactttagacagtggtaacaccgcttggatgttgacctccaccgcgttggtcttgttcatgaccctgcccggtctggcgctgttctatgcgggcatggtgcgttccaaaaacgtgctgtcggtgctgatgcagtgtttcgccattgctggcgtcatgtccattttgtgggcgatttatggttactccctggccttctccagcgcggcggatgcaggcgtcaaccaattcattggtggcatgggcgactttttcttaaagtcggttaaggcggactccctaagcggctccatccccacctcggtctttgttacctttcagatgaccttcttcatcatcacccctgcgctgattgtgggtggttttgccgagcgcatgaagttctcctccatgctggttttcatggccctatggggaaccatcgtctacctgcccatctgccacgcggtctggggtggtggtttcatggctgaagatggcgtgctcgatttcgcgggtggtaccgtggtgcacatcaatgcgggtgtggctggcttggttgctgccctggtactgggtaagcgtcgtggctaccccaccaccgccatgcccccccacaacctgagcctgaccgtaaccggtgccgccatgttgtgggtgggttggttcggctttaacgccggttctgagttggctgccgatggtactgctggcatggcgatgttggtcacccaactggccgccgccaccgccgctatcgtgtggatggcgctggagtggatgaaacacggcaaaccctctgtgctgggcattgccaccggtgcggttgctggcctggttgccatcacccctgcttctggtacggctggccccatgggcggcatcctgatcggtctggccgctggcttctttgccttcatcggtgccacctccatcaaacgcgccctgggctacgatgactcgctggacgcctttggtgtgcatggtatcgccggtatcgttggcgccattctgaccggtgtgttcgccgatgcctccttgggcggctctggcttagcagaaggcaagaccatcatgagtcaggttgcggtgcaaacgaccagcgttggctacaccatcgtctactgtgcggttgcgaccttcattatcctcaaggtactggatgtgatcatggggctgcgtgtggatgacgaagccgaagagatgggcttggatctcgccgaacacgacgagcgtggctacaatatctaa

SEQ ID NO: 1917 - protein, 436 aa, Magnetococcus sp. MC-1
MKSIKRTLLPAAALAMGSILPATAWAEDTLDSGNTAWMLTSTALVLFMTLPGLALFYAGMVRSKNVLSVLMQCFAIAGVMSILWAIYGYSLAFSSAADAGVNQFIGGMGDFFLKSVKADSLSGSIPTSVFVTFQMTFFIITPALIVGGFAERMKFSSMLVFMALWGTIVYLPICHAVWGGGFMAEDGVLDFAGGTVVHINAGVAGLVAALVLGKRRGYPTTAMPPHNLSLTVTGAAMLWVGWFGFNAGSELAADGTAGMAMLVTQLAAATAAIVWMALEWMKHGKPSVLGIATGAVAGLVAITPASGTAGPMGGILIGLAAGFFAFIGATSIKRALGYDDSLDAFGVHGIAGIVGAILTGVFADASLGGSGLAEGKTIMSQVAVQTTSVGYTIVYCAVATFIILKVLDVIMGLRVDDEAEEMGLDLAEHDERGYNI

SEQ ID NO: 1918 - DNA, 1401 bp, Shewanella sp. ANA-3
  CDS (1)..(1401): transl_table=11
atgagccaacagacagccgcacttaacgctaagctagagcgcagcacgaatattccaaacggccagcacgctaagttcgctcagccaaacgcccgttattcaaaattgggttatcaggcattattggctctgctcaccagcggctttgcgggctcggttttggccgatgaggcgcagctcagcggcgccaacaccgcatggattttaagctcatccgccctcgtcttattgatgacactccctggactggcgctgttttacggcggtctggtgcgcagtaaaaacgtactctcgattttaatgcagtgtttttctatcgctgctatcgcctctgtactgtggtttgtggtgggttactccatcgccttcgataccggcaacggttttatcggcgggcttggcaaagcttttctagccagcattggtcgcgatagtgtcagtggggatattcctgaacctctgtttatgcttttccagatgaccttcgcgattatcacgccagcgctgatcatcggtggctttgccgagcggatgaggttctccgccgtactgatgttttcaagcgcttggttgctgttagtctatgcacctatcacgcactgggtgtggggcggtggctggttggccgagcttggattgtatgactttgctggcggtacagtcgtacacattaccgctggggtggcggcactggtggcggcaaaagtattagggccgcgtaagggatttttaaactcggccattatgccccataacttgaccatgacagtgacaggcgcgggcatgctgtgggtaggctggtttggctttaatggcggcagcgctttaggcgccaatggcactgcggccatggcgattctcgcgacccatttagccgcgtcgatgggcgccattacttgggcgggtatcgagtggtataaattcggtaaggccagtgcactcggtatcgtcactggcatggtggcaggccttggcactatcacgcccgcatcgggttatgtcggcccagctggcgcattagtgataggttttcttggcggcgtggtttgctttttttcaactgtttatattaaacaaaagcttaagattgacgactcactcgatgtgttcccagtgcatggtgtcggcggtattctcggcactttactggcgggggtatttagttcgactcagcttgggatcttcagcggttatggctttgccagtgttaaccccactatgctcgaccaactcggagcgcaggccattggggttattgccaccttgagttacaccgccctggtgtcttggttgttgtttgtggtcattggcaaaatcctcggcggacttcgtgtcagtaccgaacaggaagtgaatggcctcgatctttccgaacatgaagaaacaggctacagcctctaa

SEQ ID NO: 1919 - protein, 466 aa, Shewanella sp. ANA-3
MSQQTAALNAKLERSTNIPNGQHAKFAQPNARYSKLGYQALLALLTSGFAGSVLADEAQLSGANTAWILSSSALVLLMTLPGLALFYGGLVRSKNVLSILMQCFSIAAIASVLWFVVGYSIAFDTGNGFIGGLGKAFLASIGRDSVSGDIPEPLFMLFQMTFAIITPALIIGGFAERMRFSAVLMFSSAWLLLVYAPITHWVWGGGWLAELGLYDFAGGTVVHITAGVAALVAAKVLGPRKGFLNSAIMPHNLTMTVTGAGMLWVGWFGFNGGSALGANGTAAMAILATHLAASMGAITWAGIEWYKFGKASALGIVTGMVAGLGTITPASGYVGPAGALVIGFLGGVVCFFSTVYIKQKLKIDDSLDVFPVHGVGGILGTLLAGVFSSTQLGIFSGYGFASVNPTMLDQLGAQAIGVIATLSYTALVSWLLFVVIGKILGGLRVSTEQEVNGLDLSEHEETGYSL

SEQ ID NO: 1920 - DNA, 1278 bp, Mycobacterium avium 104
  CDS (1)..(1278): transl_table=11
atgcacggaatcgatccggccgccacggcctggctgctggccagcaccgcgctggtgttgctgatgacccccggcctggcgatcttctacggcggcatggtccgcaccaccggtgtgctcaacatgatcatgatgagcttcatctccatcccgctggtgaccgtggcctggttgctggtcggctacacgatggcgttctcccaggacgggatgagcgggctggtgggcaatctgcggcacttcgggatgctcggcatcactcccgacaccacccacggcgcggtccccgaattgctgtacgccactttccaattgacgttcgcgatcatcaccgcggcgctggtcagcggcgcgatcgccgaccgcgccaagttcgccgcctggatggttttcgtcccggtgtggacggttgcggtgtattcggttgtggcgcactgggtctgggggccgggcggctggctggcccggctgggcgtgctggactatgcgggtgggctggtggtcgagatcgtctccggcagctccgcgctggccctggcgctggtgctcgggccgcggatcggcttcaagaaggacgccatgcggccgcacaatctgccgctgctgttcgtcggtgtcgggctgctgtggttcggctggttcgggttcaacgccggatcggcgttggcggccaacggaaccgccgcggccatcttcctcaacaccctggtggccggctgcctgggcatgctgggctggctgtcggtcgagcagatccgcgacgggcggcccaccacgttcggcgccgcctcgggcgtggtggccgggctggtcgccatcaccccgtcctgcggcaccgtcaacacgctgggggcgacggtggtcgggctggcggccggcgtcgtgtgctcgttcgcggtgggcgcgaaactgcgcttcaactatgacgattcgctcgacgtggtcggtgtgcacttcgtcggcggggtggtcggggtgtcgctgatcgggctgttcgccacggcggtcatgacggcgggcccgcaggggctgttctacggcggcggcgtggcccagctgggcaagcaggcgctggcgatcgcggcggtggcgctctacgcgtttaccgtgtcgttcctgctggccaaggccatcgaccgggtgatgggcttccgggtcagcgccgaggacgagaccaccggcgtcgacctgacccagcacgccgagaccgcctacgccgagggcgtgcacggtcatctgccgcagcgccgcccgggccccggcgaccggttgaagtag

SEQ ID NO: 1921 - protein, 425 aa, Mycobacterium avium 104
MHGIDPAATAWLLASTALVLLMTPGLAIFYGGMVRTTGVLNMIMMSFISIPLVTVAWLLVGYTMAFSQDGMSGLVGNLRHFGMLGITPDTTHGAVPELLYATFQLTFAIITAALVSGAIADRAKFAAWMVFVPVWTVAVYSVVAHWVWGPGGWLARLGVLDYAGGLVVEIVSGSSALALALVLGPRIGFKKDAMRPHNLPLLFVGVGLLWFGWFGFNAGSALAANGTAAAIFLNTLVAGCLGMLGWLSVEQIRDGRPTTFGAASGVVAGLVAITPSCGTVNTLGATVVGLAAGVVCSFAVGAKLRFNYDDSLDVVGVHFVGGVVGVSLIGLFATAVMTAGPQGLFYGGGVAQLGKQALAIAAVALYAFTVSFLLAKAIDRVMGFRVSAEDETTGVDLTQHAETAYAEGVHGHLPQRRPGPGDRLK

SEQ ID NO: 1922 - DNA, 1434 bp, Mycobacterium avium 104
  CDS (1)..(1434): transl_table=11
gtgacatacccgatactgggccagcccaataccggcgataccgcctggatgctggccagttccgcgctggtgctgttgatgacgccgggtctggcgtttttctacggcgggatggtgcgcgccagaagcgtgctgaacatgctcatgatgagcatcagcgcgatgggcgtggtcaccgtgctgtgggtgctttacggctattcggtcgccttcggcgacgacgtcggcaacttcatgggcaagccgacgtcctactggggcctcaagggtctcatcggcgtcaacgcggtggccgccgacccgagcaaaggcactgcggcaacggacattccgctggccggtacgctgccggccaccgtgttcgtggccttccagctgatgttcgcgatcatcaccgtcgctctgatctccggcgcggtgtccgaccggctgaagttcgccgcctggctggtgttcgccggcctgtgggcgacgttcgtctatttcccggtggcgcactgggtgttcgcattcgacggcttcgcctccgagcacggcggctggatcgccaacaagctgcacgcgatcgacttcgccggcgggacggcggtgcacatcaattccggtgtggcgggcctgatgctggcgatcgtgctgggcaagcgccgcggctggcccaccacgttgttccggccgcacaacctgccgttcgtgatgctgggcgccgggctgctgtggttcggctggtacgggttcaacgccggatcggccaccagctccaacggcgcggcggggtcgacgttcatgacgacgacgatcgcgaccgccaccgcgatgctggcctggatgctcaccgaacgcatccgcgacggcaaggccaccacgttgggcgcggcgtccgggatcgtcgccgggctggtcgccatcaccccgtcctgctcgtcggtcaacgtgctgggcgcgctggtggtgggcctggtggccggcgtggtgtgcgcgctggcggtcggcctgaaattcaagctgggctttgacgactcgctcgacgtggtcggggtgcacctggtcggcgggctggccggcaccctgctggtgggcctgctggccgccccggagagcccggccatcagcggcgtcaccggcgtctccaagggactgttctacggtggcggctgggcgcagctggaacggcaggcggtcggcgcgttcagcgtcctcatctactctggtgtggttacgctgatcctggcgttgatcctgaagtacacgatggggcttcgtctcaacccggaggccgaagcctcgggtatcgacgaggctgagcacgccgagagtggttacgatttcgccgtggctaccggctcggttctcccgccccgggtcgctgtggcggatacccgcaacggcctggaggagcagcgagtgggcgacaaagtggaggcagagcagtcatga

SEQ ID NO: 1923 - protein, 477 aa, Mycobacterium avium 104
MTYPILGQPNTGDTAWMLASSALVLLMTPGLAFFYGGMVRARSVLNMLMMSISAMGVVTVLWVLYGYSVAFGDDVGNFMGKPTSYWGLKGLIGVNAVAADPSKGTAATDIPLAGTLPATVFVAFQLMFAIITVALISGAVSDRLKFAAWLVFAGLWATFVYFPVAHWVFAFDGFASEHGGWIANKLHAIDFAGGTAVHINSGVAGLMLAIVLGKRRGWPTTLFRPHNLPFVMLGAGLLWFGWYGFNAGSATSSNGAAGSTFMTTTIATATAMLAWMLTERIRDGKATTLGAASGIVAGLVAITPSCSSVNVLGALVVGLVAGVVCALAVGLKFKLGFDDSLDVVGVHLVGGLAGTLLVGLLAAPESPAISGVTGVSKGLFYGGGWAQLERQAVGAFSVLIYSGVVTLILALILKYTMGLRLNPEAEASGIDEAEHAESGYDFAVATGSVLPPRVAVADTRNGLEEQRVGDKVEAEQS

SEQ ID NO: 1924 - DNA, 1251 bp, Mycobacterium smegmatis str. MC2 155
  CDS (1)..(1251): transl_table=11
atggataccggaacaacagcattcatgctgtgttgcatcatcgggctcacgctgatgatccctggcctggcgttgttctacggcggcatggtctcggtcaagagctcgaccaacatgatgatgatgaccttcggcgcggtcgccgtcgtcggcctgctgtgggtcctcttcgggttctccatggtgttcggtacgtcctacggcggattcgtgggcagtttcaccgaattcgccggcctgaccgaccttctcgaacccatgaccaccgtcgacgggctgccggtcagcttgttcgcggtgttccaggcgctgttcgcggcgatcaccgtggcgctgatctccggtgcggtggccgaccgcatgaagttcggcgcctggatggtgttcgcggcgttctgggccgtgctggtgtacttccccgtcgcgcactgggttttcgcgttcgacggcacggtcaccgaggattcggtcggcggctggatcgccaacaggctcggtgcggtcgacttcgcgggcggtaccgcggtgcacatcaacgccggcgcggccgcgctcgcgctggcgatcgtgctgggcaagtccgcgatgttcggacggcgcaagcctcacaacgttccgctcacgctcctcggcgcgggcatgctgtgggccggttggtatgcgttcaacggcggttcggcgctgtcggccggtaactccgcggccatcgtcatggtcaccacgttcgtggcgacctgcgctgcggtcctggcgtggatcgccgtcgagaaggtcaagaccggtcacgtgaccggggtcggcgcggcctcgggtgccatcacgggcctggtcgccatcacgcccgcgtgcggcgcggtgacgccgatcggcgcgatgttcgtcggcggtatcgcgggcgcggtgtgcgtgtacgccgtgggtctgaaagacacgttcgggtacgacgattcgctcgacgtggtcggtgtgcacctcgtcggcggcctgatcggcacgctgctcatcggcttcttcgccagcgagggcatgcccaacggcgtcaacggtctgttctatggcggcggcatcgaccagttgtggaagcaggcggtcgcggccggtgcggtgatgatctattcgttcgtgctcgcgtacgtcatcgcgttcgcgatcaagaagaccatgggcatccgcatctcccccgacgaggaagaaaagggtatcgacgccaagttccaccgcgacgcggcgtacgagctcgaattcgcctga

SEQ ID NO: 1925 - protein, 416 aa, Mycobacterium smegmatis str. MC2 155
MDTGTTAFMLCCIIGLTLMIPGLALFYGGMVSVKSSTNMMMMTFGAVAVVGLLWVLFGFSMVFGTSYGGFVGSFTEFAGLTDLLEPMTTVDGLPVSLFAVFQALFAAITVALISGAVADRMKFGAWMVFAAFWAVLVYFPVAHWVFAFDGTVTEDSVGGWIANRLGAVDFAGGTAVHINAGAAALALAIVLGKSAMFGRRKPHNVPLTLLGAGMLWAGWYAFNGGSALSAGNSAAIVMVTTFVATCAAVLAWIAVEKVKTGHVTGVGAASGAITGLVAITPACGAVTPIGAMFVGGIAGAVCVYAVGLKDTFGYDDSLDVVGVHLVGGLIGTLLIGFFASEGMPNGVNGLFYGGGIDQLWKQAVAAGAVMIYSFVLAYVIAFAIKKTMGIRISPDEEEKGIDAKFHRDAAYELEFA

SEQ ID NO: 1926 - DNA, 1326 bp, Nocardioides sp. JS614
  CDS (1)..(1326): transl_table=11
gtgatccctggaggttccgtggacggctactacgccttcatgctcgtggcgacagccctcgtcctgatgatgaccgttcccgcactggctctgttctacggcggcatgagccgctcgaagtccgtgctgaacatgatgatgatgtcgtacgtcgcgatggccgtggtcgccatcgtctacgtgctgtggggctggtcgatgaccttcggcccgaacgacgtgggtggcctgttcgccaacccgttcgacctcttcggcctcaacgacgtgacgcccgacggctatctcgcggtgatgttccagatgacgttcgccgcgatcaccgcggcgctcatctccggcgccatcgcggaccgcgtcaagctctcctcctgggtcgtgttcctgcccctgtgggtcacgctcagctacttcccgatcgggcacatggtctggggcggcggcttcatctccgagcacttcggggcccaggactacgccggcggcacggtcgtccacatcaacgccggcgtcgccgggctcgtgctcgcgctggtgatcggcaagcggatcgggttcggcaaggagccgatgcgcccgcacaacctgaccctgacgatgatcggggcgggcctgctgtggttcggctggtacgggttcaacgtcggctcgatcgtcttcaccgggtcgaccgacgaggagaacatcgcgcagttctactccgagaccggggtgacgttcctcaacaccacgatcgcgacctgcgccgcgatgctcggctggctcctcgtcgagcggctcctgcacggcaaggccacctcgctcggtgccgcgtcgggcatcgtcgccggcctggtcgccatcacgccgtcgtgcggcgcggtggagctgcccggcgcgatcctgatcggcgcggtcgccggcgccgcctgcgcctgggcggtgggcctgaagtacaaggtcggcctggacgactcgctggacgtggtgggcgtccacctggtcggtggcgtcatcgggacggtgctgatcggcctggtctcgtcctcggacgccccgggcggcatcgacggcctgttctacggcggcggcttcggctctctcggcgaccaggcgatggccgccctcatcgcgatcgtctggtcggcggtcgcgacgacgatcatcgcgtacgccatcaagctcacgatcggctggcggatcccggacgaggccgaggtcgagggggtcgacttcgaccagcacggtgagacggcgtacgacctgcacagtggtctcggcggcagcgcgaacgcgcccgcctccgtcctggtcaagaacactgtcaccgaaggggtgaacgcatga

SEQ ID NO: 1927 - protein, 441 aa, Nocardioides sp. JS614
MIPGGSVDGYYAFMLVATALVLMMTVPALALFYGGMSRSKSVLNMMMMSYVAMAVVAIVYVLWGWSMTFGPNDVGGLFANPFDLFGLNDVTPDGYLAVMFQMTFAAITAALISGAIADRVKLSSWVVFLPLWVTLSYFPIGHMVWGGGFISEHFGAQDYAGGTVVHINAGVAGLVLALVIGKRIGFGKEPMRPHNLTLTMIGAGLLWFGWYGFNVGSIVFTGSTDEENIAQFYSETGVTFLNTTIATCAAMLGWLLVERLLHGKATSLGAASGIVAGLVAITPSCGAVELPGAILIGAVAGAACAWAVGLKYKVGLDDSLDVVGVHLVGGVIGTVLIGLVSSSDAPGGIDGLFYGGGFGSLGDQAMAALIAIVWSAVATTIIAYAIKLTIGWRIPDEAEVEGVDFDQHGETAYDLHSGLGGSANAPASVLVKNTVTEGVNA

SEQ ID NO: 1928 - DNA, 1425 bp, Nostoc punctiforme PCC 73102
  CDS (1)..(1425): transl_table=11
atgattggggctatgaccctactgtttttggcaggaccgctaatgggtaatgcttttgcccaaacaccagttgctgtaccagctgctgatactggagacacagcatttatgctgatttcagcagcattagtgctgctaatgacaccaggattggcgtttttctatggtggatttgtgcgatcgcgcaatatcctaaacacattgatgatgagctttgtcttgatggcgatcgtgggagttacctggattctctggggttatagtctttcttttgcaccagggttgccattcattggtgggttgcaatggtttgggttgaacggtgttggtttagagactcaaggctacttgccacatctgccttatgaagatgcgctcaaagcagcagaccccaaatatgctgatgtagtctcttatgccggaacgattccccaccaggcattcacgatttatcaagccatgtttgccattatcaccccagctttaatttctggggcactcgttgagcggatgagtttccgcgcctattcgctgtttgtgctgctttggtcaacctttgtttacgcccctctagcccacatggtatgggcgaaaggtggattcttgggtttagctggtggattaggtgccctcgactttgcaggtggcacagtagttcatattagttctggcgtttcagcgctagtagctgcgatcgtccttggccctcggaaaacccatcccgatcgccttagtccgccacacaatgttccttttattttgctgggtgctggcttgctctggtttggttggttcggtttcaacgctgggagtgccctatctgttgctagtggaacttctggtaacttaacaacaaatttagcaacaacagcctttgttgccaccaatacagcggcggcggcggcggctttaatgtggctaattttggaagcagttttacggggtaaaccgacagctgtgggagcagctacaggagccgttgctggtttagtagggatcactcccgccgccggatttgtgacaccgctatcagcgattttaattggtttcatcaccgcctttgtttgcttctatgctgtaagtttcaagcataagctgcaaatcgacgatgctttagatacctatcccgtgcatggcgttggtggtacagtgggggcaattttaacagccatctttgccacaactcaagtcaacggcggaggtaaagacggagtgctacgtggtaattttggtgaattgggagttgaactaatagcaatcgccgttgcttacgcgatcgcaggtgttggtacgtggattattctcaaagttatcgatgctacagtcggtctgcgtgttaaagaagaagcagaattgcaaggtttggatatcaacgaacacggcgaagagggttacaactctgagtttggcgatcgtccgacttag

SEQ ID NO: 1929 - protein, 474 aa, Nostoc punctiforme PCC 73102
MIGAMTLLFLAGPLMGNAFAQTPVAVPAADTGDTAFMLISAALVLLMTPGLAFFYGGFVRSRNILNTLMMSFVLMAIVGVTWILWGYSLSFAPGLPFIGGLQWFGLNGVGLETQGYLPHLPYEDALKAADPKYADVVSYAGTIPHQAFTIYQAMFAIITPALISGALVERMSFRAYSLFVLLWSTFVYAPLAHMVWAKGGFLGLAGGLGALDFAGGTVVHISSGVSALVAAIVLGPRKTHPDRLSPPHNVPFILLGAGLLWFGWFGFNAGSALSVASGTSGNLTTNLATTAFVATNTAAAAAALMWLILEAVLRGKPTAVGAATGAVAGLVGITPAAGFVTPLSAILIGFITAFVCFYAVSFKHKLQIDDALDTYPVHGVGGTVGAILTAIFATTQVNGGGKDGVLRGNFGELGVELIAIAVAYAIAGVGTWIILKVIDATVGLRVKEEAELQGLDINEHGEEGYNSEFGDRPT

SEQ ID NO: 1930 - DNA, 1206 bp, Listeria monocytogenes str. 4b H7858
  CDS (1)..(1206): transl_table=11
atggaatcagtatttatgttcttttgtactttattggtttggttaatgacaccaggtattgcattattttacggtgggatggttcgacgcaaaaatgtgttgagtacggccatgtatagttttagttcgatggcaattgtatctatcctttgggtgatagttgggtattcattagctttcgcccctggaaacggctttataggaagttttgactggaccttcctccataatgttggcttcgcagcaaacgatacttactcagatgctattccacatattctattcatgatgtttcaaatgactttcgcaattttgactgtagctatcatttctggggcatttgcagaaagaatgaatttctccgcttatttgattttcattatcttatggtcgttacttgtttattcccctgttgctcactgggtttggggtgacggtggttggttacgtaatctcggcgcacttgatttcgccggtgggaatgttgttcatattagttcaggtgtaacaggattagtccttgcaattatgattggacgtagaaaagaagccgattctgcttcacctcataatttacctttagcgcttattggtggtattctagtttggtttggttggtatggttttaatgttggtagcgcccttacaattgataatgtggctatgatagcttttgttaatacgaatacagctgctgctgcaggtattatcggttggggtttggttgaatggttgacgaataaaaagccaactatgcttggaaccatttccggagcaattgctggtttagtatccattacccctgccgctggatttgttaccgttccaagttcacttatcattggtttcctcggcggagcactatgcttctgggctgtgttctggttgaaaggaaaagtaaaatatgatgatgcacttgatgcattcggacttcatggaatcggaggtatttggggtggtatcgcaaccggccttttcgccacaacaaaagtaaatgaagctggagcagacggattattctacggcaatgcttctctcgtagtaaaacaattaatcgccattggttcaacggtagcatatgtggctatagcgacagcaataatcgtcgtaattatcaaactatttttaccaatccgtgtaaacgaagaacaagaatataaaggacttgatttgacgctgcacggcgaaaaagcatatcaagaataa

SEQ ID NO: 1931 - protein, 401 aa, Listeria monocytogenes str. 4b H7858
MESVFMFFCTLLVWLMTPGIALFYGGMVRRKNVLSTAMYSFSSMAIVSILWVIVGYSLAFAPGNGFIGSFDWTFLHNVGFAANDTYSDAIPHILFMMFQMTFAILTVAIISGAFAERMNFSAYLIFIILWSLLVYSPVAHWVWGDGGWLRNLGALDFAGGNVVHISSGVTGLVLAIMIGRRKEADSASPHNLPLALIGGILVWFGWYGFNVGSALTIDNVAMIAFVNTNTAAAAGIIGWGLVEWLTNKKPTMLGTISGAIAGLVSITPAAGFVTVPSSLIIGFLGGALCFWAVFWLKGKVKYDDALDAFGLHGIGGIWGGIATGLFATTKVNEAGADGLFYGNASLVVKQLIAIGSTVAYVAIATAIIVVIIKLFLPIRVNEEQEYKGLDLTLHGEKAYQE

SEQ ID NO: 1932 - DNA, 1452 bp, Rubrivivax gelatinosus PM1
  CDS (1)..(1452): transl_table=11
atggcccaggaagctgcatcggcgcccgccgctgccgcagtcgtcgaagcggccgccgccgctacccctgctgccgaagcctccgcgcccgaagcggcgccggccgcagccgcgcccgtgcccaacaagggcgacgtcgcgtggatgctggtgtccacgctgctggtcatcatgatgtcgatccccggcctggcgctgttctacggcggcctggtgcgcagcaagaacatgctgtcggtgctgatgcaggtcttcgtggtgttctcgctgatcagcgtgctgtggttcatctacggctacagcctggcgttcaccgaaggcaacgcctacatcggcggcttcgaccggctgttcctgaagggcgtgttcgatcccgccaccggcgcattcgcgatgggtgccaccttcagcaagggcgtggtcatccctgagatcgtgttcgtcgccttccaggccacgttcgcggcgatcacctgcggcctgatcgtcggcgccttcgccgagcgcatcaagttcagcgcggtgctgctgttcgtcacgctgtggttcaccttcagctacacgccgatcgcccacatggtgtggtactggatgggtccggacgcctacaccggcaaggaagtggttgatgccatgaatggcaaggccggccagatctggcagtggggtgcgctggacttcgctggcggcactgtggtgcacatcaacgccgccgtcgcgggtctggtgggtgcctacatggtcggcaagcgcatcggctacggcaaggaagccttcacgccgcactcgctgacgctgacgatggtcggtgcctcgctgctgtgggtgggctggttcggcttcaacgcgggctccgcgctggaagccggcaacagcgccgcgctggccttcctgaacaccttctcggccacggcctgtgccgtgctggcctggtgcgtcggtgagtcgctgttcaagggcaaggcctcgatgctgggtgcggcgtcgggtgcggtggccggcctggtggccatcacgccggccgccggcaacgtcggcatcgtcggcgccatggtgatcggcctcgtcgccggcttcgcctgcctgtggggtgtcagcggcctgaagaagctgctcggcgcggacgattcgctcgacgtgttcggcgtccatggcgtcggcggcatcgtcggtgcgctgctgaccggcgtgttcaactcgccggccctgggcggcccgggctacgtgaccgactgggtcaccgccagcgtcatctcggcggccgactactcgatcgcctcgcaggtgtggatccaggccaaggccgtgctgctgaccatcgtctggtcgggcgtggtctcggtggtggcctacaagatcaccgacctggtgatcggcctgcgcgttagcgaggatgccgagcgcgaaggcctcgacatcacctcgcacggcgagaccgcgtaccacaagtga

SEQ ID NO: 1933 - protein, 483 aa, Rubrivivax gelatinosus PM1
MAQEAASAPAAAAVVEAAAAATPAAEASAPEAAPAAAAPVPNKGDVAWMLVSTLLVIMMSIPGLALFYGGLVRSKNMLSVLMQVFVVFSLISVLWFIYGYSLAFTEGNAYIGGFDRLFLKGVFDPATGAFAMGATFSKGVVIPEIVFVAFQATFAAITCGLIVGAFAERIKFSAVLLFVTLWFTFSYTPIAHMVWYWMGPDAYTGKEVVDAMNGKAGQIWQWGALDFAGGTVVHINAAVAGLVGAYMVGKRIGYGKEAFTPHSLTLTMVGASLLWVGWFGFNAGSALEAGNSAALAFLNTFSATACAVLAWCVGESLFKGKASMLGAASGAVAGLVAITPAAGNVGIVGAMVIGLVAGFACLWGVSGLKKLLGADDSLDVFGVHGVGGIVGALLTGVFNSPALGGPGYVTDWVTASVISAADYSIASQVWIQAKAVLLTIVWSGVVSVVAYKITDLVIGLRVSEDAEREGLDITSHGETAYHK

SEQ ID NO: 1934 - DNA, 1500 bp, Burkholderia vietnamiensis G4
  CDS (1)..(1500): transl_table=11
atgcgcaaacttctgatgtccctgctgatggcaggctcgctgatcgcggccggcgtcggccccgcgcttgctgacgatgcggcctccgccgccgctgcgtccgcgcctgccaccacggcttccgacgcgtcggccgcttctgctccggccgccacggacgcctcggcgcccgccgccgccaccgcacccgcttcgggcgctgccgacgcatcggctgccgccgccgcgtccgcgcccgccgccccggcagcgccgaccgcaccgttctccgtcgattcgtcgaagatcagcgccggcgacaccgcgtggatgctcacctcctccgcgctcgtgctgttcatgacgatccccggcctcgcgctgttctacgcgggcatggtccgcaagaagaacgtgctcgcgaccgtgatgcagagcttcgcgatcaccgcgctgatcacggtgctgtggacggtggtgggctacagcctcgcgttcacgccgggcaacggcttcatcggcggcctgtcgcgcgtgttcctgcacgggatgaactacatcaagggcgacaaggcgaccacgctgaccgtcagccatctggccacgacgatccccgagtcggtctacttcgtctatcagatgacgttcgcgatcatcacgccggcgctgatctgcggcgcgttcgccgaccggatgaagttctccgcgatgctggtgttcatggcgctctggtcgctgatcgtctatgtgccgatcgcgcacatggtgtgggagccgaccggctggctgtcggcagacggcgtgctcgacttcgcgggcggcacggtggtgcacatcaacgccggtatcgcaggcctgatctcgtgcctggtgctcggcaagcgcgtcggctacggccgcgaatcgatggcgccgcacaacctggtgctgacgatgatcggcggctcgatgctgtgggtcggctggttcggtttcaacgcgggttcggcagtcgcggctgacggccgtgccggcttcgcgatgctgacgacgcaagtcgcgacggcatgtgcggcgctcggctggatgttcgcggagtgggtcgcgaagggcaagccgtcggtgctcggcatcgtgtcgggcgcggtcgcgggtctggtggcgatcacgccggcagccggcttcgtcggcgtgacgggcgcactggtgatcggcatcgcggccggcgtcgtgtgcttctggtcggccacgtggctcaagtcgaagctcggctacgacgattcgctcgacgcattcggcgtacacggcgtgggcgggatcctcggcgcactgctgaccggcgtgttcgcggtcaaggacatcggcggcgcggacggcagcctgctgctgcaggcgaagggcgtgctgatcacgctggtctacagcggcgtgctgagcttcgtgctgctgaagctgatcgacatgacgatcggcctgcgcgtgaccgaagaggaagagcgcgaaggtctggacgtgatcctgcacggcgaacacgtcgagtaa

SEQ ID NO: 1935 - protein, 499 aa, Burkholderia vietnamiensis G4
MRKLLMSLLMAGSLIAAGVGPALADDAASAAAASAPATTASDASAASAPAATDASAPAAATAPASGAADASAAAAASAPAAPAAPTAPFSVDSSKISAGDTAWMLTSSALVLFMTIPGLALFYAGMVRKKNVLATVMQSFAITALITVLWTVVGYSLAFTPGNGFIGGLSRVFLHGMNYIKGDKATTLTVSHLATTIPESVYFVYQMTFAIITPALICGAFADRMKFSAMLVFMALWSLIVYVPIAHMVWEPTGWLSADGVLDFAGGTVVHINAGIAGLISCLVLGKRVGYGRESMAPHNLVLTMIGGSMLWVGWFGFNAGSAVAADGRAGFAMLTTQVATACAALGWMFAEWVAKGKPSVLGIVSGAVAGLVAITPAAGFVGVTGALVIGIAAGVVCFWSATWLKSKLGYDDSLDAFGVHGVGGILGALLTGVFAVKDIGGADGSLLLQAKGVLITLVYSGVLSFVLLKLIDMTIGLRVTEEEEREGLDVILHGEHVE

SEQ ID NO: 1936 - DNA, 1284 bp, Croceibacter atlanticus HTCC2559
  CDS (1)..(1284): transl_table=11
atgagtaaaaaattaaactttataatattgactgtaattgtcattattagtctaatctgtagtgctgaatacacatttattgaatctactaattacagtattgatactggagatactgcttggatgattgtagctagtgcatttgtattattaatgacgccaggattagcttttttttacggaggtttagtcaatagaaaaaatgttatctccacaatgttacaaagttttgttgctttaggagtgatgagtgttctttgggtgtttataggctttagcctagcatttggagagagctaccatggtattataggtaatccttttacttactttaattttaataacgttacgctttcacccaaccctgacttttcatcaacaataccatttttattgttcgcattatttcaattaaaatttgcaatcattgctcctgcattaataactggaagttttgcagagcgcataaggtttagaagctacattttaataatgatattattttcattatttatttactgtccattagcacatatgacttggcatccagaaggtttgctgaggaattggggagtgttagattttgctggaggtacagtagtccacctttctgctggattagctgcacttgccggtgcaatatatttaggaaaacgcaaaaaaatgattgaagagccagcaaacatcccatttgtaatattaggaacaggattactttggtttggttggtttggctttaatgccggctctgcgctaggtgctaacatagatgctgtaatagcatttgcaaacacaaacttggcttctgcaacaagtatgattacttggatttttttagaccgcatgcttaataaaaaaatgtctgctattggtgcatgtattggagcaattgtaggtttagttgctataacaccagcggcaggttttgttaatttaggtcaaagtattttcattggtttctttgctgcggttataagtaatattgctattcaagtacagaaacaatgtaatattgatgacacactagatgtatttcctagtcatggagttggaggtattgtcggtatgattttaacaggagttcttgcaaaggatgtgggtttaatttatggagagacagaaacttttatgtttcatctaattgccttaatactcgtttctataggtgttttcggaggtagtttgcttatctataaaattgtagatttagttttaccagttagagtaagggaagatcaagaagaacgcggtctagacaattcgcaacatggtgagagaatataa

SEQ ID NO: 1937 - protein, 427 aa, Croceibacter atlanticus HTCC2559
MSKKLNFIILTVIVIISLICSAEYTFIESTNYSIDTGDTAWMIVASAFVLLMTPGLAFFYGGLVNRKNVISTMLQSFVALGVMSVLWVFIGFSLAFGESYHGIIGNPFTYFNFNNVTLSPNPDFSSTIPFLLFALFQLKFAIIAPALITGSFAERIRFRSYILIMILFSLFIYCPLAHMTWHPEGLLRNWGVLDFAGGTVVHLSAGLAALAGAIYLGKRKKMIEEPANIPFVILGTGLLWFGWFGFNAGSALGANIDAVIAFANTNLASATSMITWIFLDRMLNKKMSAIGACIGAIVGLVAITPAAGFVNLGQSIFIGFFAAVISNIAIQVQKQCNIDDTLDVFPSHGVGGIVGMILTGVLAKDVGLIYGETETFMFHLIALILVSIGVFGGSLLIYKIVDLVLPVRVREDQEERGLDNSQHGERI

SEQ ID NO: 1938 - DNA, 1227 bp, Dehalococcoides sp. BAV1
  CDS (1)..(1227): transl_table=11
atggacagcggcgatacgacttggttacttgtctccaccgctttggtcatgctaatgaccccgggcgtggctctgttttatggaggcatggttcggcgcaaaaatctggtttccactcttatgatgagctttggggcaatggctctgggtggtgtactctgggtcttgatcggttacagccttggtttcggcaacgatataaacgggttggtaggcggtctgaacttctttggcttaagtggtgtggggcaggatccgtctgatacttatgccaccacagtacctcatctggccttcatgatgttccagggtatgtttgctattatctctctggcacttattaccggtgcagtagtagagagaatccgttttagcgctttgctcatgtttggagcactctggctttgccttatatattcacctattgcccactgggtttggggcgatggtggttggctttttaatctgggtgttctggactttgccggtggtacggttgtgcatatcaatgccggtgtttctgctatggctctggttttggcacttggtgcccgacgcggtttccttaaagaacagatggagcccaacaacctgcccatggttatgctgggtgcggctttactctggttcggttggttcggttttaacggcggcagcgccttgactgccggtggtttggcttcaaacgcttttgttactaccaatactgcggctgccagtgcagctctttgctggatattccttagttggcggcatcgccggccgtccttgctgggggcagttactggtgcggttgccggactggtagctattactcctgcggctggttttgtaacacctatggcggctattgccatcggtgcagtggcggctctggtttgctacggtgctatgatattcaagataaaacgcggatttgacgattcactggatgttatggcggtacatggtgttggcggtatctggggtgctttggcaacaggtatcttcgccagtctggcggtcaactctgccggtgcagacggacttctttccggaaacgtggaattattccttaagcaagccttgggcgtggttgttactgcagggtttgcctttggaggcagcttcataatagccaaagttgtagataagctggtcggactgagggtgaaagaacccgaagaactcataggtcttgatattgcccaacacgctgaacgggcttacggggggagtgtcagatga

SEQ ID NO: 1939 - protein, 408 aa, Dehalococcoides sp. BAV1
MDSGDTTWLLVSTALVMLMTPGVALFYGGMVRRKNLVSTLMMSFGAMALGGVLWVLIGYSLGFGNDINGLVGGLNFFGLSGVGQDPSDTYATTVPHLAFMMFQGMFAIISLALITGAVVERIRFSALLMFGALWLCLIYSPIAHWVWGDGGWLFNLGVLDFAGGTVVHINAGVSAMALVLALGARRGFLKEQMEPNNLPMVMLGAALLWFGWFGFNGGSALTAGGLASNAFVTTNTAAASAALCWIFLSWRHRRPSLLGAVTGAVAGLVAITPAAGFVTPMAAIAIGAVAALVCYGAMIFKIKRGFDDSLDVMAVHGVGGIWGALATGIFASLAVNSAGADGLLSGNVELFLKQALGVVVTAGFAFGGSFIIAKVVDKLVGLRVKEPEELIGLDIAQHAERAYGGSVR

SEQ ID NO: 1940 - DNA, 1284 bp, Flavobacteria bacterium BBFL7
  CDS (1)..(1284): transl_table=11
atgggcaagaaggttaattttatagttttagctgttttagtacttatcagtttaacgtttagtaatccatatacagaaaacggtgacatgagtgccatcgatagtggcgatacggcatggatgttaatcgcatcagcatttgtattattaatgacgcctggacttgcctttttctatggcggtatggtgaataaaaaatcgatgatttctaccatgttgcaaagttttgttgctcttggtgttgttagtatactttgggtaatcgtaggtttctcacttgcctttggagaaagctattatggcatcataggaaatccaatgacttatttcaattttaaagatgtaggtcttgctcctaatccagattttgcaggaaccgtaccttttttagtatttgctcttttccagcttaagtttgccatcatcacaccagccttaatcacaggtagttttgcagaacgtgtccgtttcagaagctatatcttattcatggtattgtttactatattcatatacacgccattagcacatatgacttggcatccagacggattattgcgcaacctaggagtacttgatttcgctggtggaacagttgttcacatgagtgcaggatttgcagcacttgcaggagcagtttatttagggaaacgtaaaaaaataacacacgacccagcaaacgtaccttatatcattttaggaactggattgctatggtttggatggtttggttttaatgccggtagtgcgctagccgcaaatgcagatgccgccatagcctttgccaatacaaatatcgccagtgccaccgccatgatcacatggatgttttacgaacgtttctctaatcgtaaaatgagcgctgttggtgcatgtatcggtgcaatcgtcggattggttgccattactcctgctgcaggttttgttactatttcacaaagtatatttataggatttgctactgccattactagtaatatcgctatttcattattttctaaaaccggtattgacgatacactagacgttttccctagtcatggagttggtggaattgtaggtatgatcctgacagctgtatttgcaaaagatgtgggacttgtacatggcgagacagagacctttatgtggcatatcatagcacttataggtgtttctgtatttaccttcggtggtagtttattattttacaaactggttgatatattaatacctataagagtaagagatgatcaagaagaacgtggactagatgctagtcaacacggtgaagaagtcaattaa

SEQ ID NO: 1941 - protein, 427 aa, Flavobacteria bacterium BBFL7
MGKKVNFIVLAVLVLISLTFSNPYTENGDMSAIDSGDTAWMLIASAFVLLMTPGLAFFYGGMVNKKSMISTMLQSFVALGVVSILWVIVGFSLAFGESYYGIIGNPMTYFNFKDVGLAPNPDFAGTVPFLVFALFQLKFAIITPALITGSFAERVRFRSYILFMVLFTIFIYTPLAHMTWHPDGLLRNLGVLDFAGGTVVHMSAGFAALAGAVYLGKRKKITHDPANVPYIILGTGLLWFGWFGFNAGSALAANADAAIAFANTNIASATAMITWMFYERFSNRKMSAVGACIGAIVGLVAITPAAGFVTISQSIFIGFATAITSNIAISLFSKTGIDDTLDVFPSHGVGGIVGMILTAVFAKDVGLVHGETETFMWHIIALIGVSVFTFGGSLLFYKLVDILIPIRVRDDQEERGLDASQHGEEVN

SEQ ID NO: 1942 - DNA, 1311 bp, marine gamma proteobacterium HTCC2207
  CDS (1)..(1311): transl_table=11
atgttacttcgatatcgccaactcgcagcagttgcttttgcactcctggcagccatattttcaacccaggtatttgccgatgagctgaatgcagccaacacatcatggattttgacctctacagcactggtgctgtttatgaccattcccggcctctcgctgttttacggcggtctggttcgttcaaagaatgtgctctcggtattgatgcaatgttttgccatcacttgcctggcatcgattatctggtttgcctttggttacagtctggcatttggcgatggcggttccatgaacgcctggatcggtaatctagacaatatcctgatgggtaatatcaaagaagacaccatggctggggatattcccgagtcagtatttgccctgtttcaaatgacctttgctgtgatcaccccagcactcatcgtcggcgcttttgccgagcgtatgcgctttagcgccatgctgctgtttagcgccctctggttagtcgcggtttactctccaattacccactgggtttggggtggcggctggctcggcgagatgggtctgttggattttgccggcggtactgttgtgcatattactgctggtgttggcgccttggttgccgctctggtactgggtaaccgcaaaggcttcccacagcaggcgatgcctccccacaatctgaccatgactgtaactggtgccggtatgctctgggtcggttggtttggctttaatggcggttctgctctggctgccaatggcgatgccggtatggcaatgctagtaacacatatttccgctgcagcaggctcactcgcttggatgactatggaatgggtcaaatacggtaaaccttcggttctgggtatagtcacaggtatggttgccggcctcggcactattacaccagcgtctggttttgttggccccggcggcgcactggttatcggcttgagcgcaggtgttatctgctactacgccacacaggcaatcaagcaacgctggaaaatcgatgacagcctagatgtattcccagtccacggtgtgggcggcatcctcggtacattgctcgctggtatcttcgcttcagacgcactcggcgtgtttagcggtcagggctacaatgaaggaatgaacatggcctcgcaggttcaggttcaaatagtcggaattgtggctacttttgtctataccgctattgtgacatttgtactgttaaaactagttgatgccatgttaggattgcgtatcgatgacgaagacgaaactatgggtcttgatctcgcagagcatgatgagagggggtacgacttataa

SEQ ID NO: 1943 - protein, 436 aa, marine gamma proteobacterium HTCC2207
MLLRYRQLAAVAFALLAAIFSTQVFADELNAANTSWILTSTALVLFMTIPGLSLFYGGLVRSKNVLSVLMQCFAITCLASIIWFAFGYSLAFGDGGSMNAWIGNLDNILMGNIKEDTMAGDIPESVFALFQMTFAVITPALIVGAFAERMRFSAMLLFSALWLVAVYSPITHWVWGGGWLGEMGLLDFAGGTVVHITAGVGALVAALVLGNRKGFPQQAMPPHNLTMTVTGAGMLWVGWFGFNGGSALAANGDAGMAMLVTHISAAAGSLAWMTMEWVKYGKPSVLGIVTGMVAGLGTITPASGFVGPGGALVIGLSAGVICYYATQAIKQRWKIDDSLDVFPVHGVGGILGTLLAGIFASDALGVFSGQGYNEGMNMASQVQVQIVGIVATFVYTAIVTFVLLKLVDAMLGLRIDDEDETMGLDLAEHDERGYDL

SEQ ID NO: 1944 - DNA, 1428 bp, Acidovorax sp. JS42
  CDS (1)..(1428): transl_table=11
atgaaaaaactatttgcttccctactgatcggtgcaagcctgctggccggtggcgccggcgcgctggcccagacacccgacgcggccgcggcggcttcggagcccgtggccgtcgcccccgcgcctgcgcccgctgccgagcccgtcgcagcacctgctgcggcacccgcacccgcacccgcggcagcggcgcccgccgcgcccaaggtggactcgggcgacaccgcctggatgctgacctccacgctgctcgtgatcctgatgatcatcccgggcctggccttgttctacggggggctgggccgcaccaagaacatgctgtccgtgctgatgcaggtgttcgtgatcttcgccctggtgtcgctgctgtggtccatctacggctacagcctcgcgttctccggcgagggccaattcgtgggcgacctgtccaagctcttcctgaagggcgtgagccaggaaacctttggtgcgctggcgaccattcccgaatacgtgttcatcgccttccagggcacgttcgcggccatcaccgtggcgctgatcgtgggctcctttgcggaacgcatgcgttttgcggccgtgctcatcttcgcgctgctgtggttcaccttcagctacgtgcccatggcccacatcgtgtggggtggcggcctgctggcggccgacggcgcgctcgattttgcgggcggcaccgtggtgcacatcaatgccggtatcgcgggcctggtgggtgcctacatggtgggcaagcgtatcggcttcggcaaagaggccttcaccccgcacagcctgacgctgacgatggtgggcgcctcgctgctgtgggtgggctggttcggcttcaacgccggctctgcaggggccgccaacgccgttgcgggcctggccttcgtgaacacggtgctggccacctcggccgccacgctgtcgtggatcgccggcgaagcgctgcacaagggcaaggcctccatgctgggcgcggcctcgggcgcggtggccggcctggtggcggtcacgcccgccgcgggcttcgtgggccccatgggctccatcgcgatcggcctgatcgccggcctggtctgcctgtggggcgtgggtggcctgaagaagatgctgaacgtggacgacgccttcgacgtgtttggcgtgcatggcgtgggcggcatcgtgggcgccatcctcaccggcgtgttcgcggcccagggcctgggcggcaccggcggcctgacgcccgacaccttcagcatgggcgcgcaggtgtgggtgcaggtcaagagcgtgctgttcaccatcgtgtggtcgggcgtggtgtccttcatcgcctacaaggtcgccgacctgctggtgggcctgcgcgtgagcgaggaagccgagcgcgagggcctggacatcacctcccacggcgagacggcctaccaccgctga

SEQ ID NO: 1945 - protein, 475 aa, Acidovorax sp. JS42
MKKLFASLLIGASLLAGGAGALAQTPDAAAAASEPVAVAPAPAPAAEPVAAPAAAPAPAPAAAAPAAPKVDSGDTAWMLTSTLLVILMIIPGLALFYGGLGRTKNMLSVLMQVFVIFALVSLLWSIYGYSLAFSGEGQFVGDLSKLFLKGVSQETFGALATIPEYVFIAFQGTFAAITVALIVGSFAERMRFAAVLIFALLWFTFSYVPMAHIVWGGGLLAADGALDFAGGTVVHINAGIAGLVGAYMVGKRIGFGKEAFTPHSLTLTMVGASLLWVGWFGFNAGSAGAANAVAGLAFVNTVLATSAATLSWIAGEALHKGKASMLGAASGAVAGLVAVTPAAGFVGPMGSIAIGLIAGLVCLWGVGGLKKMLNVDDAFDVFGVHGVGGIVGAILTGVFAAQGLGGTGGLTPDTFSMGAQVWVQVKSVLFTIVWSGVVSFIAYKVADLLVGLRVSEEAEREGLDITSHGETAYHR

SEQ ID NO: 1946 - DNA, 1296 bp, marine gamma proteobacterium HTCC2143
  CDS (1)..(1296): transl_table=11
atgggtactttatcgatgcgtctatcgacgttatcaattgctttaatggcatctggtttagcggctgctgaagatacactcaatgcggctaacaccagctggatactaacgtcgacagcgctggtgttgtttatgacgcttcctggtctggcgctattttacggggggttggtccggtcgaaaaacgtactgagtattctgatgcagtgttttgctattacctgtattgcttcagttctttggttcgtagtcggctatagcatcgccttcggcgaagggaacccttattttggggggatggggaaagccttgttgtcgggagtgacgtcaagttctctagcgggtgatattcctgaaaccgtctttgttatgtttcagatgacctttgccatcattacaccagctttgattatcggcggttttgcagagcggataaagttctctgccgtggtaatatttaccgcattatggttgttagttgtctacgccccaatcactcactgggtttggggtggaggctggttaggtgagatgggtttactggattttgccggtggcacagtggttcacatcaccgccggtgttgccgctttggtgtctgcagttgtgttgggcaaccgcaaaggcttcggcgaaaccgcgatgcctccgcacaacatgaccatgacaattatgggcgcgggtatgttatgggtaggctggtttggttttaatgccggtagtgccctcgctgcgaacggtgatgcgggtatggccatgttggtcacgcacttatcagctgcggctgggacgtttacttggttgacgattgaatggattaaatacggtaagcccagtgcattaggcgcagtaacaggcatggtggctggtttgggaacaatcacaccggcatcaggctatgtaggccccggcggagcattggttataggtctcagcgctggtatcgtatgcttttatgcgacgctctatatcaaacaggtgttgaaaatagacgattcgctggatgtgtttccggtacacggtgttggcggcatattggggacttttctagcgggaatatttgccagcgcggagcttggcatattcagcggtcaaggcttgccagagggtgtcactattctacagcagctgggtgttcaattaaccgggattgttgctacctttgtttacgctggcgtggcaacgtacatcatattagtcgttgttagggcgctggtcggattgcgagtgactgaagacgaagagagagagggtttggatactgtgtctcacaacgagcggggttacgatttgtag

SEQ ID NO: 1947 - protein, 431 aa, marine gamma proteobacterium HTCC2143
MGTLSMRLSTLSIALMASGLAAAEDTLNAANTSWILTSTALVLFMTLPGLALFYGGLVRSKNVLSILMQCFAITCIASVLWFVVGYSIAFGEGNPYFGGMGKALLSGVTSSSLAGDIPETVFVMFQMTFAIITPALIIGGFAERIKFSAVVIFTALWLLVVYAPITHWVWGGGWLGEMGLLDFAGGTVVHITAGVAALVSAVVLGNRKGFGETAMPPHNMTMTIMGAGMLWVGWFGFNAGSALAANGDAGMAMLVTHLSAAAGTFTWLTIEWIKYGKPSALGAVTGMVAGLGTITPASGYVGPGGALVIGLSAGIVCFYATLYIKQVLKIDDSLDVFPVHGVGGILGTFLAGIFASAELGIFSGQGLPEGVTILQQLGVQLTGIVATFVYAGVATYIILVVVRALVGLRVTEDEEREGLDTVSHNERGYDL

SEQ ID NO: 1948 - DNA, 1308 bp, marine gamma proteobacterium HTCC2080
  CDS (1)..(1308): transl_table=11
atgcacgttacacgtaaatcggctttcatagcgttatgcgcttttctattacctcttcccgctttggctggggagatttcctccgctgatactgcgtggctcttgaccgcgactgcgctggttttatttatgaccttgccgggactgtcgttattctacggtggtctagtgcgtgtccgtaacgtcttgtcggtgttaatgcagtgttttgctttggctgcgttgatgtcagtggtttggtttgtggcgggttacaccttggcctttggctctgccggtgttgagcagggcgcctggattggtgatcttggcaatctaatgctcatgggcattgatattgatggcgtcaacggttcaattcccgactccctgtttgttatgtttcaaatgacctttgcgattattactccagccctaattattggcggttttgccgagcgtattcggttttcagcactattgctgttcagtacggcatggctattacttgtctacgcacctatttgtcactgggtttggggcggtggctggttgggcgccatgggtcttcaggattttgccggtggcacagtggttcatatcacggcaggtgtcgccgccttggtcgccgcaatcatgatgggaccgcgtcgagggtttggttccgtggccatgccgccacacaacctaacgatgaccgtgacaggtgccggcatgctttgggtgggatggtttggttttaatgccggttcggctgtggcggcggatcaaagtgccgctatggcgatgctggtgacacatctttctgcagcttgcggttctttggcatggatggctatggagtgggtgcgtcacggtaagccctcggttctaggcatcgttaccggtatggtggcgggtctgggtacgattacacccgcatcaggctcagtagggcctgcagcagcggttgtgattggactcactgcaggggtcgtctgctacttcgcaacgattaccttgaaaaatcgtctgaaaatagatgacagtctcgatgtttttcccgtccacggtgttggtggtattttgggcacactgttggcaggtgtcttttgctcaccgaatctgggcatctttagcggcaatggtttctccgacggtattgacagtatcgctggtcagcttgccgttcaggcgacaggtgtcggcgcaacgtttctgtataccctggtcgtgagctacattctctttaaggtggtcgatgccctcgtgggacttcgcgtcgatagtgatgaagaaaccatcgggctggatttggtgcttcacgatgagcgaggctacgacttgtag

SEQ ID NO: 1949 - protein, 435 aa, marine gamma proteobacterium HTCC2080
MHVTRKSAFIALCAFLLPLPALAGEISSADTAWLLTATALVLFMTLPGLSLFYGGLVRVRNVLSVLMQCFALAALMSVVWFVAGYTLAFGSAGVEQGAWIGDLGNLMLMGIDIDGVNGSIPDSLFVMFQMTFAIITPALIIGGFAERIRFSALLLFSTAWLLLVYAPICHWVWGGGWLGAMGLQDFAGGTVVHITAGVAALVAAIMMGPRRGFGSVAMPPHNLTMTVTGAGMLWVGWFGFNAGSAVAADQSAAMAMLVTHLSAACGSLAWMAMEWVRHGKPSVLGIVTGMVAGLGTITPASGSVGPAAAVVIGLTAGVVCYFATITLKNRLKIDDSLDVFPVHGVGGILGTLLAGVFCSPNLGIFSGNGFSDGIDSIAGQLAVQATGVGATFLYTLVVSYILFKVVDALVGLRVDSDEETIGLDLVLHDERGYDL

SEQ ID NO: 1950 - DNA, 1305 bp, Pseudomonas putida GB-1
  CDS (1)..(1305): transl_table=11
atgaagcacctcaccctcgctgtaatgttgttagccctggccacccaggccactgccgccgaaaccaccctggacaccggcaacaccgcctggatgatctgcgccgcgatgttcgtgctgatgatgtgcatccccggcctggcgatgttttacggcggcatggtgcgggccaagaactttctttcggtgttcacccagctgttcgccgtggccggcgttatcggcattatctgggtgctgttcggctacagtctggtggtcgataccaccggcatggtcgagggccagctcaccttcaacagtttcatcggcgggttggacaaggcgctgatgctggatatcggccatgacagcctggtcggcaccatccccgaaggtgtgtttgcggtgtttcagctgacgttcgccatcatcaccccagcgctgattgccggtggttttgccgagcgcatgaagttcaccgcctcgttgctgttcatgacggcgtggttcgtgctggtgtatgcacctattgcccatatggtatggggcgggccgggggcactgatggtcaactggggggtgctggacttcgccggcggcactgcggtgcacatcaattccggcgtggcggccttggcggcggcgttgatgctgggcaagcgcaagggctacccgcaggtggccatgccgccgcataacctgggttttactctggtgggcgcggggttgttgtgggtgggctggttcggcttcaacgttgggtcggggcttgccgcgaaccagggggcaggggtggtgatgctggcgaccatggtggcggcctgcgcggggattgtcggttggttgctgaccgagaaggtgatgcatggtcgaccgactgccttgggtgctgcgtcgggggcactggcggggctggtgggtattacaccggcctgcgcattcgtcgggccgctgggggcactggtgatcggtgtgttgaccggggccatctgcttctttgccgtgacccggctcaagcaggcgctagggtatgacgacagccttgatgtgttcgggctgcatggtgtgggtgggatggtcggggcgattctgaccggtgtgtttgccgcgccggcactgggtggctatgtggaaggcgcatcgcccattgggcaagcactggtgcagttgaagggtgtggcgttcaccttcgtttactgcttcgtggtgagctgggtaattctcgcggccatcaagctgaccatcgggttgcgggccagccgagaggaagaagagcaagggctggacctggcggagcacaatgagcgcgcttataacctttga

SEQ ID NO: 1951 - protein, 434 aa, Pseudomonas putida GB-1
MKHLTLAVMLLALATQATAAETTLDTGNTAWMICAAMFVLMMCIPGLAMFYGGMVRAKNFLSVFTQLFAVAGVIGIIWVLFGYSLVVDTTGMVEGQLTFNSFIGGLDKALMLDIGHDSLVGTIPEGVFAVFQLTFAIITPALIAGGFAERMKFTASLLFMTAWFVLVYAPIAHMVWGGPGALMVNWGVLDFAGGTAVHINSGVAALAAALMLGKRKGYPQVAMPPHNLGFTLVGAGLLWVGWFGFNVGSGLAANQGAGVVMLATMVAACAGIVGWLLTEKVMHGRPTALGAASGALAGLVGITPACAFVGPLGALVIGVLTGAICFFAVTRLKQALGYDDSLDVFGLHGVGGMVGAILTGVFAAPALGGYVEGASPIGQALVQLKGVAFTFVYCFVVSWVILAAIKLTIGLRASREEEEQGLDLAEHNERAYNL

SEQ ID NO: 1952 - DNA, 1332 bp, Pseudomonas putida GB-1
  CDS (1)..(1332): transl_table=11
atgactctgcgtaagatcgcagggctaggagccctattgtccctcgtaatgcccgggcttgccctggcagaggaagctgccccagcgctgaactccggcgataccgcctggatgctgaccgcaacggcgctggtgctgttcatgaccattccgggcctggccctgttctatggcggcatggtgcgttccaagaacgtgctgtcggtgatgatgcagtgctttgcaatcaccggcctgatgagcattctctgggtcgtttacggctacagcatggccttcgataccaccggtatggaaaagggcgtgctcaacttcaactccttcgttggcggtttctccaaagcctttctcagcggcgtaacgcccgagaacttgacctcggccaccgcgctgttccctgaagcggtattcatcaccttccagatgacatttgccatcatcaccccggcgctgatcgtcggtgccttcgccgagcgcatgaagttctccgcgatgctggtgttcatgggtatctggttcaccctggtgtatgcgcctatcgcgcacatggtgtggagtggtgacggcgcactgatgtgggactggggcgtgctggacttcgctggcggcaccgtggtgcacatcaacgccggtatcgcaggcctggtcagctgcctggtgctgggcaagcgaaaaggctacccgaccacgccgatggccccgcacaacctgggctataccctgatgggtgcggccatgctgtggatcggctggttcggcttcaacgcaggctccgccgctgcggccaacggcaccgccggcatggccatgctggtcacccagatcgccactgccgctgcggcactgggctggatgttcgccgagtggatcggccacggtaaacccagtgccctgggcatcgcctcgggtgtggttgccggcctggtcgccattaccccggctgcaggcaccgtgggcccgatgggcgctctggtgattggcctggcgtcgggtgtgatctgctacttctgcgccaccaccctcaagcgcaagctgggctatgacgactcgctggacgctttcggcgtgcacggaatcggcggcatcatcggtgccatcctcaccggcgtgttcgcagcccctgcactgggcggcttcggtaccgtcaccgacatcggcatgcaggtctggatccaggccaagggcgtgatcttcaccgtggtgtacaccgccatcgtcacctacgtgatcctcaaggtgctggatgtggtgatgggcctgcgggtcaacgaagaagaagagtcggtcggcctcgacctggctcagcacaacgaacgcggctacaacctgtaa

SEQ ID NO: 1953 - protein, 443 aa, Pseudomonas putida GB-1
MTLRKIAGLGALLSLVMPGLALAEEAAPALNSGDTAWMLTATALVLFMTIPGLALFYGGMVRSKNVLSVMMQCFAITGLMSILWVVYGYSMAFDTTGMEKGVLNFNSFVGGFSKAFLSGVTPENLTSATALFPEAVFITFQMTFAIITPALIVGAFAERMKFSAMLVFMGIWFTLVYAPIAHMVWSGDGALMWDWGVLDFAGGTVVHINAGIAGLVSCLVLGKRKGYPTTPMAPHNLGYTLMGAAMLWIGWFGFNAGSAAAANGTAGMAMLVTQIATAAAALGWMFAEWIGHGKPSALGIASGVVAGLVAITPAAGTVGPMGALVIGLASGVICYFCATTLKRKLGYDDSLDAFGVHGIGGIIGAILTGVFAAPALGGFGTVTDIGMQVWIQAKGVIFTVVYTAIVTYVILKVLDVVMGLRVNEEEESVGLDLAQHNERGYNL

SEQ ID NO: 1954 - DNA, 1401 bp, Gibberella fujikuroi
  CDS (1)..(1401)
atgaccactccttacaatggcaccactgatcatgccgactatggctactcaacccatgtgcatgatctcaacatcttctacgacacgggcaacttgacgttcctcgccgtcagcgccgtccttgtgcttctcatgattcccggcgtcggcttcttctacagtggtctcgctcgtcgcaagtctgctctgacgctcattctgttgtcgatgatttcagttgcggtcatcagtttccagtggttcttctggggatactccttgaccttctcgcgaactggaaactcattcctcggtgacttgacccagtttggtctcatggacaccctcgctcagcccaatggctcttccgctctccctgacattctcttttgtctgtaccagggcatgttcgctgccattactcctgcccttgccattggttgcgttgctgatcgaggtcgcatcctccccgccatcgtcttcatgttcctttggtccaccatcgtctacgatcccatcgcctactggacctggaacgccaacggctggctcttcaaccttcccagctacgactttgctggaggtggtcccgttcacgtctcttcaggaacctgcgcgctcgcctactcccttatgctcggcaagcgtaccggctactccaacaacaacggtcttccttaccgccctcacaacgtcacccacgttgttctcggcacggtcttcctctgggtcggctggttcggcttcaacggaggttctgctctcgccatgaacatccgcgccgtcatggcatgctacgttaccaacctggctgcctcatgcggtgccattgcctggatcctcctcgattaccgtctcgagaagaagtggagcaccattggcttctgctccggtgccatttctggtctcgttgccatcactcctgccgctggtttcgtgaagccctgggctgccgtcattatcggaatctgcggtggtatcttctgcaacttcgccaccaaggtcaagttcctcatcaacgttgacgacagtcttgatatctttgccatccacggaattggtggtatggttggtaacatccttaccggtatctttggaaccaaaaccattgccgctctcgacggtggagagtacgaccctattggttgggttgacggtcactttgttcagctgggttaccaaatcgctggtactcttgccgtcttcgcttggtcctttaccctcacttgcattctccttttccttctcaacctcatccctggcctctcccttcgtgtctccccagaggaggaggagctcggcactgatgatggccagctgggcgagtttgcctatgactatgttgagatgactcgacacatggctgacagcacacatcctcattctgatgctagtgcccgaacaagtcaggagaaggtctaa

SEQ ID NO: 1955 - protein, 466 aa, Gibberella fujikuroi
MTTPYNGTTDHADYGYSTHVHDLNIFYDTGNLTFLAVSAVLVLLMIPGVGFFYSGLARRKSALTLILLSMISVAVISFQWFFWGYSLTFSRTGNSFLGDLTQFGLMDTLAQPNGSSALPDILFCLYQGMFAAITPALAIGCVADRGRILPAIVFMFLWSTIVYDPIAYWTWNANGWLFNLPSYDFAGGGPVHVSSGTCALAYSLMLGKRTGYSNNNGLPYRPHNVTHVVLGTVFLWVGWFGFNGGSALAMNIRAVMACYVTNLAASCGAIAWILLDYRLEKKWSTIGFCSGAISGLVAITPAAGFVKPWAAVIIGICGGIFCNFATKVKFLINVDDSLDIFAIHGIGGMVGNILTGIFGTKTIAALDGGEYDPIGWVDGHFVQLGYQIAGTLAVFAWSFTLTCILLFLLNLIPGLSLRVSPEEEELGTDDGQLGEFAYDYVEMTRHMADSTHPHSDASARTSQEKV

SEQ ID NO: 1956 - DNA, 1386 bp, Gibberella fujikuroi
  CDS (1)..(1386)
atgctctcggccacagctctagtgctgttaatggttcccggtgttggcttcttctattcaggcctcgcccgtcgcaaatcggctctgtcgcttatatggctctcagtaatgagcgccgcagtgacgactttccaatggttcttctggggcttctctctcaccttctcgcatacggccggcccgtttatcggtgaccttgccaactttggcttccgcgatgtcctggcccggccctcggttggttccgctcatctccccgatatgctcttcgccgtttaccagggcatgttctccgccctaactgtggctctcgctaccggtgccgtcgccgagcgtggccgcatgctcccctgtattatcttcaccttcgtgtgggccactgtcgtgtacgaccctattgcctgctggacctggaatcccagtggctggtctaacaagatgggcggcctcgattttgctggaggcacccctgtgcacatcgcttctggaagcgctgctctggcttattcaatgatgctgggcaagcgtagtggccatggaacgcatgagctcaactaccgccctcacaatgctactcatatcgtgaccggaacagtcttcctttgggttggatggtttggcttcaacgccggctctgctctctctgctaaccttcgcggcgtaatggccgccatcgtgactaaccttgctgcttgtgtcgggggcatcacctggtgtctgttggactatcgtctggagaggaagttctccactgtcggcttttgctctggtgttgttgccggtctcgtctgcatcacccctggctctggctatgtccccccatggtctgctgtcatctttggtgctgtcggcgctgctggctctaactatgctaccaaggttaagttcctccttggaattgacgatgcactcgatatctttgccgtccacggcattggtggtttgatcggcaatatctgtaccgccttcttcgccaccccaagcatcgctgctctcgacggctactctcacatcaagggcggttgggtcgaacgtcactgggcgcagatgggttatcaactggccgattccatctgtggaggcccatactcattcgtcgtcacttgcagcatcctattcctcatgaacctcattccgggtctgcgtcttcgagtcgattcggatgccgaagtacagggcattgacgatgccgagattggagagttcgcatacgactacgttgagcttactcgtgaagtcgtcagcgatatcgacaacgagtccggaagccgatactcggctgatcctacggctttccaccattacgaaaaaaatcacattcccatgattgatgctcgcatgtttggtggccagcccgcgcatgcccctgtgacgtttccacagtga

SEQ ID NO: 1957 - protein, 461 aa, Gibberella fujikuroi
MLSATALVLLMVPGVGFFYSGLARRKSALSLIWLSVMSAAVTTFQWFFWGFSLTFSHTAGPFIGDLANFGFRDVLARPSVGSAHLPDMLFAVYQGMFSALTVALATGAVAERGRMLPCIIFTFVWATVVYDPIACWTWNPSGWSNKMGGLDFAGGTPVHIASGSAALAYSMMLGKRSGHGTHELNYRPHNATHIVTGTVFLWVGWFGFNAGSALSANLRGVMAAIVTNLAACVGGITWCLLDYRLERKFSTVGFCSGVVAGLVCITPGSGYVPPWSAVIFGAVGAAGSNYATKVKFLLGIDDALDIFAVHGIGGLIGNICTAFFATPSIAALDGYSHIKGGWVERHWAQMGYQLADSICGGPYSFVVTCSILFLMNLIPGLRLRVDSDAEVQGIDDAEIGEFAYDYVELTREVVSDIDNESGSRYSADPTAFHHYEKNHIPMIDARMFGGQPAHAPVTFPQ

SEQ ID NO: 1958 - DNA, 1542 bp, Gibberella fujikuroi
  CDS (1)..(1542)
atgtcttatgttatccctgggcccccgactgccttcaatggcaccaatgaagagcttggtggtgattccactaccgagaatctcaaccaatggtaccaatctggcgaccaggccttcatcatcctctccgcctgcctcgtccttctcatggtccctggcattgccttcctgtactctggtcttgcccgaagaaaatcagccctctccatgctctgggttgttatgatgtccttctccgtcattgtcttccagtggtacttctggggcttctctctcgccttctctacaacttccaacaaccccttcatcggtgatctcaagcatttcggtctcatgaaggtctggggtgctccctcagtcggatctcctcttatccctgctctgctttactctttctatcagatgatgttctgcgctgtcactggcgctcttacagtcggcgctgtcgcagagcgaggccgcgttgtgccaagcatggtgttcatcttcttctgggccactcttgtctactgccctctcgcgtactgggtctggaaccctaatggttggggcttcgttaacggcgttctcgactacgctggtggtgttcccgtcgagattggctccggcatgtccgcattcgcctactcttgggttctgggccgccgcaacgagaagatgatgatgaacttccgtcctcacaacatctccctcatcactctcggtaccatgttcctctggttcggctggctcggcttcaatggtggctcttctttcggtgctaacttccgtgctgttatggcttgctggaactcctgcctcactgccatgtttgctgctatgacttggtgcgttctcgatttccgcctggctcgtaagtggtccatggtcggctggtgctctggcactatctctggccttgttgctgctactcctgcttccggtttcctcgacccttgggctagcatcatcctgggtgttgtcgctggtgtcgcttgcaattttgccacaaagatcaagttccttgttcgaattgacgactctctcgatgtgtttgccgagcacggtgtcggtggtatcgttggtctcatcttcaatgcttttttcgcccgtggctctatcattggcctcgacggtgtcaacactggtgcttcaggtggcttcatggatggcaactacgtcatcattggctggcaaatcgctgccattgtcgctgcctccgcttatgccttcgtcatgtctgccatcatcgccaagattatcgacttcattcctggactgaagctccgtgcctctgaagaggctgagctccttggtatggatgatgaccagcacggcgagttctcttacgactacgttgaggttcgccgagacttccttgcttggagccctcaccgtggtgagcccgctgaagatggtgatgtgcttgagcctacccatggcattcaggagcaccagtctatgatgaacccaagcgaatccgatgatgtccgcaagactccttctcttaacacgcccgatgtcgttgcacccgacgcggtgattaacgagaagcatgcttaa

SEQ ID NO: 1959 - protein, 513 aa, Gibberella fujikuroi
MSYVIPGPPTAFNGTNEELGGDSTTENLNQWYQSGDQAFIILSACLVLLMVPGIAFLYSGLARRKSALSMLWVVMMSFSVIVFQWYFWGFSLAFSTTSNNPFIGDLKHFGLMKVWGAPSVGSPLIPALLYSFYQMMFCAVTGALTVGAVAERGRVVPSMVFIFFWATLVYCPLAYWVWNPNGWGFVNGVLDYAGGVPVEIGSGMSAFAYSWVLGRRNEKMMMNFRPHNISLITLGTMFLWFGWLGFNGGSSFGANFRAVMACWNSCLTAMFAAMTWCVLDFRLARKWSMVGWCSGTISGLVAATPASGFLDPWASIILGVVAGVACNFATKIKFLVRIDDSLDVFAEHGVGGIVGLIFNAFFARGSIIGLDGVNTGASGGFMDGNYVIIGWQIAAIVAASAYAFVMSAIIAKIIDFIPGLKLRASEEAELLGMDDDQHGEFSYDYVEVRRDFLAWSPHRGEPAEDGDVLEPTHGIQEHQSMMNPSESDDVRKTPSLNTPDVVAPDAVINEKHA

SEQ ID NO: 1960 - DNA, 1654 bp, Glomus intraradices
  CDS (143)..(1582)
acgcggggaaccaaaaaataaataattatttggtccattaattaaaaaaaaaattatacctttattatttattacttttgaaaaataatttactctcttacgataaatcaaattttttcattctccctccttttaagataaaatgtctgctcccgctgctgctcctgctgcagaacctaatccattcgatggtgttaatataacagaactcattgcaaatgtgtcagcattgtcttcagttaacgatattgatcaaggacatacagcatggattatgatgtcaactgctttggtatttattatgattccaggtgtcggatacttttacagtggtatggctagaagtaaaaatgcattatcccttataatgttaagtgttttatccttggctgtagtatcaattcagtggtgggctatcggtttcagtttagcattcggcccaggcacaagtggttatatcggaaacttaaattatgctttctttatgggtgtcggtactgaacctcttaatggtgctgtaaaaattccaggaatagtttttgccatgtatcagtgtatgtttgctgctattacacccgcacttgccatcgggtctgcagctgaacgtggtagaattttcccaagcatagtcttcatttttatttggtcaactattgtatatgatccaattgcttactggacatggaatcttaatggttggtccgcaaaaatgggtggtctcgatttcgctggtggtactcccgtacacatttcttctggtgctgctgctcttgcttactgtttaatcttgggtaaaagaactagtcatggaactgatgaatttaaacctcataatattgctaatgttgtacttggaaccgttttactttggttcggttggtttggtttcaacggtggttcagctcttaattctacttctcgtgctgctatggctatcgctgtaaccaatttatcagctgctgttggtggtcttacttggtgtttattggattatcgacttgaaaagaaattgtcagctctagctttctgttccggtgctgttgcaggacttgttgctatcaccccaggttctggttatgttggtaccccagctgctgttgcttttggtttcattgctggaatttgttgtaatttggccgttaaattgaagcacatctttgattttgatgacgctttggatgttttcgctgttcatggagtcggtggtgttattggtaatattttaactgctatttttgctgaacagaaaattgttgcccttgacgaaactgttttacctggaggttggcttaatcaacattggatacaaatgggtcatcaactcgctgattcagttactggtgtagcttattcatttgttgttacatatttaatcttatttattatggataaaattcccggactttcactcagagctgatcctgaatctgaagctaaaggtttagatgaaactgaattaggagaattggcttattatcatgtcgatagacttgtagcagtaaatacacgaaccggtgagacaaaacccgtaaaagaagaaacaattccccaacaaaatgacgcaaatgcaacaattgtataaaacgaatgaaaattttttatttcccattatcatttttttaattcccaaaaaaaaaaaaaaaaaaaaaaaaaa

SEQ ID NO: 1961 - protein, 479 aa, Glomus intraradices
MSAPAAAPAAEPNPFDGVNITELIANVSALSSVNDIDQGHTAWIMMSTALVFIMIPGVGYFYSGMARSKNALSLIMLSVLSLAVVSIQWWAIGFSLAFGPGTSGYIGNLNYAFFMGVGTEPLNGAVKIPGIVFAMYQCMFAAITPALAIGSAAERGRIFPSIVFIFIWSTIVYDPIAYWTWNLNGWSAKMGGLDFAGGTPVHISSGAAALAYCLILGKRTSHGTDEFKPHNIANVVLGTVLLWFGWFGFNGGSALNSTSRAAMAIAVTNLSAAVGGLTWCLLDYRLEKKLSALAFCSGAVAGLVAITPGSGYVGTPAAVAFGFIAGICCNLAVKLKHIFDFDDALDVFAVHGVGGVIGNILTAIFAEQKIVALDETVLPGGWLNQHWIQMGHQLADSVTGVAYSFVVTYLILFIMDKIPGLSLRADPESEAKGLDETELGELAYYHVDRLVAVNTRTGETKPVKEETIPQQNDANATIV

SEQ ID NO: 1962 - DNA, 2279 bp, Azotobacter vinelandii
  CDS (850)..(2160): transl_table=11
ctgcagcaaggccttgagctgggcttcgagttcccggggcgggagcggcgtctcgcgccgagcaggcggaagcatgggtgctgagggtgtcgaacagggctttgggcggcagcatggtgcggttccggaatcagtcggccggcagtgtaacacgggccgtcgacagggctgtcgggccgtgcgcgctcgttttcgtcgggggagcatgtgcccgtgcgtcgggtgggtgcgacatcttttcgcgccccatccggcgaaagatccataaccacgtcgacgataggggttttggccgtttgtcgatggcggtatgatttttgcctttgcgaagacatggcactccgaggcgttggccagacacggatgccgtcgagcgggccggtcagaggcggtcacgcgaaagccgaacactgcgcttaaacttgaatcgggatcgtttattcctggggcaagtccacttacacggagatatgtttcatgaagctagtcactgccatcatcaagccgttcaagctggacgacgtacgcgaatcgctgtcggagattggggtgcagggcatcaccgttaccgaggtcaaggggttcggccggcagaagggccataccgaactgtaccggggtgcggaatacgtagtcgactttctgcccaaggtgaagatcgacgtggccatcgaggacagtcagctcgaccatgtcatcgaggccatcaccaaggccgccaacaccggcaagatcggtgacggcaagattttcgtcgtcaatctggaacaagccatccgcatccgtaccggcgaaaccggcaccgacgcgatctgagcccacgatccccccgccccaggagaataatcaatgacgctgcgcaaaggcgcagggtcttgctgccctttcttccctcttcctgccccgtcatggccagccgcccaggaggctacgctggattcgggcgataccgcctggatgctgaccgccacggcgctggtgctgttcatgaccattcccggcctggcgctgttctacggcggcatggtgcgttcgaagaacctgctctcggtgatgatgcaatgcttcgccatcaccggcctgatcagcgtgctctgggtcctgttcggttatagcttggccttcgacaccgccggcatggaggagggggtgctcaacttcagttccttcgtcggcggtctggacaaggccttcctcagtggcctgaccaccgacagcctggtcggcacctttcccgaaagcgtcttcatcaccttccagatgaccttcgccatcatcactccggcgctgatcaccggtgccttcgccgagcgcatgaagttctcgtcgatgctggtgttcatgtcggcctggttcctgctggtctacgcaccgatcgcccatatggtctggagcggcaacggcgcgctgatgtgggattggggcgtgctcgacttcgccggcggcaccgtggtgcacatcaacgccggtgtcgccggcctggtcgcctgcctggtgctgggcaagcgcaagggctaccccggagtcgccatgaccccgcacaacctcggctacaccctggtcggcgcggccatgctctgggtcggctggttcggcttcaacgccggctcgcgatcgcgcaacggcaccgccggcatggccatgctggtgacccagatcgccaccgccgccgccgcgctggcctggatccccgccgagtggctgacccacggcaagccgagccctgggcatcgcctccggcgtggtcgcgcctggtggcatcaccccggccgcggtaccgtcggcccgatgggcgccctggtgatcggcctggcttccggctcgatctgtttctactgcgccactgccgtgaagcgccgcttcggctatgacgattctctcgacgccttcggcgtgcacggtgtcggcggcatcgtcggcgcggtgctgaccggcctgttcgcggctccggccctgggcggtttcggcgaaatcgacagtatcgccagccaactgtggatccagatcaagggcgtgctcttcaccgtgatctacaccggcgtcgccaccttcgtgatcctcaaggcgatcgagcgggtgataggcctgcgcatcagcgaagaggaagaaaccatgggtctcgacctctccctgcacaacgagcgcggttacaacctctgagtttggggagggcggctagccggccgccgttcccgccgtggcctcgctcccatccaggggagcagccgtcaaaagggcgcctcgggcgctttgcttttttccgtgccgcgctagaattc

SEQ ID NO: 1963 - protein, 436 aa, Azotobacter vinelandii
MTLRKGAGSCCPFFPLPAPSWPAAQEATLDSGDTAWMLTATALVLFMTIPGLALFYGGMVRSKNLLSVMMQCFAITGLISVLWVLFGYSLAFDTAGMEEGVLNFSSFVGGLDKAFLSGLTTDSLVGTFPESVFITFQMTFAIITPALITGAFAERMKFSSMLVFMSAWFLLVYAPIAHMVWSGNGALMWDWGVLDFAGGTVVHINAGVAGLVACLVLGKRKGYPGVAMTPHNLGYTLVGAAMLWVGWFGFNAGSRSRNGTAGMAMLVTQIATAAAALAWIPAEWLTHGKPSPGHRLRRGRAWWHHPGRGTVGPMGALVIGLASGSICFYCATAVKRRFGYDDSLDAFGVHGVGGIVGAVLTGLFAAPALGGFGEIDSIASQLWIQIKGVLFTVIYTGVATFVILKAIERVIGLRISEEEETMGLDLSLHNERGYNL

SEQ ID NO: 1964 - DNA, 1317 bp, Azospirillum brasilense
  CDS (1)..(1317): transl_table=11
atgagccgtctcttcaccctcgccgcgccgacgatggcggcgattctgggcttggccggtctgcctgccgccgccctcgcccaggaaagcgccgccgccgcggccgaacccaccctgagcagcggcgacacggcttggatgctggtcgccacggcgctggttctgttcatgaccatcccgggtctggctctgttctacggcggcatggtccgcaagatgaacgtgctgtcggtcgtgatgcagagctttgcgatctgctgcctggtcagcatcctgtggttcttcgccggttacagcatcgcctttaccgaaggcaccccgtatttcggcagcctgtccaagttcatgctggccggcatcaccaaggacagcctgacgggcgtcattcccgagacgatcttcgtcgtctttcagatgaccttcgccatcatcaccccggccctgatcaccggcgccttcgccgaccgcatgaagttctcctcgatgctggtcttcacgggcctgtggtcgctgatcgtctacgcgccgatcacccactgggtctggggtccgggcggctatctggcgggtgacggcgtgctcgactacgccggcggcaccgtggtgcacatcaacgcgggcgtggccggtctggtcgccgccatcgtgctgggcaagcgcaagggctatccgaacgagaacttcgctccgcacaacctggtgctcagcctgatcggcgcctcgatgctgtgggtcggctggttcggcttcaacgcgggttccgccgtggccgccgacggccgtgcgggcatggccatgctggtcacgcagatcgccgccgccaccgccgccatgtcctggctgctggtcgagtgggccaccaagggcaagggttcggttctcggcatcatctccggcgccatcgccggtctggtcgccatcaccccggcctcgggcttcgtcggtccgaccggcgccctggtcatcggtctggccgccggcgtgatctgctactggggcgccaccggcctgaagcgcgccctcggctatgacgactcgctggacgccttcggggtgcacggcgtgggcggcatcgtcggcgccatcctgaccggcgtcttcgcccaggaagccatcggcggcaccgccggcgccctggaaggcaacgtcggccagatctggacgcaggtctacggcattctcgccaccatcgtctactcggcggtcggctccttcatcatcctgaaggtcatcgacgtggtgatgggcctgcgcgtcgacgaggacgtcgagcgcgacggcctggacctcgccctgcacggcgagaccatccactaa

SEQ ID NO: 1965 - protein, 438 aa, Azospirillum brasilense
MSRLFTLAAPTMAAILGLAGLPAAALAQESAAAAAEPTLSSGDTAWMLVATALVLFMTIPGLALFYGGMVRKMNVLSVVMQSFAICCLVSILWFFAGYSIAFTEGTPYFGSLSKFMLAGITKDSLTGVIPETIFVVFQMTFAIITPALITGAFADRMKFSSMLVFTGLWSLIVYAPITHWVWGPGGYLAGDGVLDYAGGTVVHINAGVAGLVAAIVLGKRKGYPNENFAPHNLVLSLIGASMLWVGWFGFNAGSAVAADGRAGMAMLVTQIAAATAAMSWLLVEWATKGKGSVLGIISGAIAGLVAITPASGFVGPTGALVIGLAAGVICYWGATGLKRALGYDDSLDAFGVHGVGGIVGAILTGVFAQEAIGGTAGALEGNVGQIWTQVYGILATIVYSAVGSFIILKVIDVVMGLRVDEDVERDGLDLALHGETIH

SEQ ID NO: 1966 - DNA, 1365 bp, Ostreococcus tauri
  CDS (1)..(1365)
atgtcgactgcggtggaggaaaggtcgacggcgagtaagctgcgagcgccgctcgcggcgggcgcgctcggattggccgcggtgacgctcggtggaccggcgagcgcggcggcggccgcggtgccggcgatcgtcgccgcggacacgtgctggattttgatttccagcgcattggtgctcttcatgaccattccgggtctcgcggcgttctacgccggtctggtgcgacgcacgaacacgctcagcgttctgattcagtgcttcgcactcactgcgcacatgtctgcgctgtggttcctgtgtggatattccctgtccttcagcacggtcgggatgaaggagggcgttgttggtttggcgtccttcatcggcggtctagacaaagtggcgctcgccggggtatccatgtcctccgtcgcgggtacgatcccggaagcgctctgggttttgtatcaaatgacgtttgcgattatcacgccggcactcatgatcggctcgctcgttgagcgcatgaagtttaactctgtgatgtggttctccacgctttggatgttcgccgtttacttcccggcgtgccatatggtttggggcggcgccggcggatatttcgcggacatgggcgtccttgacttcgccggtggcattgtcgtacacattaccgccggtatcggtgcgctcgttgccgccatgtaccttggaccgcgcaaggaggcgaagatccatcaaggcaacttggtgctcacattcctcggtaccgccatgttgtgggtgggctggttcggtttcaacggtggttccgccggtgcggcgtctgccggtgccgctttcgcttgcctcgcgacgcagctctctgcgtccgttgccgccatcgcttggacggctctcgacgtgattgagaacggcaaggtgtccgtcctcggtacgtgcacggcgtccattgccggtcttgcggccatcaccccggccgccggtttcatcggccctgtcggtgcttgcttgatgggtcttgcctctgctatcgtgtgccgattcttctccaccaatgtcaaggagtacttcggctatgatgatgcccttgatgtcttcggagttcacggtatcggcggctttttgggcaccgtcatgctcggtatcctctgccacccgttcttcggcggattcaacgacgttccgatgatgaagcaaaccgccgtgcaaatgttcgccgccgttgctactgcagtgtacaccgctggcgcctcttgggcatgcctcaaggcgacggacattatcacgaacggcatccgcgtcccggctgaagcggaagagatgggcctcgacgtgtattctcacggcgagaccgcgtactctccgatgccgcgataa

SEQ ID NO: 1967 - protein, 454 aa, Ostreococcus tauri
MSTAVEERSTASKLRAPLAAGALGLAAVTLGGPASAAAAAVPAIVAADTCWILISSALVLFMTIPGLAAFYAGLVRRTNTLSVLIQCFALTAHMSALWFLCGYSLSFSTVGMKEGVVGLASFIGGLDKVALAGVSMSSVAGTIPEALWVLYQMTFAIITPALMIGSLVERMKFNSVMWFSTLWMFAVYFPACHMVWGGAGGYFADMGVLDFAGGIVVHITAGIGALVAAMYLGPRKEAKIHQGNLVLTFLGTAMLWVGWFGFNGGSAGAASAGAAFACLATQLSASVAAIAWTALDVIENGKVSVLGTCTASIAGLAAITPAAGFIGPVGACLMGLASAIVCRFFSTNVKEYFGYDDALDVFGVHGIGGFLGTVMLGILCHPFFGGFNDVPMMKQTAVQMFAAVATAVYTAGASWACLKATDIITNGIRVPAEAEEMGLDVYSHGETAYSPMPR

SEQ ID NO: 1968 - DNA, 1437 bp, Aspergillus oryzae
  CDS (1)..(1437)
atggcagaataccctgtggcctacaatgggtcggcgaccgggaccggaggtgactctctgacggaagatctcaacatctactacagctctggtgacatcgcatgggttattgtttcgacggctcttgtcttgttgatgattccaggagtcggattcttctattccggtcttgcccgtcggaagtcggcactttcgctactatggctctcgataatgtctgtcggaatagtctccttccagtggttcttctgggggtactctctcgctttctctcataccgccggaaaatatattggtgacttgagcaactttgggttcaaaggggtcctgggtgcgccatctgttggcagcgccaaggtcccagatctcttgtttgctgtcttccaaggcatgttcgcctgtattacagtggcactcgcggttggtgctgtcgcagagcgtggccgcatgcttccctgcatggtttttagctttgtctggtccaccatcatctacgaccctatcgcatgctggacctggaactcgagcggttgggtggcaaaccttggtggtcttgattatgcgggtggtacacccgttcacatcgcctctggttgtaccgcattggcatactcgctgatgcttggaaagcgtcgtggacacggcacccacgagctcaactatcgcccgcacaacgtaacacatgtggtcatcggtacggtattcctttgggttggatggttcggattcaatgccggctccgccttgagcgccaatcttcgtgccgtcatggcagccgtggtcaccaacctcgccgccgccgtggggggagttacctggtgtatcctggactaccggcttgagaggaagtggtctactgttggtttctgctccggtgtgattgccggcttggtggccatcacccccgcatcgggctttgtcactccctgggcttcattcattttcggtgttgtgggagctgtcgcttgcaactatgccaccaaactcaagtacgtgatcaaggttgacgacgcgcttgatatcttcgctgtccacggtattggaggtctggtgggcaaccttttgactggacttttcgctgctgattacatcgcccaccttgatggctctaccacaatcgatggcggctggatcaaccacaactacatccagctagcttatcagctcgccgactccgtcaccggaatggcatactctttcttcggaagctgcattatcctcttcatcatcaacctgattcctggcctcagcttgcgtgccccggaagaagacgagatcatgggcattgacgacgccgaaattggcgagtttgcttatgactacgtcgagattacccgcgacgtgatcagtgccgccaacagtgagagcggcgagaatgcttccaagcgtagcttgactccaaccggcaacgaaacgaccatagaggccaaggcttag

SEQ ID NO: 1969 - protein, 478 aa, Aspergillus oryzae
MAEYPVAYNGSATGTGGDSLTEDLNIYYSSGDIAWVIVSTALVLLMIPGVGFFYSGLARRKSALSLLWLSIMSVGIVSFQWFFWGYSLAFSHTAGKYIGDLSNFGFKGVLGAPSVGSAKVPDLLFAVFQGMFACITVALAVGAVAERGRMLPCMVFSFVWSTIIYDPIACWTWNSSGWVANLGGLDYAGGTPVHIASGCTALAYSLMLGKRRGHGTHELNYRPHNVTHVVIGTVFLWVGWFGFNAGSALSANLRAVMAAVVTNLAAAVGGVTWCILDYRLERKWSTVGFCSGVIAGLVAITPASGFVTPWASFIFGVVGAVACNYATKLKYVIKVDDALDIFAVHGIGGLVGNLLTGLFAADYIAHLDGSTTIDGGWINHNYIQLAYQLADSVTGMAYSFFGSCIILFIINLIPGLSLRAPEEDEIMGIDDAEIGEFAYDYVEITRDVISAANSESGENASKRSLTPTGNETTIEAKA

SEQ ID NO: 1970 - DNA, 1422 bp, Aspergillus oryzae
  CDS (1)..(1422)
atggtcgcgcagccggtgtacaatgcttctatgccggaagggggcgatccaacaagagtcgacgtcaatgcacaatatgcgggattggagtacaattatatctatatcaccgcctgcacctttattgtcttcttaatcctgcctgggatcgccttcctctacagtggattaacacggcggaagtccgcattggccctcctcttccaaggctttatgatccttgcggttgtcacattccaatggttgttctgggggtattctctagcgtattccagagatggaggaccatttatcggcacgctgcagaattttggactgatgaacgtcatggtggcaccctctcccggttccgccgtgcttccggagatcgtcttctgcctattccagcttcttttctgcgcttgcacggtaatgatccttgcgggcggcgcctttgaacgaggcaacattttgccgtctctgatcttcagcttcttctgggccacgatcgtctattgccccttagccaggtggacatggagcagcaacggttggctttacaaattcggggctatagacttcgctggtggtggtcccgtccatatagcttcgggctgtgccgctttagcatacgcgctggttctcgggaagcggttacaccatggagaagcctcgccgcgcaaaccccacaacacaacgttggtatttctcggaacagttctcatctggacaggatggcttgggttcaacggtggatcgagtcttaatgccagtatgcgtgctatggtggccgtcttcaacaccaatacggcgggatgcacggggatcctggggtgggtcctagtcgatatgatcaaacacaggggtagattctctgtggttggggcctgcgaaggcgccattgccggtctcgtagggatcacaccagctgccggctgtgtttctctttggctggcggcttgtattgggttcattaccggcatcgtctgttcatcactccagaatattaatgattggctcagggttgacgagggcatggatgtcttcaagcttcacggagttggtggcatagtaggcgccttcttgacggggcttttcgcaagtgaatccatttcagccctggatggggccagtcttactggcggcgctattgatggcaacggaattcaggtcggcagacagcttgctgagatctgtgctatcgccggatactcctttactgtgtcctacatcttgctcttcattctcaagtacatccctgggatgcgtctacgggtggatgaggagtcggagatgatgggtctcgaccgggcacagttctttgacgaacagatcggtgactggtcaatagcacatggcacgagcagtccgatgttgatgggggtgtccaaagagccatctgcgtcaaaagatgagcaaacagtgaaaacaccaggagtctag

SEQ ID NO: 1971 - protein, 473 aa, Aspergillus oryzae
MVAQPVYNASMPEGGDPTRVDVNAQYAGLEYNYIYITACTFIVFLILPGIAFLYSGLTRRKSALALLFQGFMILAVVTFQWLFWGYSLAYSRDGGPFIGTLQNFGLMNVMVAPSPGSAVLPEIVFCLFQLLFCACTVMILAGGAFERGNILPSLIFSFFWATIVYCPLARWTWSSNGWLYKFGAIDFAGGGPVHIASGCAALAYALVLGKRLHHGEASPRKPHNTTLVFLGTVLIWTGWLGFNGGSSLNASMRAMVAVFNTNTAGCTGILGWVLVDMIKHRGRFSVVGACEGAIAGLVGITPAAGCVSLWLAACIGFITGIVCSSLQNINDWLRVDEGMDVFKLHGVGGIVGAFLTGLFASESISALDGASLTGGAIDGNGIQVGRQLAEICAIAGYSFTVSYILLFILKYIPGMRLRVDEESEMMGLDRAQFFDEQIGDWSIAHGTSSPMLMGVSKEPSASKDEQTVKTPGV

SEQ ID NO: 1972 - DNA, 1350 bp, Aspergillus oryzae
  CDS (1)..(1350)
atgtctgtccaggctgcctgggaggcctgctcgaaaacagacactctcttcattttagtatgtagtgttttctgttggctgattatcccggcagtcggtctcgcctactcgggctattcgacgcgttacaacagcctggcctcattctacccaggcctcctagcagtagccgtctgttctattcaatggtggatgctcggatactcactagcctacggtgagggcaacagtgtattcggcggtttcagtaaaatcttccatattggcgtccttgctgaaccggtcggatcgatccccgagatcctcttctccgaattccaactaatcttctgcgccacggtctgcgcaatcgccatcggaggagcgtgcgagcgcggcagactgcttccactaatcccgttcatcttcctgtggtgcaccttcatctatgccccattagcccacatggtctggtcagagaatggcttcctggccaatctcggcgccctcgactttgccggcggcacaccagtgcacatctgtagcggcgcaacagcaacagccatgagcctctacctctcctacccactcttccgctccaaacgatccccaatccgcaccccccaacacctcatcctccacaaaccccacaacaccctctgccaactcctcgccctaatcatcatctggaacgcctggctcgccttcgacgccggcaccaccctcgccctcaacttcaaatccgtcatggccgcctgcgtcaccaacctctgcgccgcctccggcgccctcacctgggccagcctcacatactacgaaaccggtaaatggagcctagacagcaccttccttggcgcgatcgcaggactcgtcctcatcacgcccagcgcgggattcatcgacatgaccaccgcggtcgggttcggggttctcggcgcctctctcggtcgccaggcgctgcggattaagttcacgaagcgggctgcgctactgcgatgggtggataacggggatacatttgctacgcattgtctcgggggatttctggggactattgtgacgggtctgtttgctagacgggaggttgcggcgtatgatgggtcgacgattattaaggggggtgtggtgtttgatgggaattggggacagctttggattcagattgtcgaggctgttattgggtttgtgtggagttttggggggagctatgtgctgtatgctttggtggactgtgttcctgggtttgaggttttagggacggatgaggatattattgccgggatggatgcgtcgcagatgggggagtcattatatgctgcgcagtgggagggagaggaggattatcatccttttgagggtgttcggctttag

SEQ ID NO: 1973 - protein, 449 aa, Aspergillus oryzae
MSVQAAWEACSKTDTLFILVCSVFCWLIIPAVGLAYSGYSTRYNSLASFYPGLLAVAVCSIQWWMLGYSLAYGEGNSVFGGFSKIFHIGVLAEPVGSIPEILFSEFQLIFCATVCAIAIGGACERGRLLPLIPFIFLWCTFIYAPLAHMVWSENGFLANLGALDFAGGTPVHICSGATATAMSLYLSYPLFRSKRSPIRTPQHLILHKPHNTLCQLLALIIIWNAWLAFDAGTTLALNFKSVMAACVTNLCAASGALTWASLTYYETGKWSLDSTFLGAIAGLVLITPSAGFIDMTTAVGFGVLGASLGRQALRIKFTKRAALLRWVDNGDTFATHCLGGFLGTIVTGLFARREVAAYDGSTIIKGGVVFDGNWGQLWIQIVEAVIGFVWSFGGSYVLYALVDCVPGFEVLGTDEDIIAGMDASQMGESLYAAQWEGEEDYHPFEGVRL

SEQ ID NO: 1974 - DNA, 1686 bp, Aspergillus oryzae
  CDS (1)..(1686)
atgtcggacatcaaggcgcccttcgtccctgactatgcgtcttacaactggactggagccccatctaactatgactcgctggcgaccaatgagctgggtggtgactccagggtggagaacgtgaacaagtggtttcaatccggtgatcaagcgtatatcatcgtggcttccgccatggtcatggtcatgattcccggtctcggtttcctttattccggtcttgctcgccgtaaatcagccctgagtatgatttgggcctgtatggcttctttctctgtcgtcacgttccaatggtatttctggggctattcgcttgcattctcgcccacggccaccaacggatacatcggaaaccttcgtaacttcggcctgatgaagaccttggccgatccaagtcctggctctgttcttgtgcccaatctcctctatgccttctatcagatgcaattctgtggtgtcacggctgcgattatcatgggagctgttgctgaacgtggacgcttgctccccgccatggtgtttgtgttcgtctgggctacgatcgtatactgtcccttggcttgttgggtgtggaatgtgaatggctgggcaatgaactacggtgtattggattatgcgggtggtggtccggtcgagattggctccggtttttccgcactcgcctattcaatggttcttggtcgtcgccaggagcgcatgatgttgaacttccgccctcacaacgtctctctcattctccttggaaccgttttcttgtggtttggatggcttggcttcaacggtggctcagcctttggagccaatcttcgtgccaccatggcgtgctggaataccaacctgactgcggcttttggggccattagctgggtccttctcgattggcgcttagcgaggaaatggtccatggttggttggtgctctggcaccatctcgggcctggttgcagctaccccggcatcaggattcattaccccttgggctagtgtgattctgggtatagtcactggtattgtttgcaactactccaccaaggtgaaatactggattcgtatcgacgattccatggatgtgttagctgagcacggtatcgcgggtattgtcggtcttatcttcaacgcgcttttcgccgacgacgcgatcgtaggactggacggagtcaacactggtagcaaaatgggtggatggctgatccacaactacaagcaactctacattcaaatcgccttcattgtcgcctcagccgcctatgctttcgttgtgtctgccatcattgcctacgccatcaatgcaatccccggcctgaagctgcgcgcttctgaggaagccgaattgctcggtatggacgatgatcagcttggcgagttcgcctacgactacgtcgaagtccgtcgtgactatcttgcatggacccctcagaaacacgaccagctcgaagacggccaccatatccctgccgccgcacggtacggcatcggggagcacagcgaaatgatgcttgacggccatacccccatcggtattgacagtcgcggttgcagcgaaggcgactccggcatccaggaaatcaagatgtccccggcacctgcgccggcaatggcacccgccccacgtcaagttgccgaacaacatcccgctcacgagggatcaataccacccagtgtcgaggaggatgagaaaacacagtaa

SEQ ID NO: 1975 - protein, 561 aa, Aspergillus oryzae
MSDIKAPFVPDYASYNWTGAPSNYDSLATNELGGDSRVENVNKWFQSGDQAYIIVASAMVMVMIPGLGFLYSGLARRKSALSMIWACMASFSVVTFQWYFWGYSLAFSPTATNGYIGNLRNFGLMKTLADPSPGSVLVPNLLYAFYQMQFCGVTAAIIMGAVAERGRLLPAMVFVFVWATIVYCPLACWVWNVNGWAMNYGVLDYAGGGPVEIGSGFSALAYSMVLGRRQERMMLNFRPHNVSLILLGTVFLWFGWLGFNGGSAFGANLRATMACWNTNLTAAFGAISWVLLDWRLARKWSMVGWCSGTISGLVAATPASGFITPWASVILGIVTGIVCNYSTKVKYWIRIDDSMDVLAEHGIAGIVGLIFNALFADDAIVGLDGVNTGSKMGGWLIHNYKQLYIQIAFIVASAAYAFVVSAIIAYAINAIPGLKLRASEEAELLGMDDDQLGEFAYDYVEVRRDYLAWTPQKHDQLEDGHHIPAAARYGIGEHSEMMLDGHTPIGIDSRGCSEGDSGIQEIKMSPAPAPAMAPAPRQVAEQHPAHEGSIPPSVEEDEKTQ

SEQ ID NO: 1976 - DNA, 1533 bp, Herbaspirillum seropedicae
  CDS (1)..(1533): transl_table=11
atgagcatgaagaaaatgttttccggcgcgctcgccattggcgcgctgctgtttgcagtcagttttactgctccggcccaggcgcaggatgcgcccaagcctgaagctgcagcggctgccgcagcggccccggctgctgctcccgctgcacccaaggcggaagctgccgctcctgcggccgctgccccggccgcaccggctgccgctgccgccgctcccgcaccggtccccaacaagggcgataccgcctggatgctggtctgcaccgccttcgtcatcctcatgaccttgccgggcctgggcctgttctacggcggcctggtgcgcagcaagaacatgctgtcggtgctgatgcagtgcttcatgatcttctcgctgatctacatcctgtggttcgtctacggctacagcatcgcgttcaccgagggcaatgccttcttcggtggcttcgatcgcctgttcctgcacggtctgacgggtgactccaacaccggcaccttcagcaagggcgtggtcattccggagctggtcttcgtcgccttccagggtgcgttcgcggccatcactgtggcgctgatcattggcgccttcgccgaacgcgtgaagttctcggccgtgatcctgttctccatcctgtggttcaccttctcctacctgccgatggcccacatggtctggttctggccgggtccggacgccttcaccgacgctgccgctggtgaaaaggccaccgccatctcgggctggctgttccagaagggcgcgctggactacgcaggcggcacggtggtgcacatcaacgccgctatcgccggcctggtcggttcctatgtgatcggcaagcgtatcggtttcggcaaggaagccttcaagccgcatagcctgaccctgaccatggtcggcgcctcgctgctgtggttcggctggttcggcttcaacgccggctcgggtctggaagccaacggcactgctgccctggccttcgtcaacaccatcctggcaacggcggctgctgtgctgtcctggagcttcggcgaatggatcggcaagggcaagccctcgatgctgggcgccgcttccggcgcggtggctggtctggtggcgatcaccccggcggctggtttcgtgggcgtcatcggcgccgtggtcatgggcctgatcgctggcctgctgtgcctgtggggcgtgagcggcctgaagaagatcctgggttccgacgatgcgctggacgtgttcggcgtgcacggcgtgggcggcatcctgggcgccatcctgaccggcgtgttcgcagcccccagcctgggcggcaccggcatctacgactacgtggccaacgctgttgcgcctgactactccatcggcggccaggtctggatccagttccagggcgtgctgaccaccgtggtcctgtcgggtgtggtctccttcatcgcctacaagatcgttgacgtcgtcatcggcctgcgtgtgaccgaggaagaagaacgcgaaggcctggatatctccagccacggcgaatcggcttaccactaa

SEQ ID NO: 1977 - protein, 510 aa, Herbaspirillum seropedicae
MSMKKMFSGALAIGALLFAVSFTAPAQAQDAPKPEAAAAAAAAPAAAPAAPKAEAAAPAAAAPAAPAAAAAAPAPVPNKGDTAWMLVCTAFVILMTLPGLGLFYGGLVRSKNMLSVLMQCFMIFSLIYILWFVYGYSIAFTEGNAFFGGFDRLFLHGLTGDSNTGTFSKGVVIPELVFVAFQGAFAAITVALIIGAFAERVKFSAVILFSILWFTFSYLPMAHMVWFWPGPDAFTDAAAGEKATAISGWLFQKGALDYAGGTVVHINAAIAGLVGSYVIGKRIGFGKEAFKPHSLTLTMVGASLLWFGWFGFNAGSGLEANGTAALAFVNTILATAAAVLSWSFGEWIGKGKPSMLGAASGAVAGLVAITPAAGFVGVIGAVVMGLIAGLLCLWGVSGLKKILGSDDALDVFGVHGVGGILGAILTGVFAAPSLGGTGIYDYVANAVAPDYSIGGQVWIQFQGVLTTVVLSGVVSFIAYKIVDVVIGLRVTEEEEREGLDISSHGESAYH

SEQ ID NO: 1978 - DNA, 1852 bp, Triticum aestivum
  CDS (45)..(1529)
cgctgaacgccaaccactttcccaagtaggggggcgccgcggagatgtcggcgacgtgcgcggcggacctggggccgctgctgggggcggcggcggcgaacgccacggactacctgtgcaacaggttcgccgacaccacgtccgcggtggactccacctacctgctcttctcggcctacctcgtcttcgccatgcagctcggcttcgccatgctctgcgccggctccgtccgggccaagaacaccatgaacatcatgctcaccaacgtgctcgacgccgccgccggcgcgctcttctactacctcttcggcttcgccttcgccttcgggacgccgtcgaacggcttcatcgggaagcacttcttcggcctcaaggacatgccgcagaccggcttcgactacagcttcttcctcttccagtgggccttcgccgtcgccgccgccggcatcacctccggctccatcgccgagaggacgcagttcgtcgcgtatctcatctactcggccttccttacgggattcgtctacccggtcgtgtcccactggatctggtccgtcgacggctgggcctccgcggctcgcacgtccggcccgctgctcttcaagtccggcgtgatcgacttcgccggctccggcgtcgtgcacatggtcggcggcatcgccggcttctggggcgcgctcatcgagggcccccgcatcggccggttcgaccacgccggccgctcggtggcgctcaagggccacagcgcgtcgctcgtcgtgctggggaccttcctgctctggttcggctggtacgggttcaacccggggtccttcgtcaccatcctcaagtcgtacggcccgcccgggagcatcaacgggcagtggtcgggcgtgggccgcaccgccgtgacgacgacgctggcgggcagcgtggcggcgctcacgacgctgttcgggaagcggctccagacggggcactggaacgtggtggacgtctgcaacggcctgctcggcgggttcgcggccatcaccgccgggtgcagcgtggtcgacccgtgggccgccgtcatctgcggcttcgtctccgcctgggtgctcatcgggctcaacgcgctcgccggccgcctcaagtacgacgacccgctggaggcggcgcagctgcacggcggctgcggcgcgtgggggatcatcttcacggcgctgttcgccaagaagcagtacgtggaggagatctacggcgccggcaggccgtacgggctgttcctgggcggcggcgggcggctgctggcggcgcacatcgtgcagatcctcgccatcgccggcttcgtgagctgcaccatgggcccgctcttcttggcgctcaagaagctgggcctgctccgcatctcggccgaggacgagatggccggcatggacctgacccggcacggtgggttcgcctacgtctaccacgacgacgacgagcacgacaagtcggtcggcggcttcatgctcaggtcggcgcagacccgcgtcgagccggcggcggcggcgaacagccaggtctagccaatcaagccggactacgtaacaagaaatccagtggaaatcgcctttctgttctcgcgcgtcatatcacatatgtgatccgatcatgggatcaatatttccggtgctgtttgggccaatactttggcgctcttgtgttcgttcacaagattgtaaaattattacactaggacgaggttattttttttaccttttttgtgtacatgcgtgcgtttagaggagatgtgtggtgtgtggatggaatctgcagggctggggttttttctttcttggtgatatcttgtcatttttgtggtggaattctgtgatcataagggtgtgga

SEQ ID NO: 1979 - protein, 494 aa, Triticum aestivum
MSATCAADLGPLLGAAAANATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAVAAAGITSGSIAERTQFVAYLIYSAFLTGFVYPVVSHWIWSVDGWASAARTSGPLLFKSGVIDFAGSGVVHMVGGIAGFWGALIEGPRIGRFDHAGRSVALKGHSASLVVLGTFLLWFGWYGFNPGSFVTILKSYGPPGSINGQWSGVGRTAVTTTLAGSVAALTTLFGKRLQTGHWNVVDVCNGLLGGFAAITAGCSVVDPWAAVICGFVSAWVLIGLNALAGRLKYDDPLEAAQLHGGCGAWGIIFTALFAKKQYVEEIYGAGRPYGLFLGGGGRLLAAHIVQILAIAGFVSCTMGPLFLALKKLGLLRISAEDEMAGMDLTRHGGFAYVYHDDDEHDKSVGGFMLRSAQTRVEPAAAANSQV

SEQ ID NO: 1980 - DNA, 1503 bp, Pichia angusta
  CDS (1)..(1503)
atgcctagacaatggacccgcttttttgaatataaatatctcgagatgcgcagattttctcgtctaatcaatactaattcattttttgcaacgatgaaagactcaatgactgaggacctcgctgcagactatgacaaggccgacatggtctgggtcatggtcagtggtgtgctggtctggattatgattcctggtgttggacttctgtactctgggctatctagaaagaaacatgctctttctctgttgtgggcatcgctcatggctatctgtttgatttccttccaatggttcttctgggggtactcgcttactttcggtaccaactcatctgtgtttttaggatcattggacaatttttgcctgatgaaagttcttggagattctaacgcactgtctactgtgccggacattgttttctgctttttccagggaatgtttgccatgatcaccggatgcattatgctcggtggtgcgtgcgagagagctagactgggcccaatgatggtgttcttgtttctctggatgactgtcgtttactgcccttgtgccatgtggacatggaacgctaacggctggcttgcaaccctcggtgcttacgactttgccggtggaggaccagtccaccaggcttctggtttcggagccttggcctacgctttgatctgtggtaagagacacgacccggttgctggttccaacttgcctaagtacagacctcattctgtcacaagtgtcgttctgggtactgttttcctgtggttcggatggtttggattcaacggaggatcttccggagatgcctccatcagaggattttacgcctgtgttaacaccaaccttgctgctgcttgcggtggccttgcttggatgttcctcgactacttcagatgcggccgtaaatggaccaccgtcggaatgtgctctggtgctgttgctggtcttgttggtatcactccggcagctggtttcgtgcctgtttactttgccgttccaatcggtgctctcactgcaattgcttgcaactactcggttgacatcaagaacatgattggaattgacgacggtctggatgtttggtgtcttcacggtgttggtggatttaccggttctgtgctgaccggtctgtttgctgcagactacatcattgctactgactatggtgtctctggtgagggaggatggctcaaccaccactacaagcagctcggctaccagctggcagccagtgtctccatcgacgcatggtcttttgttgtcacttccatcctcctgctggttcttaacagaattccattcctcaagatcagattgagcgaggaggaagaggagctgggtactgatgctgctcaaatcggcgaatttacttaccaggagtccagggtctatatcccagagccagtgagatctgtcaaaagtattccaggtaccaaggccaccaagtccaacgaactcgacgctgacgccgttccgcttccaaaagacgaaaaagttgacgtttaa

SEQ ID NO: 1981 - protein, 500 aa, Pichia angusta
MPRQWTRFFEYKYLEMRRFSRLINTNSFFATMKDSMTEDLAADYDKADMVWVMVSGVLVWIMIPGVGLLYSGLSRKKHALSLLWASLMAICLISFQWFFWGYSLTFGTNSSVFLGSLDNFCLMKVLGDSNALSTVPDIVFCFFQGMFAMITGCIMLGGACERARLGPMMVFLFLWMTVVYCPCAMWTWNANGWLATLGAYDFAGGGPVHQASGFGALAYALICGKRHDPVAGSNLPKYRPHSVTSVVLGTVFLWFGWFGFNGGSSGDASIRGFYACVNTNLAAACGGLAWMFLDYFRCGRKWTTVGMCSGAVAGLVGITPAAGFVPVYFAVPIGALTAIACNYSVDIKNMIGIDDGLDVWCLHGVGGFTGSVLTGLFAADYIIATDYGVSGEGGWLNHHYKQLGYQLAASVSIDAWSFVVTSILLLVLNRIPFLKIRLSEEEEELGTDAAQIGEFTYQESRVYIPEPVRSVKSIPGTKATKSNELDADAVPLPKDEKVDV

SEQ ID NO: 1982 - DNA, 1470 bp, Saccharomyces cerevisiae
  CDS (1)..(1470)
atggctcggggtgacggccctctatggacagagacatatgatagttccacagtcgcttttatgattttaggtgccgccctggttttcttcatggtaccggggctgggctttctttattccggtttagcaagaagaaaatctgctctggctttgatttgggtagtgataatggctaccttagtaggtatactgcaatggtatttttggggctattctttagcattctctaagactgcgacgaacaacaaatttatcggcaacttggattcatttgggtttagaaacgtctatggcaaaatttcggatgattccacgtatcctgaactgatttatgccattttccaaatgatgttcatgtgtgtcgcattgagtattatagctggtgccactgcggaaagaggtaagctttttccacatatggtttttctttttgtttttgcgactttggtttactgtcccatcacttattggatttgggccccaggtggttgggcctaccaatggggggtattagactgggctggcggtgggaatattgaaatcctaagtgctgtggctggtttcgtttattcttattttctaggaagaagaaaagaaaacctcctgatcaactttagaccacataatgtttccatggtgactttgggtacttctatactttggtttggttggttgcttttcaatgctgcaagctcactgtcaccaaatatgaggtccgtatatgcgttcatgaacacttgtctcagcgccaccacgggtggaatgacgtggtgtttattagattatcgatctgaaaaaaaatggtccactgttgggttatgctccggcattatctgtggtttagttgctgccacgcctagctcgggttgtattactctatatggctctttgatccaaggtataatagcgggtgttgtttgtaattttgcaacaaaaataaagtattatttaaaagtggatgattccttagatctattagctgaacacggtatcgccggtgtggtgggattgatttttaacgctctatttgcagctgattgggttattggaatggacggcacaacaaagcataagggtggttggttgacgcataactggaaacaaatgtatattcaaattgcctatatcggtgcctctgccggctattgtgctgtggtcacggccatcatttgcttcgtattaggtaaaattccgggtgtccatctaagagtcactgaggaagccgaagcattggggttggatgaagatcaaataggcgaattcgcttacgattacgtggaggttaggagagattattaccagtggggtgtagatacagatgcacttcatactacatgcaatggcgctaattctgcgtctgagacaaatcctactgaggacagccaaaactcctcattgtcatcagctacagtaagcggccaaaacgaaaaaagtaataatcctaaattgcatcacgcaaaagaagcatga

SEQ ID NO: 1983 - protein, 489 aa, Saccharomyces cerevisiae
MARGDGPLWTETYDSSTVAFMILGAALVFFMVPGLGFLYSGLARRKSALALIWVVIMATLVGILQWYFWGYSLAFSKTATNNKFIGNLDSFGFRNVYGKISDDSTYPELIYAIFQMMFMCVALSIIAGATAERGKLFPHMVFLFVFATLVYCPITYWIWAPGGWAYQWGVLDWAGGGNIEILSAVAGFVYSYFLGRRKENLLINFRPHNVSMVTLGTSILWFGWLLFNAASSLSPNMRSVYAFMNTCLSATTGGMTWCLLDYRSEKKWSTVGLCSGIICGLVAATPSSGCITLYGSLIQGIIAGVVCNFATKIKYYLKVDDSLDLLAEHGIAGVVGLIFNALFAADWVIGMDGTTKHKGGWLTHNWKQMYIQIAYIGASAGYCAVVTAIICFVLGKIPGVHLRVTEEAEALGLDEDQIGEFAYDYVEVRRDYYQWGVDTDALHTTCNGANSASETNPTEDSQNSSLSSATVSGQNEKSNNPKLHHAKEA

SEQ ID NO: 1984 - DNA, 1702 bp, Camellia sinensis
  CDS (63)..(1604)
ttccaagcctctctctctttcccatttttctgacactaagcaaaacactcgtataagttgtcatggcttccactttgggctgctcagccacagacctcgtcccccacctcaccggcgtcaacaacgccaccgcggtcgcagacttcatctgcggccgcttagacgccgtctccaccaagctctccgacaccacctacgccgtcgacaccacctacctcctcttctcagcctacctagtcttcgccatgcagctcggcttcgccatgctctgcgccggctccgtccgcgccaaaaacaccatgaacatcatgctcaccaacgtcctcgacgctgccgccggcggcctctcctactacctcttcggcttcgctttcgctttcggctccggctcccgctccaacgccttcatcggccactactccttcgccctcactggcgtcccatcagctacccacgactacagcttctttctctaccaatgggctttcgctatagccgccgccggaatcactagcggttccatagccgagcgaactcagttcgtggcttacctcatctactcctccttcttaaccgcctttgtctaccccatcgtctcccactgggtctggtctggcgacggctggctcagcgccagccgtacctccggcgccctcttgttcagctccggcgccatcgacttcgccggctcaggcgtcgtccacatggtcggcggcatcgccggtctctggggagccctaatcgaaggcccgagaatcggccgattcgaccggtccggcaggtccgtcgcgttgcgaggtcacagcgcttcgctcgttgttctcggctcgttcctcctctggttcggctggtacgggttcaaccccggttcgtttttaaccatcctgaaatcgtacggtactgccgggacttattacgggcaatggagcgccgtagggaggacagctgtgactacaacattggctgggtgcacagccgcacttacgaccttgtttggcaagagattattggatggacactggaatgtcgttgatgtgtgtaacggtttgttagggggttttgctgcgatcacctcagggtgttcggtggtagagccgtgggctgcaatcgtgtgtgggttcgtgtcagcttgggttttgatcgggtgtaacaaggttgcagagaagttgaagtacgatgatccactggaggcggcgcaactccacgggggttgtgggtcgtgggggattttattcaccgggttgttcgcgaagaagaagtatgtcgacgaggtgtattcggcggggcggccgtacgggttgtttatgggtggcggaggaaagcttctggcggcgcagcttattgagatcttagttattttcgggtgggtgtcggtgacaatgggcccactattttatggattgaaaaaattgaagttgttgcggatctcgagggaggatgagatggcggggatggatctgaccaggcatggtgggtttgcatacatctatcgtgatgaagatgatctcgctaatagacctgggtttatgatgaggaaggtcgagcctcagaactcaagtcccacacctgatcacaactcatcatcaccagctgaagctgtgtagtacaaagggcaatcggacggtttcccagagtcaaacttcctacgtatcagcttttttcattttaaaaaaaaaaaaaaaaaaaaaaaaaaaaaaaaaaa

SEQ ID NO: 1985 - protein, 513 aa, Camellia sinensis
MASTLGCSATDLVPHLTGVNNATAVADFICGRLDAVSTKLSDTTYAVDTTYLLFSAYLVFAMQLGFAMLCAGSVRAKNTMNIMLTNVLDAAAGGLSYYLFGFAFAFGSGSRSNAFIGHYSFALTGVPSATHDYSFFLYQWAFAIAAAGITSGSIAERTQFVAYLIYSSFLTAFVYPIVSHWVWSGDGWLSASRTSGALLFSSGAIDFAGSGVVHMVGGIAGLWGALIEGPRIGRFDRSGRSVALRGHSASLVVLGSFLLWFGWYGFNPGSFLTILKSYGTAGTYYGQWSAVGRTAVTTTLAGCTAALTTLFGKRLLDGHWNVVDVCNGLLGGFAAITSGCSVVEPWAAIVCGFVSAWVLIGCNKVAEKLKYDDPLEAAQLHGGCGSWGILFTGLFAKKKYVDEVYSAGRPYGLFMGGGGKLLAAQLIEILVIFGWVSVTMGPLFYGLKKLKLLRISREDEMAGMDLTRHGGFAYIYRDEDDLANRPGFMMRKVEPQNSSPTPDHNSSSPAEAV

SEQ ID NO: 1986 - DNA, 1521 bp, Triticum aestivum
  CDS (24)..(1436)
aggtaggtagatcagtcgggaagatgtcggtgccggtggcgtaccaggggaacacgtcggcggcggtggccgactggctgaacaagggcgacaacgcgtggcagctgacggcgtccacgctggtgggcctcatgagcgtgccgggcatggtggtgctgtacggcggcgtggtgaagaagaagtgggcggtcaactccgccttcatggcgctctacgccttcgccgccgtctggatctgctgggtcgtctgggcctacaacatgtccttcggcgaggagctgctcccgttctggggcaaggccggcccggcgctcgaccaggccttcctcgtcggccgcgcctcgctcccggccaccgcgcactaccgcgcagacggcacgctcgagacggccatggtggagccctacttccccatggccaccgtcgtctacttccagtgcgtgttcgccgccatcacgctcatcctggtggccgggtcgctgctgggccgcatgagcttcctggcgtggatgctcttcgtgccgctctggctcaccttctcctacaccgtcggcgccttctccgtgtggggcggcggcttcctcttccactggggcgtcatcgactactgcggcggctacgtcatccacatccccgccggcgtcgccggcttcaccgccgcgtactgggtcgggccaaggaccaagaaggacagggagagcttcccgcccaacaacatcctgttcgcgctcaccggcgccgggctgctgtggatggggtgggccgggttcaacggcggcgggccgtacgcggccaatgtcgactcgtccatggccatcctgaacaccaacatctgcacggcggcgagcctcatcgtctggacctgcctcgatgccgtcttcttcaagaagccctccgtggtcggcgccgtccaggccgtgatcaccggtctcgtctgcatcacgccaggcgcaggtgtcgtgcagggttgggcggcgctggttatgggcgtgctggccggcagtgtgccgtggtacaccatgatggtgctccacaagcgctccaagctccttcaacgcgtcgacgacacccttggcgtcatccacacccacggcgtcgccggcctgctgggcggcgtcctcacgggcctcttcgccgagccgaacctctgcaatctattccttccggtcaccaactcccggggcgccttctacggtggtaacggtggggcgcagctcgggaagcagatcgccggagcgctcttcgtgatcgggtggaacgtggtcgtcacgtccattatctgcgtcgtcatccgccttgtcgtcccgctgcgcatgtccgaggagaagctcgccattggcgacgacgccgtgcacggcgaggaggcctacgcgttgtggggcgatggcgagcactacgatgacaccaagcacggcgccgccgtcgtgccggtgtgattttctctgctttgcttccttgttatgtttgtcccgtctatactgtgtcctgctttattttctcttgtctcttgccttccaaatg

SEQ ID NO: 1987 - protein, 470 aa, Triticum aestivum
MSVPVAYQGNTSAAVADWLNKGDNAWQLTASTLVGLMSVPGMVVLYGGVVKKKWAVNSAFMALYAFAAVWICWVVWAYNMSFGEELLPFWGKAGPALDQAFLVGRASLPATAHYRADGTLETAMVEPYFPMATVVYFQCVFAAITLILVAGSLLGRMSFLAWMLFVPLWLTFSYTVGAFSVWGGGFLFHWGVIDYCGGYVIHIPAGVAGFTAAYWVGPRTKKDRESFPPNNILFALTGAGLLWMGWAGFNGGGPYAANVDSSMAILNTNICTAASLIVWTCLDAVFFKKPSVVGAVQAVITGLVCITPGAGVVQGWAALVMGVLAGSVPWYTMMVLHKRSKLLQRVDDTLGVIHTHGVAGLLGGVLTGLFAEPNLCNLFLPVTNSRGAFYGGNGGAQLGKQIAGALFVIGWNVVVTSIICVVIRLVVPLRMSEEKLAIGDDAVHGEEAYALWGDGEHYDDTKHGAAVVPV

SEQ ID NO: 1988 - DNA, 1392 bp, Acetobacter diazotrophicus
  CDS (1)..(1392): transl_table=11
gtgagtctcccccgcactattcggactttctcacctcgcggcaccaccatcgccctggccacgctggccggggcggcgctgccggccatggccgcgcccgccatggccgccgatccggccccgcccgccatcaacaccggcgataccgcctggatgctggtcagcaccgcgctggtgctgatgatgaccgtaccgggcctggccctgttctatggcggcatggtccgcaagaagaacgtgctggccacgctgatgcagtccttcgccatctgctgcatcgtcacgattgtctggatggtcgcgggctacagcctggcgttcggcaccgggtcgccctacatcggcgatctgtcccgcttcatgctgaacggcatcggcgcgcagatttccaaggggtccgatgtcggcttcacgctggggctggggtcggccaacgccacggtgatgacgatccccgagagcgtcttcatgatgttccagatgacgttcgcgatcatcaccccggcgctgatcaccggcgccttcgccgagcgcatgaagttcagcgcgctgtgcgtgttcaccatcctgtggtcgctgctggtctatgcgccggtcgcccactgggtctggagcccgcttggctgggtcgcggggttcggcgccatcgatttcgccggcggcaccgtggtgcacatcaatgccggcgtcgccggcctggtcacggcgctggtggtgggcaagcggcagggctacggccaggacgatatgtcgcccttcaacctgacctatgccgtcatcggcgcgtcgctgctgtgggtcggctggttcggcttcaatgccgggtcggcggtaggggccaacggccgcgccggcatggcgatggcgacgacgcagatcgccagcgccgccgccggggtggcctggatgctggccgaatgggcccgcaccggcaagccgacggtgctgggcatcatttccggcgccgtcggcggactggtcgcgatcacgcccgccgccggcttcgtgctgccgggcggggccctgatcatcggcctgctggccggcgcggtctgccactggaccgccaccaccatgaagcacatgctgggctatgacgacagcctggacgccttcggcgtgcatggcatcggcggcatcctgggcgcgctgctgaccggcgtgctggcctatggcccgctttcggccaccgacgccaatcccgccggggtcgtgggatccttcgcgcagctcgtcacccaggccaaggccgtgggcgtcaccatcgtctggtgcgcggtcgtcaccttcgtcctgctgaagatcgtcgacctcgccatcggcctgcgcgtccggagcgaggacgaaatcgaggggctggacatgacccagcacggcgaacgcatcaactga

SEQ ID NO: 1989 - protein, 463 aa, Acetobacter diazotrophicus
MSLPRTIRTFSPRGTTIALATLAGAALPAMAAPAMAADPAPPAINTGDTAWMLVSTALVLMMTVPGLALFYGGMVRKKNVLATLMQSFAICCIVTIVWMVAGYSLAFGTGSPYIGDLSRFMLNGIGAQISKGSDVGFTLGLGSANATVMTIPESVFMMFQMTFAIITPALITGAFAERMKFSALCVFTILWSLLVYAPVAHWVWSPLGWVAGFGAIDFAGGTVVHINAGVAGLVTALVVGKRQGYGQDDMSPFNLTYAVIGASLLWVGWFGFNAGSAVGANGRAGMAMATTQIASAAAGVAWMLAEWARTGKPTVLGIISGAVGGLVAITPAAGFVLPGGALIIGLLAGAVCHWTATTMKHMLGYDDSLDAFGVHGIGGILGALLTGVLAYGPLSATDANPAGVVGSFAQLVTQAKAVGVTIVWCAVVTFVLLKIVDLAIGLRVRSEDEIEGLDMTQHGERIN

SEQ ID NO: 1990 - DNA, 1434 bp, Hebeloma cylindrosporum
  CDS (1)..(1434)
atggtcaacgtcacatacgatgattctggcagcttggttgcctacacgcccgatggcactccaatcgtctacaacctcggcgacatggcctggattgctgcctccatggctctcgtctggattatgattccaggcgttggccttttttattctggtttgctacggcggaagaacgcgctgtcgatgatttggacgtctctcgcatccatcgctgttgtttcatttcaatggtttttctgggggtactcccttgcgttcagcgaaacgggaaacgccttcattggcgatcttaaatactttggtctaaagggtgtccttgatcagccttctattggcagcagccgtattcccgccatccttttctgtatctatcagctcatgttcgcggcgatcaccgctgccctcgccgtgggcgctattgctgagcgtggtcgtctcggccctctacttgtctttattttcgtctggtccacaatagtttacgaccctattgccaattggacctggaacaccaacggatggtcattcatcctcggcggtctcgattttgctggaggaacacccgtccatatcagctctggaaccgccgccctcgccatttccatcttcctgggaaagcgccgtggatatggaactgaacgcctcgcttacaagccccataacaccacctacgttatcctcggtaccgttttcctgtggttcggttggtttggtttcaatggtggttcagccctctccgccaacctccgcgcaatccaggcatgcattgtaaccaacctcgctgcttccgttggcggcctgacgtggatgctttgggattatcggattgaaaggaagtggtccgctgttggtttttgctccggagccgtctctggtctcgttgcaatcacccccgcctctggtttcgttggcgctcccgccgcggtcgcctttggcgttcttggtggaacggcctgcaattttgccacccagctaaaattcgttcttggttacgacgatgccctcgacatttttgctactcacgctattgggggaattgttggtaacctcctcaccggccttttcgcccaggccagtgtagctggattcgatggtatcaccgaaatccctggtggctggttggacaggcattacatccagcttgcccatcaactcgctgattccgtcgccggatttgcttactcctttgtcatgacaactatcatactttgggtcatgcatattattcccggtctgacgctccgcaccaccgaggaggcggagatcctcggtgtggatgacgctgagatgggagagttcgcatacgattatgtcggcattgaccaagaaatcggccatactctcgacactggccttaccgcgactggtggaggccgcgagcctgaccatgccaaggcagtgtcgaccagcagcgtagaagagaaatcagcatga

SEQ ID NO: 1991 - protein, 477 aa, Hebeloma cylindrosporum
MVNVTYDDSGSLVAYTPDGTPIVYNLGDMAWIAASMALVWIMIPGVGLFYSGLLRRKNALSMIWTSLASIAVVSFQWFFWGYSLAFSETGNAFIGDLKYFGLKGVLDQPSIGSSRIPAILFCIYQLMFAAITAALAVGAIAERGRLGPLLVFIFVWSTIVYDPIANWTWNTNGWSFILGGLDFAGGTPVHISSGTAALAISIFLGKRRGYGTERLAYKPHNTTYVILGTVFLWFGWFGFNGGSALSANLRAIQACIVTNLAASVGGLTWMLWDYRIERKWSAVGFCSGAVSGLVAITPASGFVGAPAAVAFGVLGGTACNFATQLKFVLGYDDALDIFATHAIGGIVGNLLTGLFAQASVAGFDGITEIPGGWLDRHYIQLAHQLADSVAGFAYSFVMTTIILWVMHIIPGLTLRTTEEAEILGVDDAEMGEFAYDYVGIDQEIGHTLDTGLTATGGGREPDHAKAVSTSSVEEKSA

SEQ ID NO: 1992 - DNA, 1317 bp, Pseudomonas stutzeri
  CDS (1)..(1317): transl_table=11
atgactctgcgaagattcgcagggctaggagcccttttgtctctgttaagcccaggcctggccatggcgcaggaggcaacgctggattcaggcgatacggcatggatgctgacggccactgcgctggtgctgttcatgaccatccccggactggcgctgttctacggcggcatggtccgctcgaagaacatcctctcggtgatgatgcagtgcttcgccatcaccggcctgatgagcatcctctggatggtctatggctacagcctcgcattcgataccaccggtatggaagcgggcgtcaccaacttcaattccttcgtcggtggtctggatcgcgccttcctcagcggcctgactcctgacagcctggtcggcgccttcccggaaagcgtcttcatcacgttccagatgaccttcgccatcatcaccccggcgctcatcgtcggcgccttcgccgagcgcatgaagttctcggcgatgctggtgttcatggacgtgtggttcaccctggtctatgcgccgatcgcgcatatggtctggggcggtgacggtggcctgatgtgggactggggcgtgctggatttcgccggtggcaccgtggtgcacatcaatgccggtatcgccggtctggtggcctgcctggtcctgggcaagcgcaagggcttcccgaccacgccgatggcaccgcacaacctggggctgaccctggtcggcgcggcgatgctgtggattggctggttcggcttcaacgccggttcggccgtggctgccaacggcaccgctggcatggccatgctggtcacccagatcgccaccgccgcagctgcgttgggctggatgttcgccgagtggatcggccacggcaaacccagcgcgctgggcatcgcctcgggcgtggtcgccggtctggtcgccatcaccccggctgccggcaccgtcgggccgatgggcgcgctgatcatcggcctggtctcgggcgtggtctgcttcttctgcgccaccagcctgaaacgcaagctcggctacgacgattcgctggatgcctttggcgtgcacggcgtgggcggcatcgtcggtgcgctgctcaccggcatcttcgccgcacccatgctgggcggtttcggtgaggtggagaacatcggcctgcagctgtggattcagttcaagggcgtgctcttcaccgtcgtctacaccggcatcgtcacctacctgatcctcaaggcgatcgacctggtgatgggcctgcgggtgaacgaggagcaagagaccatcggcctcgacctcagcctgcacaacgagcgcggctacaacctgtaa

SEQ ID NO: 1993 - protein, 438 aa, Pseudomonas stutzeri
MTLRRFAGLGALLSLLSPGLAMAQEATLDSGDTAWMLTATALVLFMTIPGLALFYGGMVRSKNILSVMMQCFAITGLMSILWMVYGYSLAFDTTGMEAGVTNFNSFVGGLDRAFLSGLTPDSLVGAFPESVFITFQMTFAIITPALIVGAFAERMKFSAMLVFMDVWFTLVYAPIAHMVWGGDGGLMWDWGVLDFAGGTVVHINAGIAGLVACLVLGKRKGFPTTPMAPHNLGLTLVGAAMLWIGWFGFNAGSAVAANGTAGMAMLVTQIATAAAALGWMFAEWIGHGKPSALGIASGVVAGLVAITPAAGTVGPMGALIIGLVSGVVCFFCATSLKRKLGYDDSLDAFGVHGVGGIVGALLTGIFAAPMLGGFGEVENIGLQLWIQFKGVLFTVVYTGIVTYLILKAIDLVMGLRVNEEQETIGLDLSLHNERGYNL

SEQ ID NO: 1994 - DNA, 1194 bp, Methanosarcina mazei
  CDS (1)..(1194): transl_table=11
atggctataaacgaagcagacactgtatgggtattgctttcatcggcattggtattattaatggttcctgcgctggcactgttctacggagggcttgtccagcgtaaaaacgtcctgagcagcatgatgcattcattcgttgcaatgggcgtcctggctcttgaatggataataataggttactcccttgcgttttcagaaggcaactggtttattggcggccttgagaatgtgtttctgagcgggattgatccttactccgtaacaggtacgattcccacctatgcatttgttgcattccagggaatgttcgcaataattactcctgcacttatatccggtgccatagtagggcgtgtcaagttcaagtcttacatcgcgttcatcctgctctggggccttattgtctatgccccggtatgtcactgggtttggggcggcggattccttaccggagaagcccttgactttgcaggcggtacggttgtccacataactgcaggtatgtcttcacttgcaatactggcatacctcggcaagagaaggggatatggtgttgattccctgaagccgcacaacgttaccctgaccctcctcggagccggacttctctggttcgggtggttcgggttcaacgcaggctcggctcttgctgcaaacgaaatagcagcccttgcattcatgaccacgctcgttgctcccgctgcagcaggttttgtctggatggcgcttgaatgggcgcaccttggacgccccaccgcactcgggtttgcaaccggcatcctggcagggcttgtagggataactcctgctgccggatttgtcactccagtagccgcgattgccataggtgcgattgcaagcttcatatgttaccaggctgtgatgttcaaaaacaggctaggatacgacgattcacttgatgcatttggagttcacggagtcggcggaatagtcggtgcgatattaacaggcgtatatgcaagtgtaggcggagaaggcctacttctcgggaactctgcccagttgatgattcagcttcagggcgtggttatcacaattgtatacgcaatggcctgcaccctgctgataggatttgtactccataaaacgatagggctcaaagtcagtgaaagcgaagaaatcatagggcttgacaaaacccagcatggtgaagcagcatacaacatttga

SEQ ID NO: 1995 - protein, 397 aa, Methanosarcina mazei
MAINEADTVWVLLSSALVLLMVPALALFYGGLVQRKNVLSSMMHSFVAMGVLALEWIIIGYSLAFSEGNWFIGGLENVFLSGIDPYSVTGTIPTYAFVAFQGMFAIITPALISGAIVGRVKFKSYIAFILLWGLIVYAPVCHWVWGGGFLTGEALDFAGGTVVHITAGMSSLAILAYLGKRRGYGVDSLKPHNVTLTLLGAGLLWFGWFGFNAGSALAANEIAALAFMTTLVAPAAAGFVWMALEWAHLGRPTALGFATGILAGLVGITPAAGFVTPVAAIAIGAIASFICYQAVMFKNRLGYDDSLDAFGVHGVGGIVGAILTGVYASVGGEGLLLGNSAQLMIQLQGVVITIVYAMACTLLIGFVLHKTIGLKVSESEEIIGLDKTQHGEAAYNI

SEQ ID NO: 1996 - DNA, 1452 bp, Tuber borchii
  CDS (1)..(1452)
atgaatgacccagatcatctcaattatgtcccacttgttcctttcaatggaactaaaccattcgggggtgattcactgactcaagacctgaacatttggtacgagagcggaaatgttgcctgggtcatgacctcgactgcgcttgttctgctgatgattccgggtgtcggattcttctattcgggactcgcgagaagaaagtcggctctttctctcatctggctgtcaatgatggcaaccgctgtagttagctttcagtggttcctttggggttattctttggctttctcgcatactggtggtagattcattggaaaccttgacaatttcggatttaagggacttctcggttatccttctattggaagtgagaaaattccggacctgctgtttgctctctatcagggaatgttctctgctattacggttgctctggctattggtgccgctgcagagagaggccgtatgttgccttgtgtagtttttatgtttgtctgggctactttgatttacgaccctattgcatgctggacgtggaattcctcgggatggtcgttcaggatgggtggattggattttgctggtggaacgccagttcatatttcatccggatccgccgccttggcctactctctgatgttgggaaagcgacgaggccatggaacacatgagttaaactaccgcccacacaatgtcactcacatcgttctcggaacagttttcctgtgggttggctggtttgggtttaacggaggatccgctctttctggcaacatgagagctgttatggcttgtgtcgtcactaatttggctgcatctgttggaggaattacttggtgtcttctcgattaccgtttggagcagaagtggtctactgtgggattctgttcaggagtcattgccggactggttgctattacccctggatctggatatgttccctcttgggctgctgttatttacggtgttgttggtggtgccgcatgtaactatgctaccaagctcaagtttgttattggcgtagatgatgctttggatatcttcgcggagcacggtgtcgggggtattgtaggaaatatcctgacagccttctttgcggctgattacattgcgcatcttgacggctctaccgagattaatggaggttggttgaacggacactataagcaacttggatatcaagttgcggactctgttgcgggttttgcatactccttcggaggcacttgtatcatcctcttcatcatgaatcttatccctggtttgagtcttcgtgctactgaggaggccgagattcttggtattgatgatgccgagctcggagagttcgcctatgactatgttgagcttactcgcgaagttatctctgacgatgacactgtacctaaaatgtcatcggagaacaatgcgagtgtagaactacctgctgaaagggctgagaagtctgcttaa

SEQ ID NO: 1997 - protein, 483 aa, Tuber borchii
MNDPDHLNYVPLVPFNGTKPFGGDSLTQDLNIWYESGNVAWVMTSTALVLLMIPGVGFFYSGLARRKSALSLIWLSMMATAVVSFQWFLWGYSLAFSHTGGRFIGNLDNFGFKGLLGYPSIGSEKIPDLLFALYQGMFSAITVALAIGAAAERGRMLPCVVFMFVWATLIYDPIACWTWNSSGWSFRMGGLDFAGGTPVHISSGSAALAYSLMLGKRRGHGTHELNYRPHNVTHIVLGTVFLWVGWFGFNGGSALSGNMRAVMACVVTNLAASVGGITWCLLDYRLEQKWSTVGFCSGVIAGLVAITPGSGYVPSWAAVIYGVVGGAACNYATKLKFVIGVDDALDIFAEHGVGGIVGNILTAFFAADYIAHLDGSTEINGGWLNGHYKQLGYQVADSVAGFAYSFGGTCIILFIMNLIPGLSLRATEEAEILGIDDAELGEFAYDYVELTREVISDDDTVPKMSSENNASVELPAERAEKSA

SEQ ID NO: 1998 - DNA, 1479 bp, Hebeloma cylindrosporum
  CDS (1)..(1479)
atgagtaatttagctaccggccagttcgaccgtggtgacatatctttcatcgtcgtcgcgggcgccatggtgttcttcatggtgcccggtctggctttcctttattccggcctttctcgtcgcaaaagtgcactgtctcttatatgggccgttgcagcgagcaacgccgtcgtgatattccagtggtatttcgtcggctactctctggcgttctccagcacggcgacaaacggctacattggaaacctgagaaattttgggctcatgaaggttgaggctgatccctctccgggctcccctctcattcccgagattctttacagtttcttccagatggaattcgcatgcgtaaccgccggtattctaatgggcggtctcgccgaacgtggtcgcgttttcccggccatgattttcatatttttttggatgaccttcgtctactgccctcttgcttgttgggcatggagcacgcatggctgggcttttaaatggggtgttcttgattttgcaggcggtggtcccgttgagattggaagcggtgttggtggcctggcctatgcctgggtccttggtcgcaggaacgaacgagaattgcttaacttccgtcctcataacgttggcctggttggcttgggaaccttcatgctatggtttggatggatcgggttcaacggaggaagtgcttttggtgcaaatctccgcgccatctttgccatttggaataccatgattgctgcgtcattcgggggcatggtttggtgccttctcgatttccgcatcgagcgtcggtggagtatggtcggattttgctccggtacgatcgccggtcttgttgcagctacaccttcctctggctacttgagaccatggtcgtcagttgtggtcggagttcttgcgggcaccttgtgtaattttgctaccaaagtcaagtttttgttgcgaatcgatgacgcgctcgatctattcgcggaacacgctgtaggtggcgttgttggtttgatgttgaacgcattctttgccgaaactgccgttattgccatggacgatgttaccatcggagttcgtggtggttgggtcgatcacaattggaagcaactttatattcagtttacctatgtggttgcgacttgcgcctactcttttgtcatgactgctctggtggcaaaaaccgtcgatctgatccctggcctgaaactcagaagtagtccagaaggcgagatgcttggtatggacgaggttgagatcggagaattcgcaactgattacattgaattgcgccgggacgttgcggactgttcgactttcggtttcacaagaggttctaatggatacatcccacatgctgcgacgaatgaaacacacgctcaagatactagttctaacgacgacccgcatcatcgtatcgatgaacccacggcgcctgaacgtttggaacccctcaccgaaaaaaatgaatgtgggaccgtgactccatcataa

SEQ ID NO: 1999 - protein, 492 aa, Hebeloma cylindrosporum
MSNLATGQFDRGDISFIVVAGAMVFFMVPGLAFLYSGLSRRKSALSLIWAVAASNAVVIFQWYFVGYSLAFSSTATNGYIGNLRNFGLMKVEADPSPGSPLIPEILYSFFQMEFACVTAGILMGGLAERGRVFPAMIFIFFWMTFVYCPLACWAWSTHGWAFKWGVLDFAGGGPVEIGSGVGGLAYAWVLGRRNERELLNFRPHNVGLVGLGTFMLWFGWIGFNGGSAFGANLRAIFAIWNTMIAASFGGMVWCLLDFRIERRWSMVGFCSGTIAGLVAATPSSGYLRPWSSVVVGVLAGTLCNFATKVKFLLRIDDALDLFAEHAVGGVVGLMLNAFFAETAVIAMDDVTIGVRGGWVDHNWKQLYIQFTYVVATCAYSFVMTALVAKTVDLIPGLKLRSSPEGEMLGMDEVEIGEFATDYIELRRDVADCSTFGFTRGSNGYIPHAATNETHAQDTSSNDDPHHRIDEPTAPERLEPLTEKNECGTVTPS

SEQ ID NO: 2000 - DNA, 1416 bp, Hebeloma cylindrosporum
  CDS (1)..(1416)
atggtgaatgtcacctacgacgcctctcagccactcgtatggactgacgctgccggaaacactggtgtctatagcccaggagatatcgcctgggtcctagcttcaactgcgttggtatggataatggtccccggtgttggattcttctattctggattgcttcggcggaagaatgctctgtctatgatatacctgagcatgatgacagtagccgtggtgtctttccaatggttcttctggggtttctcgcttgcttttagcgacggtgctagtctgttcatcggagacctaaaatatttcggcatgaaaggcgtcctcgaagagccttccattggaagtacacgtataccggccatcgttttcagtgtctatcagctcatgttcgcggctattacaccaatgatcgcggtcggtggtttcgccgaacgcgcgcaccttggacccctgcttttcttcgtttttgtgtggtcaaccctcgtttatgaccccattgcatgctggacatggaactccaaaggctggtctttcgtccacggaagctacgacttcgccggtggaacacctgtccacatctcttctggcacggccgccctcgctatttccatctacctcggaaaacgacgcggatacggcactgaagtgcttacatataagcctcacaacactacctacgttatccttggaactattttcctttggtttggatggttcggattcaacggaggctccgcccttgcagctaacttgcgagcggcccaggcttgtatcgttaccaatttggccgcgagtgttggtggactgacctggatgctttgggactatcgtattgaaaaaaaatggtcggctgtcggcttttgctcaggcgctatcgcaggcctcgtcgccattactcccggctctggtttcgtgggttcccctgctgccgttttattcgggttcatggccggtacagtgtgcaatttcgcgacccaactcaagttctttgctggatatgacgactccctcgatatcttcgcttcccatgccgtcggaggtgtcgtcggtaatctgctaacggcgctcttcgcacaagccagcgtcgctggtttcgatggcttcaccgtcatccctggaggttggttggaccgccactacatccagctcgcatggcacgtcgccgactcggctgcgggcctcagttattcatttgtggtgactactatcatcctctgggtcatgcactttatccccggtctccgccttcgcgtcccagaagaaaccgaaataataggtatcgacgaagccgacatgggcgaattcgcctacgactacgtaggcctggagaccgagctcaagccacatgtatacgtgcgctcaacaggaacagcttatgactccggccggaactccgagctcaaggaacgctcaagtgcctag

SEQ ID NO: 2001 - protein, 471 aa, Hebeloma cylindrosporum
MVNVTYDASQPLVWTDAAGNTGVYSPGDIAWVLASTALVWIMVPGVGFFYSGLLRRKNALSMIYLSMMTVAVVSFQWFFWGFSLAFSDGASLFIGDLKYFGMKGVLEEPSIGSTRIPAIVFSVYQLMFAAITPMIAVGGFAERAHLGPLLFFVFVWSTLVYDPIACWTWNSKGWSFVHGSYDFAGGTPVHISSGTAALAISIYLGKRRGYGTEVLTYKPHNTTYVILGTIFLWFGWFGFNGGSALAANLRAAQACIVTNLAASVGGLTWMLWDYRIEKKWSAVGFCSGAIAGLVAITPGSGFVGSPAAVLFGFMAGTVCNFATQLKFFAGYDDSLDIFASHAVGGVVGNLLTALFAQASVAGFDGFTVIPGGWLDRHYIQLAWHVADSAAGLSYSFVVTTIILWVMHFIPGLRLRVPEETEIIGIDEADMGEFAYDYVGLETELKPHVYVRSTGTAYDSGRNSELKERSSA

SEQ ID NO: 2002 - DNA, 1587 bp, Ustilago maydis
  CDS (1)..(1587)
atggtcaacatcacttacggtgtgcttcaagcacccgatggctcctcggctacctcgagcgccatcgccaagggaactgacattatcgtttcttacggcccaaatggcgagagcgtcgcttcctattcgcccggtgacatttcctgggttctcacatgtaccgctctcgtatggctcatgattcccggtctcggttacctctactctggtcttgctcgcagaaagaacgcgcctcacctccttttgctcactttggccgctctcgccgttgtctcgttccagtggttcttttggggctactcgctcaccttttctcaaacctcaggcgctttcctcggcaatctgcgcaactttggctacatgggtgttctcgaaaatcccgtgcctcaggcatacaacaaagtgcccgaaattgtatacgccatctaccagtgcatgttcgccaaccttgtccccgccatcgccatcggtgccgcttgtgagcgtggccgtgtctggcctttcctcgtctttacctttgtctggaccacgctcgtctacgatgtgatcgcctgctgggtctggaaccccaccggttgggcgttcaagtggggtgttcttgactacgccggtggtggacccgtcgagattaactcgggtatcactggtctcgtcatctcttactatcttggccctcgtaccggttatggcaccgagcgtctactcttcaagccacacaacgtttcctacatcttcctgggcaccgccttcctctggttcggctggatcggcttcaacggtggttcggtctttgctgccaacctccgtgcggctatggccatcagcaccaccaacctcgccgcttcgtccgccggtctcacctggatgttcctcgactggcgtctcgaacgcaagtggtccgtcgttggcttctgcacgggtgccattgctggtctcgtcgccatcactcccgctgctggctttgtcggcatgcccgctgctttgctcgtcggagtcgtttcctcggccgtttccaactttgccaccgttctcaagggccccatgcgcgttgacgatgtcatggacattttctcggtccacgctctcgccggtattgttggcacccttctcaccggtatcttcgcccaggcttccgtagccaacaacgacggcaacacggtcatcgccggtggctggctcgactcaaactggatccagctcgcctatcaactcgcctactgtgtcgctgtcacctgttggtgtggtggcgtcacgtttgctatcatgtttgttattgaccacattccttacatcggtcccttccgttcgagcgagatgggtgaagtggtgggtatggatgaggaccagtgtggcgagtgggcttacgactacgcctttatcaaccgtgatcttgagggcaactacaagcccgaccacggtcagacgctcgacatcaacgaaaagatgcccaacgttcatcaaaccgactcgctgcgctccgaaacgcacgccgactcgagccaagacaaccccaactcgcagctcgccgctgccgaacaccagtctccatccaccgctgaaccagccgtggaaatgaagcaggcttaa

SEQ ID NO: 2003 - protein, 528 aa, Ustilago maydis
MVNITYGVLQAPDGSSATSSAIAKGTDIIVSYGPNGESVASYSPGDISWVLTCTALVWLMIPGLGYLYSGLARRKNAPHLLLLTLAALAVVSFQWFFWGYSLTFSQTSGAFLGNLRNFGYMGVLENPVPQAYNKVPEIVYAIYQCMFANLVPAIAIGAACERGRVWPFLVFTFVWTTLVYDVIACWVWNPTGWAFKWGVLDYAGGGPVEINSGITGLVISYYLGPRTGYGTERLLFKPHNVSYIFLGTAFLWFGWIGFNGGSVFAANLRAAMAISTTNLAASSAGLTWMFLDWRLERKWSVVGFCTGAIAGLVAITPAAGFVGMPAALLVGVVSSAVSNFATVLKGPMRVDDVMDIFSVHALAGIVGTLLTGIFAQASVANNDGNTVIAGGWLDSNWIQLAYQLAYCVAVTCWCGGVTFAIMFVIDHIPYIGPFRSSEMGEVVGMDEDQCGEWAYDYAFINRDLEGNYKPDHGQTLDINEKMPNVHQTDSLRSETHADSSQDNPNSQLAAAEHQSPSTAEPAVEMKQA

SEQ ID NO: 2004 - DNA, 1731 bp, Brassica napus
  CDS (1)..(1560)
  misc_feature (1591)..(1591): k is g or t
atgtcaggagctataacatgttctgcggccgatctagccaccctacttggccccaatgccacggcggcggccgactacatttgcggccaattaggcaccgttaacaacaagttcaccgatgcagccttcgccatagacaacacctacctcctcttctctgcctaccttgtcttcgccatgcagctcggcttcgctatgctttgtgctggttctgttagagccaagaatacgatgaacatcatgcttaccaatgtccttgacgctgcagccggtggattcttctactatctctttggttacgcctttgcctttggaggatcctccgaaggattcattggaagacacaactttgctcttagagactttccgactcccacagctgattactctttcttcctctaccaatgggcgttcgcaatcgcggccgctggaatcacaagtggttcgatcgcagagaggactcagttcgtggcttacttgatatactcttctttcttaaccggatttgtttacccggttgtctctcactggttttggtccccggatggatgggccagtccctttcgttcagcggatgatcgtctgtttagcaccggagccattgactttgctggctccggtgttgttcacatggttggtggcatagcaggtttgtggggtgctcttattgaaggtcctcgtcgtggtcggttcgagaaaggtggtcgcgctattgctctgcgcggccactctgcctcactcgtcgtcttagggaccttcctcctatggtttggatggtatggtttcaaccccggttccttcactaagatactcgttccgtataattctggttccaactacggccaatggagcggaatcggccgtacagcggttaacaccacactctcaggatgcacagcagctctaaccacactctttggtaaacgtctcctatcaggccactggaacgtaacggacgtttgcaacgggttactcggtgggtttgcggccataaccgcaggttgctccgtggtagagccatgggcagcgattgtgtgcggcttcatgacttctctcgtccttatcggatgcaacaagctcgcggagcttgtacaatatggcgatccactcgaggcggcccaactacatggagggtgtggcgcgtgggggttgatattcgtaggattgtttgccaaagagaagtatctaaacgaggtttatggcgccaccccgggaaggccatatggactatttatgggcggaggagggaagctgttgggagcacaattggttcaaatacttgtgattgtaggatgggttagtgccacaatgggaacactcttcttcatcctcaaaaggctcaatctgcttaggatctcggagcagcatgaaatgcaagggatggatatgacacgtcacggtggctttgcttatatctaccatgataatgatgatgagtctcatagagtggatcctggatctcctttccctcgatcagctctccccctcgcgtttaattttcaactttttggtaatttattaccgtttaagtattgtttgggttttggttttgaaatataaatatttggatgttttggtttgttttaagtgkcctatcgtctttttgtgtttataagtgttttagtttatgtttttttttttgattttcttgaattttaattttacatgcctcggctaatgtttatgctatttcttagaaatttatatatacaacttttggtgatcaaaaaa

SEQ ID NO: 2005 - protein, 519 aa, Brassica napus
MSGAITCSAADLATLLGPNATAAADYICGQLGTVNNKFTDAAFAIDNTYLLFSAYLVFAMQLGFAMLCAGSVRAKNTMNIMLTNVLDAAAGGFFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMTSLVLIGCNKLAELVQYGDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSALPLAFNFQLFGNLLPFKYCLGFGFEI

SEQ ID NO: 2006 - DNA, 1482 bp, Ustilago violacea
  CDS (1)..(1482)
atggtcaacgttgcgtacgatacgacagggactcttgttgccaatgtagatggcactcagaccgtgtacaatggcggtgacatggcatgggtgcttgtcgccggtgttctcgtcatgatcatgtcccccggagttggtttcctctattctggtcttttgcgtaggaagaatgctttgtctatgatgatgctcggtgtccttgtctatgcggttattacaattcaatggtttttttggggctactcgttggcttttagcagcaccggcagtgccttcatcggcgacttgaagcactttggcctcatgaacgtcacgctcgaaccatccgccgggtcctccaagattcctgctctgttgtattacttctaccaatccatgttcgccactgtgactgtggttattcttgttggaggtattgcagaacgtgcacgtattctaccgcttctcattttctgcttctgttgggccaccatcgtgtacgaccctattgccaactgggtctggaaccccaacggatggctctacaagctcggtgagctcgactttgccggcggaggacccgtccatatcacttcgggaaccgctggctttgcgtggtcgctctacttgggccgtcgtcgcggttatggtacagccaagctcgcttaccgcccccactcggtcttccaaatcatcctcggcaccgtcttcctctggttcggctggttcggatttaacggtggatccgaactggcgatgaacttgcgcgcagtccaggcctcgactgtcaccaacatcgctgccgctatgggtggaatcacctggttcgcgatggattggttctacaccaagaagtggtctgctgtctcgatgtgctccggtatcctcgctggtctcgtcggcatcacccctgcggctggttatattggctctcccgcggcgttggccattggtttcctcaccgcaattgcatgcaactttggcactggcctcaaagttctgctcggaatcgatgatgccgtcgactcgttcgcgctccacgccattgggggctactgcggatccgccttgactgcgctcttcgccgatagccgcgtcgctggatttgatggctacaccgagattcctggcggctggatcaaccacaactacatccagcttgggtggcaactcgccggagcgacgacgatcatggcttacaccttcgtcgtcacctacctgctcctctttgtcatcgaccacattcctggcctcaaactccgagctactgaggacatggagattcttggtatcgacgagaccgagctcggcgagaacgcctacgactttgtcttccgcaaccgtgatcttgagaaccctgaggaattctccgaattgcacaaccgagcaactggcgaagaccttagccgccaagtgagccatcactcgtcgtcgagccacaacaaggacatcaagtcgcctcactccgctgtccccgtgacggaggagaaattgagcgtttga

SEQ ID NO: 2007 - protein, 493 aa, Ustilago violacea
MVNVAYDTTGTLVANVDGTQTVYNGGDMAWVLVAGVLVMIMSPGVGFLYSGLLRRKNALSMMMLGVLVYAVITIQWFFWGYSLAFSSTGSAFIGDLKHFGLMNVTLEPSAGSSKIPALLYYFYQSMFATVTVVILVGGIAERARILPLLIFCFCWATIVYDPIANWVWNPNGWLYKLGELDFAGGGPVHITSGTAGFAWSLYLGRRRGYGTAKLAYRPHSVFQIILGTVFLWFGWFGFNGGSELAMNLRAVQASTVTNIAAAMGGITWFAMDWFYTKKWSAVSMCSGILAGLVGITPAAGYIGSPAALAIGFLTAIACNFGTGLKVLLGIDDAVDSFALHAIGGYCGSALTALFADSRVAGFDGYTEIPGGWINHNYIQLGWQLAGATTIMAYTFVVTYLLLFVIDHIPGLKLRATEDMEILGIDETELGENAYDFVFRNRDLENPEEFSELHNRATGEDLSRQVSHHSSSSHNKDIKSPHSAVPVTEEKLSV

SEQ ID NO: 2008 - DNA, 1858 bp, Solanum lycopersicum
  CDS (13)..(1557)
gccgctcaaatcatggcctccgccatgacttgctcagctgccgagctcttccctcatctcggcagctcagcaaatgccacagcggccgcagaattcatctgcagccgcttctcagctgtctcagagtacctcacaaacaccacctacgcggtggacaccacatacctcctcttctcggcttacctcgtcttcgccatgcaattgggatttgccatgttgtgcgcgggctctgtccgcgccaaaaacacgatgaatataatgcttacaaacgtgcttgatgctgctgctggtggattttcttattatctctttggttttgcctttgcctttggagctccttctaatggtttcattggaaaacatttttttggattaaaagagtttccttcacaagcttttgactatagctattttctttatcaatgggcctttgcaatagctgcagcaggtatcacaagtgggtccatagctgaaagaacacaatttgtggcttatctcatttactcttcatttttgactggttttgtgtacccaattgtctcacattggttctggtccggtgatggttgggccagtgcatcaaaaaccgatggtaacttattattgcggttcggtgttatcgattttgccgggtccggtgttgttcatatggttggtggcattgccggtctatggggcgctttcatcgaaggaccacgaatcggtcggtttgatcggtccggtcggtctgttgccctaagaggccatagtgcctcattagttgtattaggtacttttttactatggttcggttggtacggatttaatcctggttcattcttaactattcttaaatcatacgatcataccataagaggtacttattatggtcagtggagcgcgatcggtagaacagctgtcacgactacattggctggttgtaccgccgctctgacaactttgttttgtaagaggcttttagtggcacattggaatgtagttgatgtatgtaacggtttactaggtggatttgcagcaatcacgtcaggttgtgcagttgttgagccatgggcagctatagtttgtggatttatcgcagcttgggttttaattggatttaacgcattggcagctaaattaaaatacgacgatccattagaagcagcacaacttcatggtggttgcggttcatgggggataatatttactggattattcgcgaaaaaagaatatgtcaacgaagtatatccaggatttcctaatagaccatatggattgtttatgggaggtggtggaaaactattaggtgcacaagtaattcaagttgttgtgattattggatgggtgagtgtcacaatgggaccattgttttatttgttacataagtttaagctattgaggatatcgcgagacgatgaaacagcagggatggatttaacaagacatggaggatttgcatatatatatcatgatgaagatgaaggttcatctatgcctggatttaaaatgacaagagttgaaccgactaatacttctacaccagatcatcaaaatagatctgttaatgtggttgtataacaaataaataaataaataaaaatgttactatatagaatggtcaccttataattaaggaaacgtcaaatctcaaagtgctttaataatgtgatattattggtttcttgatagactatatatatatatgccaaatatttttgaccaaaaaaaaaaggattgtacttattttagctttatgactttattgtatgtgtcttcttgtttgtttgtttatttatttgaagcagttatctgtattgttctaaagatgtaaataaatagattattaattactctggtcaaaaaaaaaaaaaaaaaaaaa

SEQ ID NO: 2009 - protein, 514 aa, Solanum lycopersicum
MASAMTCSAAELFPHLGSSANATAAAEFICSRFSAVSEYLTNTTYAVDTTYLLFSAYLVFAMQLGFAMLCAGSVRAKNTMNIMLTNVLDAAAGGFSYYLFGFAFAFGAPSNGFIGKHFFGLKEFPSQAFDYSYFLYQWAFAIAAAGITSGSIAERTQFVAYLIYSSFLTGFVYPIVSHWFWSGDGWASASKTDGNLLLRFGVIDFAGSGVVHMVGGIAGLWGAFIEGPRIGRFDRSGRSVALRGHSASLVVLGTFLLWFGWYGFNPGSFLTILKSYDHTIRGTYYGQWSAIGRTAVTTTLAGCTAALTTLFCKRLLVAHWNVVDVCNGLLGGFAAITSGCAVVEPWAAIVCGFIAAWVLIGFNALAAKLKYDDPLEAAQLHGGCGSWGIIFTGLFAKKEYVNEVYPGFPNRPYGLFMGGGGKLLGAQVIQVVVIIGWVSVTMGPLFYLLHKFKLLRISRDDETAGMDLTRHGGFAYIYHDEDEGSSMPGFKMTRVEPTNTSTPDHQNRSVNVVV

SEQ ID NO: 2010 - DNA, 1272 bp, Aquifex aeolicus
  CDS (1)..(1272): transl_table=11
atgagagcgctaggatttatagggattattctatcaattttttcctcttttgcgtatgcatctgaagccaagttagacactggtaacacagcttggatgctcgtagcttcagcccttgtggtgtttatgacagttcccgggctcgctcttttctatggaggtttagacaaatcaaagagcatcctaaacacgatagcgatgtccttttcagcctttgcggttgtaacactaacgtggatattcgtaggttactcagtagcctacggagacgatatttttggttttataggaaatccattccagtacgtattaggtaagggtataagcgggataaattccgataccggataccctgcacttctggatctgatgttccagctcactttcgcaacaataactaccgctttaatttcgggttccttcgtaggaaggatgaagttttcagcctggatattgtttgcaatactctggagcgtatttgtttatccgcctgtagcccactgggtatggggaggcggatttctggctaacgacggagcccttgactttgcaggaggaacggtagtccacattaacgcgggtatagcgggtttagtaggtgcgttgatcctcggaagaaggaaagacacatctcttattcccaacaacgttccactggtagccctcggtgcgggaatactgtggttcgggtggtttggattcaacgccggttctgctctcggagctaatgagagcgcagcttgggcaatgataaataccacggttgcaacttcaacggcagcactcgcatggatgtttaccgaatggcttcacgtcggtaaacctacagttgtgggaatatcttcaggtatcgttgcaggacttgtcgcaataactcccgcggcaggttttgtaaaccttatcggttcaatttttataggagctatagcatccgtgtgtgcttactttatggttgctcttgtaaaaccaaaattcggatacgacgatgcacttgacgtgttcggaattcacggagtacgcggaatagtgggagcagttttaacgggagtatttgcggatccgaacgtgggaggaactcctggactgctctacggcaatccaaaacaggttcttatacaaatagaaggcgttatcgctactatactctactccgctatcctcacagccgttatactgctggttctgaaagcagtagtaggtctaagagtttccgaagaagaggagctcgaactggacagctccctacacggtgaaaaggcttacaacctataa

SEQ ID NO: 2011 - protein, 423 aa, Aquifex aeolicus
MRALGFIGIILSIFSSFAYASEAKLDTGNTAWMLVASALVVFMTVPGLALFYGGLDKSKSILNTIAMSFSAFAVVTLTWIFVGYSVAYGDDIFGFIGNPFQYVLGKGISGINSDTGYPALLDLMFQLTFATITTALISGSFVGRMKFSAWILFAILWSVFVYPPVAHWVWGGGFLANDGALDFAGGTVVHINAGIAGLVGALILGRRKDTSLIPNNVPLVALGAGILWFGWFGFNAGSALGANESAAWAMINTTVATSTAALAWMFTEWLHVGKPTVVGISSGIVAGLVAITPAAGFVNLIGSIFIGAIASVCAYFMVALVKPKFGYDDALDVFGIHGVRGIVGAVLTGVFADPNVGGTPGLLYGNPKQVLIQIEGVIATILYSAILTAVILLVLKAVVGLRVSEEEELELDSSLHGEKAYNL

SEQ ID NO: 2012 - DNA, 1434 bp, Mycobacterium bovis
  CDS (1)..(1434): transl_table=11
gtggaccaattccccatcatgggcgttccggatggcggcgacaccgcctggatgctggtgagttccgcgctcgtgctgttgatgacgccgggtctggcatttttctacggcggcatggtgcgttccaagagcgtcctgaacatgatcatgatgagcatcagcgcgatgggtgtcgtgacggtgctctgggcgctttacggctactcgattgcgttcggtgatgacgttggcaacatcgccggcaacccgagccaatactggggtctcaaaggtctcatcggcgtcaatgctgttgctgccgatccgagcacgcagaccgccgcggtgaatattccgctggcgggtaccctgccggcgaccgtgtttgtggcattccagctgatgttcgcgatcatcacggttgcgctgatctccggggcggtggccgaccggttgaagttcggcgcctggctgttgttcgccggtttgtgggcgacgttcgtctatttcccggtcgcacactgggtcttcgcatttgacggtttcgccgctgagcacggcggctggatcgccaacaagctgcacgccatcgacttcgccggcggcaccgcggttcatatcaacgccggtgtggcggccttgatgctggcgatcgtgctgggcaaaagacgcggttggccggcgacgctgtttcgaccgcacaatctgccgtttgtgatgctcggggccgccctgctgtggttcggctggtacgggttcaacgcaggatcggcgacgaccgccaacggtgttgccggggcgacgtttgtcaccaccacgattgcgacggccgcggccatgcttggctggctgctcacggagcgcgtccgagatggcaaggctacgacgctgggcgcggcgtcgggcatcgtcgccggactggtcgccatcacgccgtcctgctcgtcggttaatgtcctgggtgccttggcggtaggcgtgtcggccggggtgctgtgcgcgctggcggtggggctgaaattcaaactgggcttcgatgattcgctcgacgtggtcggggtgcacctggttggtggtctggtgggcacactgctggtgggtctgctggcagctccggaggctccggcaattaatggtgtggccggggtatcgaaggggttgttttacggcggaggcttcgcccagctggaacgacaggcgctcggtgcctgcagtgttctcgtctactctggaatcatcaccctgatcttggcattgatcctgaaattcaccatcgggctcaggcttgacgcggagcaagagagcaccggcatcgacgaggctgagcacgcggaaagcggctacgatttcgccgtcgccagcggctcggttctccccccgcgggtcaccgtggaggatagccgcaacggcattcaggagcgtataggccagaaagtggaggcggagccgaaatga

SEQ ID NO: 2013 - protein, 477 aa, Mycobacterium bovis
MDQFPIMGVPDGGDTAWMLVSSALVLLMTPGLAFFYGGMVRSKSVLNMIMMSISAMGVVTVLWALYGYSIAFGDDVGNIAGNPSQYWGLKGLIGVNAVAADPSTQTAAVNIPLAGTLPATVFVAFQLMFAIITVALISGAVADRLKFGAWLLFAGLWATFVYFPVAHWVFAFDGFAAEHGGWIANKLHAIDFAGGTAVHINAGVAALMLAIVLGKRRGWPATLFRPHNLPFVMLGAALLWFGWYGFNAGSATTANGVAGATFVTTTIATAAAMLGWLLTERVRDGKATTLGAASGIVAGLVAITPSCSSVNVLGALAVGVSAGVLCALAVGLKFKLGFDDSLDVVGVHLVGGLVGTLLVGLLAAPEAPAINGVAGVSKGLFYGGGFAQLERQALGACSVLVYSGIITLILALILKFTIGLRLDAEQESTGIDEAEHAESGYDFAVASGSVLPPRVTVEDSRNGIQERIGQKVEAEPK

SEQ ID NO: 2014 - DNA, 1479 bp, Saccharomyces cerevisiae
  CDS (1)..(1479)
atggagagtcgaactacagggcctttaacgactgaaacctacgatggccccactgtggccttcatgatattaggtgccgccctagtattttttatggtgcccggattgggattcttgtactccggattggcaagaaggaagtctgcactagcactaatctgggttgtattaatggcgactttggtcggtatactgcaatggtatttctggggttactctctagctttttcaaagtccgctccgaataataaattcattgggaatctagattcgtttggctttagaaacgtgtacggaaaaaaattcgatgaagatgcctaccctgagctcgcgtatgcaaccttccaaatgatgttttcgtgcgtcaacttaagtattatcgctggcgccactgccgaaagaggcaggctgctaccgcacatggtttttctctttattctagctaccattggatattgtccagtgacgtattggatttggtcaccaggtggttgggcataccaatggggagtcctcgattgggcaggcggcggcaacattgaaatattaagcgctgtttccgggtttgtttactcttggtttttgggcaaaagaaatgaaaagttactgataaatttcaggcctcataatgtttcattggtcactctaggcacatccatactgtggtttggctggctgctatttaattctgcatcctcattatccccaaatttgaggtcagtttatgcattcatgaatacatgtctcagtgccattactggtgggatgacgtggtgtcttctggattacagatcggagaagaaatggtcgacagttggtctgtgctccggtatcatttctgggctggtggctgcaacgccaagctcaggctgtataaccctttacggttcacttattcaaggcattgtggcgggggtagtgtgtaactttgcgacgaagttgaaatactacgctaaagtagatgatgccatggacattctagctgagcacggggttgcaggcgtaataggactaattttcaatgccctttttggagcagactgggtcattggtatggatggcactacagagcacgagggcggctgggtaactcacaattacaagcaaatgtataagcagatcgcttacattgccgcatccattgggtacactgctgctgtaactgcaataatctgctttgtgctcggctacatacccggtatgaggctaagaatatcagaagaggcagaggaggcgggtatggacgaagatcaaattggcgaatttgcgtacgattatgtggaagtgagaagagattactatctatggggtgtagacgaagattcacaacgctctgatgtaaatcaccgggtgaacaacgctcatttggccgctgaacgtagcagtagcggtactaatagttcctcggatgggaatggagaaatgattcaatccgaaaagatcctaccaattcatcaagaagatcctgccaataggtaa

SEQ ID NO: 2015 - protein, 492 aa, Saccharomyces cerevisiae
MESRTTGPLTTETYDGPTVAFMILGAALVFFMVPGLGFLYSGLARRKSALALIWVVLMATLVGILQWYFWGYSLAFSKSAPNNKFIGNLDSFGFRNVYGKKFDEDAYPELAYATFQMMFSCVNLSIIAGATAERGRLLPHMVFLFILATIGYCPVTYWIWSPGGWAYQWGVLDWAGGGNIEILSAVSGFVYSWFLGKRNEKLLINFRPHNVSLVTLGTSILWFGWLLFNSASSLSPNLRSVYAFMNTCLSAITGGMTWCLLDYRSEKKWSTVGLCSGIISGLVAATPSSGCITLYGSLIQGIVAGVVCNFATKLKYYAKVDDAMDILAEHGVAGVIGLIFNALFGADWVIGMDGTTEHEGGWVTHNYKQMYKQIAYIAASIGYTAAVTAIICFVLGYIPGMRLRISEEAEEAGMDEDQIGEFAYDYVEVRRDYYLWGVDEDSQRSDVNHRVNNAHLAAERSSSGTNSSSDGNGEMIQSEKILPIHQEDPANR

SEQ ID NO: 2016 - DNA, 1470 bp, Saccharomyces cerevisiae
  CDS (1)..(1470)
atggctcggggtgacggacatctatggacagagacatatgatagttccacagtcgcttttatgattttaggtgccgccctggttttcttcatggtaccggggctgggctttctttattccggtttagcaagaagaaaatctgctctggctttgatttgggtagtgataatggctaccttagtaggtatactgcaatggtatttttggggctattctttagcattctctaagactgcgacgaacaacaaatttatcggcaacttggattcatttgggtttagaaacgtctatggcaaaatttcggatgattccacgtatcctgaactgatttatgccattttccaaatgatgttcatgtgtgtcgcattgagtattatagctggtgccactgcggaaagaggtaagctttttccacatatggtttttctttttgtttttgcgactttggtttactgtcccatcacttattggatttgggccccaggtggttgggcctaccaatggggggtattagactgggctggcggtgggaatattgaaatcctaagtgctgtggctggtttcgtttattcttattttctaggaagaagaaaagaaaacctcctgatcaactttagaccacataatgtttccatggtgactttgggtacttctatactttggtttggttggttgcttttcaatgctgcaagctcactgtcaccaaatatgaggtccgtatatgcgttcatgaacacttgtctcagcgccaccacgggtggaatgacgtggtgtttattagattatcgatctgaaaaaaaatggtccactgttgggttatgctccggcattatctgtggtttagttgctgccacgcctagctcgggttgtattactctatatggctctttgatccaaggtataatagcgggtgttgtttgtaattttgcaacaaaaataaagtattatttaaaagtggatgattccttagatctattagctgaacacggtatcgccggtgtggtgggattgatttttaacgctctatttgcagctgattgggttattggaatggacggcacaacaaagcataagggtggttggttgacgcataactggaaacaaatgtatattcaaattgcctatatcggtgcctctgccggctattgtgctgtggtcacggccatcatttgcttcgtattaggtaaaattccgggtgtccatctaagagtcactgaggaagccgaagcattggggttggatgaagatcaaataggcgaattcgcttacgattacgtggaggttaggagagattattaccagtggggtgtagatacagatgcacttcatactacatgcaatggcgctaattctgcgtctgagacaaatcctactgaggacagccaaaactcctcattgtcatcagctacagtaagcggccaaaacgaaaaaagtaataatcctaaattgcatcacgcaaaagaagcatga

SEQ ID NO: 2017 - protein, 489 aa, Saccharomyces cerevisiae
MARGDGHLWTETYDSSTVAFMILGAALVFFMVPGLGFLYSGLARRKSALALIWVVIMATLVGILQWYFWGYSLAFSKTATNNKFIGNLDSFGFRNVYGKISDDSTYPELIYAIFQMMFMCVALSIIAGATAERGKLFPHMVFLFVFATLVYCPITYWIWAPGGWAYQWGVLDWAGGGNIEILSAVAGFVYSYFLGRRKENLLINFRPHNVSMVTLGTSILWFGWLLFNAASSLSPNMRSVYAFMNTCLSATTGGMTWCLLDYRSEKKWSTVGLCSGIICGLVAATPSSGCITLYGSLIQGIIAGVVCNFATKIKYYLKVDDSLDLLAEHGIAGVVGLIFNALFAADWVIGMDGTTKHKGGWLTHNWKQMYIQIAYIGASAGYCAVVTAIICFVLGKIPGVHLRVTEEAEALGLDEDQIGEFAYDYVEVRRDYYQWGVDTDALHTTCNGANSASETNPTEDSQNSSLSSATVSGQNEKSNNPKLHHAKEA

SEQ ID NO: 2018 - DNA, 1215 bp, Bacillus subtilis
  CDS (1)..(1215): transl_table=11
atgcaaatgggcgatacagtttttatgttcttttgcgctttactcgtgtggctgatgaccccgggattagcgttattttatggaggaatggtaaagagcaaaaatgtgctgagcactgccatgcacagtttctcttccattgccatcgtttccatcgtttgggtgctgttcggatatacacttgccttcgcaccaggcaattcaatcatcggcgggctggagtgggcaggcctcaaaggggtcggatttgatccgggagattacagcgataccatcccccactcgttatttatgatgttccaaatgacgttcgccgttctgactacagcgattatttccggggctttcgcagagcggatgcgattcggcgcttttcttttattctcggttttatgggcctctttggtttacacacccgtagcgcactgggtatggggcggcggctggatcggccagcttggagcgctcgatttcgctggcggcaatgttgttcatatttcctccggggtggcaggacttgttcttgccattgtgctcggcaaacggaaagacggtacagcgtcttctccgcataacctcatttacaccttcttaggaggagctttgatttggttcggctggttcggctttaacgtcggcagcgcattgaccttagatggtgtggccatgtacgcgttcatcaacacaaacaccgcggctgcagccgggatcgccggctggatcttagtagaatggatcattaacaaaaaaccgacaatgctcggagcggtatctggggcaatcgccgggcttgtcgccattacgccggctgccggatttgtcacaccgttcgcttccattattatcggcatcatcggcggagctgtttgtttctggggagtattctcgcttaaaaagaaattcggatacgacgacgcgcttgacgcctttggcctgcacgggatcggcggcacatggggcggaatcgcaacaggattattcgcaacaacctctgttaactcagcgggcgcagatgggttattttacggtgatgcaagcttaatctggaaacaaatcgtcgccatcgccgccacttatgtttttgtatttattgtcactttcgttattattaaaattgtaagcctcttccttccccttcgcgcaactgaagaagaagagtcacttgggcttgacttaacgatgcacggggaaaaagcatatcaagattctatgtga

SEQ ID NO: 2019 - protein, 404 aa, Bacillus subtilis
MQMGDTVFMFFCALLVWLMTPGLALFYGGMVKSKNVLSTAMHSFSSIAIVSIVWVLFGYTLAFAPGNSIIGGLEWAGLKGVGFDPGDYSDTIPHSLFMMFQMTFAVLTTAIISGAFAERMRFGAFLLFSVLWASLVYTPVAHWVWGGGWIGQLGALDFAGGNVVHISSGVAGLVLAIVLGKRKDGTASSPHNLIYTFLGGALIWFGWFGFNVGSALTLDGVAMYAFINTNTAAAAGIAGWILVEWIINKKPTMLGAVSGAIAGLVAITPAAGFVTPFASIIIGIIGGAVCFWGVFSLKKKFGYDDALDAFGLHGIGGTWGGIATGLFATTSVNSAGADGLFYGDASLIWKQIVAIAATYVFVFIVTFVIIKIVSLFLPLRATEEEESLGLDLTMHGEKAYQDSM

SEQ ID NO: 2020 - DNA, 1224 bp, Methanobacterium thermoautotrophicum
  CDS (1)..(1224): transl_table=11
atgatgctaaattcaggtgatacagcatggatgttgatctcaactgcactcgtgatactaatgacggtgccaggggttgctatgttctattctggtttaacaaaacgtgagaatgttctgaacaccatctttctatcatttgtttcccttggcattgtgagtctgctctggtttctgtttggatatggtctaatattcggcggggatgtttcagggatcataggatcccatcaggtgggcatcagccttattaatttagggtctgcttcaaaatatgctccaacaatccccgaaggactctttgcaatttttcagatgacctttgctgcaataacagttgccctgatttctggcgctgtggtggaaaggatcaaattctcgtcatggatactgttcatccccctctggtttgcactcgtatatgtacccgtggcccactgggtatggggcggaggattcctgcagaaccttggtgttcatgatttcgcagggggaattgtggtgcacatcaccagtggcatagccgcccttgcccttgcccttgttactggtccaagatatgaccagaaactgatgccacatcaccttggatattctgttataggtaccggtcttctctggtttggctggtttggattcaacgccggttcagccctctctgccggatcccttgcagctaacgccatgatagtgacaaacacctctgcagcggcgggtatgataggatggatcctcatggatagacttaaaaccggaaaaccaacacttcttggcgctctttctggagcagttgcaggcctggcatcaataacacctgcagcaggttttgtggatataggtgcctccattgtcaccggacttgtggcagctgttatatgttatcttgcagtttcatggctgaagccagctgctggatatgatgatgcgcttgatgtatttgggattcacggtgtttcagggatcataggaacccttggagttggtttatttgcagttccagccctaaacccatctttgacctcaggaggtcttttaactggaagcacatcccttcttgtcagtcagctgattggtgttgtcaccgtcactgtctacaccttcgtcgttacatatatccttgcgatgctgctgatgaaatttaaggggctccgtgttgaaagggaagaggaaattcagggacttgacataaatctccatgaggaaacaggttacagactgacatga

SEQ ID NO: 2021 - protein, 407 aa, Methanobacterium thermoautotrophicum
MMLNSGDTAWMLISTALVILMTVPGVAMFYSGLTKRENVLNTIFLSFVSLGIVSLLWFLFGYGLIFGGDVSGIIGSHQVGISLINLGSASKYAPTIPEGLFAIFQMTFAAITVALISGAVVERIKFSSWILFIPLWFALVYVPVAHWVWGGGFLQNLGVHDFAGGIVVHITSGIAALALALVTGPRYDQKLMPHHLGYSVIGTGLLWFGWFGFNAGSALSAGSLAANAMIVTNTSAAAGMIGWILMDRLKTGKPTLLGALSGAVAGLASITPAAGFVDIGASIVTGLVAAVICYLAVSWLKPAAGYDDALDVFGIHGVSGIIGTLGVGLFAVPALNPSLTSGGLLTGSTSLLVSQLIGVVTVTVYTFVVTYILAMLLMKFKGLRVEREEEIQGLDINLHEETGYRLT

SEQ ID NO: 2022 - DNA, 1239 bp, Methanobacterium thermoautotrophicum
  CDS (1)..(1239): transl_table=11
atggagatgactctgatggatgcggtcttaaactccggtgacactgcctggatgctggtatcaacagccctggtaatgctgatgacggttccaggcgtggcactattctacgggggtttaacaaaaaaggaaaacgtgctgaacaccatgttcctatccctgatagccttcgcagtgacgagcataatatgggtactctacggctatcagttcgcctttggagctgacataatggggttcataggaagtccagtgaacctgctgatgaacggggtcggtgttaacactgctgctgcactggcaccaacaataccagacttcctctacatagcattccagttaacattcgcagcaataacggttgcactcatatccggtgccgtcgttgaaaggatgaagttctcagcctggctggcattcattgtgctctgggtgagcctggtctacgtgccggtggcccactgggtatggggcggaggattcctggcgcagctcggtgccctggacttcgcaggcggtactgtggttcacatcaactcaggtgttgcagcactcgcactcgtctacctcctcggtaagagaaaggacacgagacttctgccacacaacctgggatactcagtgataggtgcttcactgctctggttcggctggtttggattcaacgccggttcagcactcacggcaggtggacttgcagcatcagccttcctggtgaccaacactgcggcggctgctggtatggtatcatgggttataatggactacctcaaggtgggtaaacccacagtactcggcggaatatccggtgcagttgctggcctcgtcgccataacacctgcagcaggtttcgtaactgtacctgcagccctcatcataggccttgtcacgagcgtaatatcataccttgcagtatcatacctcaaaccaaggcttggatacgacgatgccctggacgtcttcggaatacacggcatgtcaggtatatggggctcagtggcaacaggcctctttgcagcgccattcatcaacgaactgggaacaggcctcatatacggaaaccctggacagctgacagcacaggtgatagccgtggcagttgtggctgcctactccttcgtggtgacactgatcatcggcaaactcctggacttcaccgttggtctgagggtgagcggtaaggaggagatggagggccttgacacccacctgcatgaggagacaggctacaggatctga

SEQ ID NO: 2023 - protein, 412 aa, Methanobacterium thermoautotrophicum
MEMTLMDAVLNSGDTAWMLVSTALVMLMTVPGVALFYGGLTKKENVLNTMFLSLIAFAVTSIIWVLYGYQFAFGADIMGFIGSPVNLLMNGVGVNTAAALAPTIPDFLYIAFQLTFAAITVALISGAVVERMKFSAWLAFIVLWVSLVYVPVAHWVWGGGFLAQLGALDFAGGTVVHINSGVAALALVYLLGKRKDTRLLPHNLGYSVIGASLLWFGWFGFNAGSALTAGGLAASAFLVTNTAAAAGMVSWVIMDYLKVGKPTVLGGISGAVAGLVAITPAAGFVTVPAALIIGLVTSVISYLAVSYLKPRLGYDDALDVFGIHGMSGIWGSVATGLFAAPFINELGTGLIYGNPGQLTAQVIAVAVVAAYSFVVTLIIGKLLDFTVGLRVSGKEEMEGLDTHLHEETGYRI

SEQ ID NO: 2024 - DNA, 1545 bp, Arabidopsis thaliana
  CDS (1)..(1545)
atggacaccgcaaccaccacatgctctgccgtagatctatctgccctcctatcctcttcttctaactcaacatcttccctcgccgcggcaacctttttatgttcccaaatttcaaacatctccaacaaactctccgacacaacttatgccgtcgacaacacgtatctcctcttctccgcctaccttgtctttgccatgcagctcggtttcgctatgctttgtgctggatcagtccgagccaagaacactatgaacatcatgcttaccaatgtccttgatgctgccgctggagccatctcttactacctcttcggattcgcattcgcctttggtacaccttccaacggattcatcggtcgccaccatagcttcttcgctttaagctcttaccctgaacgccccggctccgacttcagctttttcctctaccaatgggcttttgccatagccgcggccggaatcactagcggttccatcgccgagcgaacgcaattcgttgcttaccttatctactctactttcttgaccggttttgtttacccgacagtctcgcactggttctggtcaagtgatggatgggctagcgcgtcccggtctgacaacaatctcttgtttggctcaggtgctattgatttcgcaggttcaggagttgttcacatggtaggtggaattgccggtttatgtggagcgttagttgaaggaccaagaataggtagatttgaccggtcaggccggtccgtggctttacgtggtcacagtgcatcccttgtcgtgcttggtaccttcttgttgtggtttggatggtatgggtttaaccctggttcctttttaaccattcttaaaggctacgacaagtctcggccatattatggtcaatggagcgctgtaggtcgcaccgcggtcaccacaacgctttctggctgcaccgctgcgttgactactctattcagtaaacggcttttagcaggtcattggaacgttattgacgtatgcaacggacttctaggcggctttgcagctataacctccggatgtgccgtggtggagccgtgggctgctatagtatgtggctttgtggcatcatgggttttaatcggatttaacttgcttgccaagaaacttaaatatgatgacccactcgaggctgctcagctccacggtggatgtggagcatggggattaatctttaccgggctgttcgcaaggaaagaatacgttaacgagatttactccggtgataggccttacggactgttcatgggcgggggaggaaaactgctcgccgcgcagatcgttcagattattgtgatcgttgggtgggtgacggtaactatgggaccgttgttttatgggttacataagatgaatcttttgaggatatcagcagaagatgagatggcaggaatggacatgacacgtcatggaggatttgcttacgcatacaatgacgaagacgacgtgtcgactaaaccatggggtcatttcgctggaagagtggagcctacaagccggagctcgactcctacaccgaccttgactgtttga

SEQ ID NO: 2025 - protein, 514 aa, Arabidopsis thaliana
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 2026 - DNA, 1428 bp, Arabidopsis thaliana
  CDS (1)..(1428)
atggccggagcttacgatccaagcttgccggaggttcctgaatggctcaacaaaggagacaacgcgtggcagctcacggcagcgactctggttggtctacagagtatgccaggtcttgttatcctctatgcctccatcgtcaagaagaaatgggctgtgaattcagcttttatggctctttacgctttcgccgccgttcttctctgttgggttctcctctgttacaaaatggcttttggagaagagcttttgccgttttggggcaaaggtggtccagctttcgaccaaggataccttaagggacaagcaaagatcccaaatagtaatgtggcggcgccgtattttccgatggcgacgttggtgtattttcagttcacattcgcggcgataacgacgatacttgtggcgggatctgtgttggggaggatgaatattaaagcatggatggcttttgtgccattgtggttgatctttagctacacagttggagcttatagtatatggggaggtgggtttctgtatcagtggggagttattgattattccggcggttatgttattcatctctcctccggtgttgccggtttcgtcgctgcttactgggtaggaccaaggcctaaggctgacagagagagattcccaccgaacaatgttcttctaatgcttgctggagctggacttttatggatgggatggtccggttttaacggtggtgctccttacgcggccaacttaacctcctctatcgccgtgttaaacaccaacctctcggccgccacaagcctccttgtatggactacacttgatgtcatcttctttggcaaaccttctgtcatcggagcaattcaaggcatggttactggcttagccggcgtcactcccggagcaggtttgatccaaacatgggcagctataataattggagtagtctcaggaacagctccatgggcctctatgatgatcattcacaagaaatccgctctccttcaaaaggtggatgatacattagcggtgttttacacacacgccgtggctggtttacttggtggaataatgacagggttgtttgcacaccctgatctctgcgttttggtacttcctctcccagcgaccagaggagctttctacggtggcaatggcggcaaacagcttttgaaacagttggctggagctgccttcattgccgtctggaatgtggtgtcgactactatcattctactcgctattagggtgttcataccattgagaatggctgaggaagagctcgggattggagacgacgcagcacatggggaagaagcttatgctctttggggagatggagagaagtttgatgctacaaggcatgtgcaacagtttgagagagatcaagaagctgctcatccttcttatgttcatggtgctagaggtgtcaccattgttctatga

SEQ ID NO: 2027 - protein, 475 aa, Arabidopsis thaliana
MAGAYDPSLPEVPEWLNKGDNAWQLTAATLVGLQSMPGLVILYASIVKKKWAVNSAFMALYAFAAVLLCWVLLCYKMAFGEELLPFWGKGGPAFDQGYLKGQAKIPNSNVAAPYFPMATLVYFQFTFAAITTILVAGSVLGRMNIKAWMAFVPLWLIFSYTVGAYSIWGGGFLYQWGVIDYSGGYVIHLSSGVAGFVAAYWVGPRPKADRERFPPNNVLLMLAGAGLLWMGWSGFNGGAPYAANLTSSIAVLNTNLSAATSLLVWTTLDVIFFGKPSVIGAIQGMVTGLAGVTPGAGLIQTWAAIIIGVVSGTAPWASMMIIHKKSALLQKVDDTLAVFYTHAVAGLLGGIMTGLFAHPDLCVLVLPLPATRGAFYGGNGGKQLLKQLAGAAFIAVWNVVSTTIILLAIRVFIPLRMAEEELGIGDDAAHGEEAYALWGDGEKFDATRHVQQFERDQEAAHPSYVHGARGVTIVL

SEQ ID NO: 2028 - DNA, 1491 bp, Arabidopsis thaliana
  CDS (1)..(1491)
atgtcaggagctattacttgctctgcggctgatctctcagccctactcggcccaaatgccacggcagcggctgactacatttgcggccagttgggttccgttaacaacaagtttaccgatgcagcctacgctatagacaacacgtacctcctcttctctgcctatcttgtctttgcgatgcagctcggcttcgctatgctttgtgctggctccgttagagctaagaacacgatgaacatcatgctcactaatgtccttgatgctgcagccggaggactcttctactacctctttggttatgcatttgcctttggtgaatcctccgatggattcattggaagacacaactttggtcttcaaaactttccgactctcacctcggattactccttcttcctctaccaatgggcgtttgcaatcgcagccgctggaatcaccagcggctccattgccgagaggactaagttcgtggcgtatttgatatactcttcttttttgaccgggtttgtttacccagttgtctctcactggttctggtctccggatggatgggctagtcccttccgttcagaagaccgtttgtttggcactggagccatcgactttgctgggtcaggtgttgttcacatggttggtggtatcgcaggattatggggtgcccttattgaaggccctcggattggtcggtttcctgatgggggtcatgctattgctctgcgaggccactctgcctcactcgtcgtcttagggaccttccttctctggtttggttggtacgggttcaaccctggttccttcaccaagatactcattccctacaattctggttccaactatggccaatggagtggaataggccgcaccgcggttacaactacactctcgggatgcacagcggctctaaccacactcttcggaaaacgtctcctatcaggccactggaacgtaactgacgtttgcaacgggttactcggagggtttgcggccataacggcaggttgctctgtggttgatccatgggcagcgatcgtatgtggcttcgtggcttccctcgtccttatcggatgcaacaagctcgcagagctcttaaaatatgacgatccacttgaggccgcacaactacacggagggtgtggtgcttggggtttgatatttgtaggactgtttgcaaaagagaagtatataaatgaggtttacggcgcgagcccaggaaggcactacgggctatttatgggcggaggagggaagctattgggagcacaactggttcaaataattgtgattgttggatgggttagtgccacaatgggaacactcttcttcatcctcaaaaagctcaatttgcttaggatctcggagcagcatgaaatgcgaggaatggatttagcaggtcatggtggttttgcttatatctaccatgataatgatgatgattccattggagtgcctggatctccagtacctcgtgcgcctaaccctccagccgtttga

SEQ ID NO: 2029 - protein, 496 aa, Arabidopsis thaliana
MSGAITCSAADLSALLGPNATAAADYICGQLGSVNNKFTDAAYAIDNTYLLFSAYLVFAMQLGFAMLCAGSVRAKNTMNIMLTNVLDAAAGGLFYYLFGYAFAFGESSDGFIGRHNFGLQNFPTLTSDYSFFLYQWAFAIAAAGITSGSIAERTKFVAYLIYSSFLTGFVYPVVSHWFWSPDGWASPFRSEDRLFGTGAIDFAGSGVVHMVGGIAGLWGALIEGPRIGRFPDGGHAIALRGHSASLVVLGTFLLWFGWYGFNPGSFTKILIPYNSGSNYGQWSGIGRTAVTTTLSGCTAALTTLFGKRLLSGHWNVTDVCNGLLGGFAAITAGCSVVDPWAAIVCGFVASLVLIGCNKLAELLKYDDPLEAAQLHGGCGAWGLIFVGLFAKEKYINEVYGASPGRHYGLFMGGGGKLLGAQLVQIIVIVGWVSATMGTLFFILKKLNLLRISEQHEMRGMDLAGHGGFAYIYHDNDDDSIGVPGSPVPRAPNPPAV

SEQ ID NO: 2030 - DNA, 1497 bp, Arabidopsis thaliana
  CDS (1)..(1497)
atgtcaggagcaataacatgctctgcggccgatctcgccaccctacttggccccaacgccacggcggcggccgactacatttgcggccaattaggcaccgttaacaacaagttcaccgatgcagccttcgccatagacaacacctacctcctcttctctgcctaccttgtcttcgccatgcagctcggcttcgctatgctttgtgctggttctgttagagccaagaatacgatgaacatcatgcttaccaatgtccttgacgctgcagccggaggactcttctactatctctttggttacgcctttgcctttggaggatcctccgaagggttcattggaagacacaactttgctcttagagactttccgactcccacagctgattactctttcttcctctaccaatgggcgttcgcaatcgcggccgctggaatcacaagtggttcgatcgcagagaggactcagttcgtggcttacttgatatactcttctttcttaaccggatttgtttacccggttgtctctcactggttttggtccccggatggatgggccagtccctttcgttcagcggatgatcgtttgtttagcaccggagccattgactttgctggctccggtgttgttcacatggttggtggcatagcaggtttatggggtgctcttattgaaggtcctcgtcgtggtcggttcgagaaaggtggtcgcgctattgctctgcgcggccactctgcctcgctagtagtcttaggaaccttcctcctatggtttggatggtatggtttcaaccccggttccttcactaagatactcgttccgtataattctggttccaactacggccaatggagcggaatcggccgtacagcggttaacaccacactctcaggatgcacagcagctctaaccacactctttggtaaacgtctcctatcaggccactggaacgtaacggacgtttgcaacgggttactcggtgggtttgcggccataaccgcaggttgctccgtcgtagagccatgggcagcgattgtgtgcggcttcatggcttctgtcgtccttatcggatgcaacaagctcgcggagcttgtacaatatgatgatccactcgaggcagcccaactacatggagggtgtggcgcgtgggggttgatattcgtaggattgtttgccaaagagaagtatctaaacgaggtttatggcgccaccccgggaaggccatatggactatttatgggcggaggagggaagctgttgggagcacaattggttcaaatacttgtgattgtaggatgggttagtgccacaatgggaacactcttcttcatcctcaaaaggctcaatctgcttaggatctcggagcagcatgaaatgcaagggatggatatgacacgtcacggtggctttgcttatatctaccatgataatgatgatgagtctcatagagtggatcctggatctcctttccctcgatcagctactcctcctcgcgtttaa

SEQ ID NO: 2031 - protein, 498 aa, Arabidopsis thaliana
MSGAITCSAADLATLLGPNATAAADYICGQLGTVNNKFTDAAFAIDNTYLLFSAYLVFAMQLGFAMLCAGSVRAKNTMNIMLTNVLDAAAGGLFYYLFGYAFAFGGSSEGFIGRHNFALRDFPTPTADYSFFLYQWAFAIAAAGITSGSIAERTQFVAYLIYSSFLTGFVYPVVSHWFWSPDGWASPFRSADDRLFSTGAIDFAGSGVVHMVGGIAGLWGALIEGPRRGRFEKGGRAIALRGHSASLVVLGTFLLWFGWYGFNPGSFTKILVPYNSGSNYGQWSGIGRTAVNTTLSGCTAALTTLFGKRLLSGHWNVTDVCNGLLGGFAAITAGCSVVEPWAAIVCGFMASVVLIGCNKLAELVQYDDPLEAAQLHGGCGAWGLIFVGLFAKEKYLNEVYGATPGRPYGLFMGGGGKLLGAQLVQILVIVGWVSATMGTLFFILKRLNLLRISEQHEMQGMDMTRHGGFAYIYHDNDDESHRVDPGSPFPRSATPPRV

SEQ ID NO: 2032 - DNA, 1506 bp, Arabidopsis thaliana
  CDS (1)..(1506)
atgtcttgctcggccaccgatctcgctgtcctgttgggtcctaatgccacggcggcggccaactacatctgtggccagttaggcgacgtcaacaacaaatttatcgacaccgctttcgctatagacaacacttaccttctcttctccgcctaccttgtcttctctatgcagcttggcttcgctatgctctgtgccggttccgtgagagccaagaatactatgaacatcatgcttaccaacgtccttgacgctgcagccggtggtctcttctattatctgtttggctacgcctttgcctttggatctccgtccaatggtttcatcggtaaacactactttggtctcaaagacatccccacggcctctgctgactactccaactttctctaccaatgggcctttgcaatcgctgcggctggaatcacaagtggctcgatcgctgaacggacacagttcgtggcttacctaatctattcctctttcttaaccgggtttgtttacccggtcgtctctcactggttctggtcagttgatggatgggccagcccgttccgtaccgatggagatttgcttttcagcaccggagcgatagatttcgctgggtccggtgttgttcatatggtcggaggtatcgctggactctggggtgcgctcatcgaaggtccacgacttggccggttcgataacggaggccgtgccatcgctcttcgtggccactcggcgtcacttgttgtccttggaacattcctcctctggtttggatggtacggatttaaccccggttccttcaacaagatcctagtcacgtacgagacaggcacatacaacggccagtggagcgcggtcggacggacagctgtcacaacaacgttagctggctgcaccgcggcgctgacaaccctatttgggaaacgtctactctcgggacattggaacgtcactgatgtatgcaacggcctcctcggagggtttgcagccataactggtggctgctctgtcgttgagccatgggctgcgatcatctgcgggttcgtggcggccctagtcctcctcggatgcaacaagctcgctgagaagctcaaatacgacgaccctcttgaggcagcacaactacacggtggttgcggtgcgtggggactaatattcacggctctcttcgctcaagaaaagtacttgaaccagatttacggcaacaaacccggaaggccacacggtttgtttatgggcggtggaggaaaactacttggagctcagctgattcagatcattgtgatcacgggttgggtaagtgcgaccatggggacacttttcttcatcctcaagaaaatgaaattgttgcggatatcgtccgaggatgagatggccggtatggatatgaccaggcacggtggttttgcttatatgtactttgatgatgatgagtctcacaaagccattcagcttaggagagttgagccacgatctccttctccttctggtgctaatactacacctactccggtttga

SEQ ID NO: 2033 - protein, 501 aa, Arabidopsis thaliana
MSCSATDLAVLLGPNATAAANYICGQLGDVNNKFIDTAFAIDNTYLLFSAYLVFSMQLGFAMLCAGSVRAKNTMNIMLTNVLDAAAGGLFYYLFGYAFAFGSPSNGFIGKHYFGLKDIPTASADYSNFLYQWAFAIAAAGITSGSIAERTQFVAYLIYSSFLTGFVYPVVSHWFWSVDGWASPFRTDGDLLFSTGAIDFAGSGVVHMVGGIAGLWGALIEGPRLGRFDNGGRAIALRGHSASLVVLGTFLLWFGWYGFNPGSFNKILVTYETGTYNGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAWGLIFTALFAQEKYLNQIYGNKPGRPHGLFMGGGGKLLGAQLIQIIVITGWVSATMGTLFFILKKMKLLRISSEDEMAGMDMTRHGGFAYMYFDDDESHKAIQLRRVEPRSPSPSGANTTPTPV

SEQ ID NO: 2034 - DNA, 1515 bp, Arabidopsis thaliana
  CDS (1)..(1515)
atggcgtcggctctctcttgctctgcctctgatctgattccattactatcaggtggagccaacgccaccgcagcagcagccgccgctgaatacatctgcgggagattcgacacagtcgccgggaaattcactgatgcggcttacgcaatcgacaacacttaccttctcttctctgcttacctcgttttcgcgatgcagctcggtttcgccatgctctgtgccggatccgtacgtgcaaaaaacacgatgaacattatgctcacgaacgtcatcgacgctgcagccggaggtctcttctattatctcttcggtttcgcttttgcttttggatctccttctaatggattcatcggaaaacatttctttggaatgtatgattttcctcaacctacgtttgattatccttattttctatatcaatggactttcgctatcgccgccgctggaatcacgagtggttcgatagcggagaggactcagttcgttgcgtatttgatctattcttctttcttgacgggtcttgtttacccgattgtgtcgcattggttttggtcttctgatggttgggcgtctccggctagatctgagaaccttctgtttcaatcaggtgtgattgatttcgctggctctggtgttgttcatatggttggtggtattgctggtttatggggagctttaattgaaggacctaggattggtcggtttggagttgggggtaaaccggttacgttgcgtggtcatagtgctacgttggttgttcttggaacgtttttgttatggttcggatggtacgggtttaacccgggctcgtttgcaactatttttaaggcgtatggggagactccagggagctcgttttacggacaatggagcgcagttgggagaaccgcggtaacaactacgttagctggttgcacggcggcgttaacgactctgtttgggaaaagacttattgatgggtattggaatgtaactgatgtttgcaatggtttgttaggcgggtttgcggctataactagcggatgttcggttgtggaaccgtgggctgcgcttgtatgtgggtttgtagccgcatgggtgctgatgggatgcaatagactagcggaaaagctccaatttgatgatccgttggaagcggctcagcttcacggtggttgtggtgcgtgggggattattttcaccgggttgttcgcggagaaaagatacattgccgagatctttggaggcgacccgaataggcctttcggattgctaatgggaggaggaggtaggttgcttgcggcgcacgtcgttcagattttggtgattacgggttgggttagtgtgacaatggggactctgttttttattttgcataagctgaaactgttgaggataccggcggaggatgagatagctggggtggatccgacgagtcacggagggttggcttatatgtacacagaagatgagattaggaatgggatcatggttaggagagtgggtggtgataatgatcccaatgtaggtgtttga

SEQ ID NO: 2035 - protein, 504 aa, Arabidopsis thaliana
MASALSCSASDLIPLLSGGANATAAAAAAEYICGRFDTVAGKFTDAAYAIDNTYLLFSAYLVFAMQLGFAMLCAGSVRAKNTMNIMLTNVIDAAAGGLFYYLFGFAFAFGSPSNGFIGKHFFGMYDFPQPTFDYPYFLYQWTFAIAAAGITSGSIAERTQFVAYLIYSSFLTGLVYPIVSHWFWSSDGWASPARSENLLFQSGVIDFAGSGVVHMVGGIAGLWGALIEGPRIGRFGVGGKPVTLRGHSATLVVLGTFLLWFGWYGFNPGSFATIFKAYGETPGSSFYGQWSAVGRTAVTTTLAGCTAALTTLFGKRLIDGYWNVTDVCNGLLGGFAAITSGCSVVEPWAALVCGFVAAWVLMGCNRLAEKLQFDDPLEAAQLHGGCGAWGIIFTGLFAEKRYIAEIFGGDPNRPFGLLMGGGGRLLAAHVVQILVITGWVSVTMGTLFFILHKLKLLRIPAEDEIAGVDPTSHGGLAYMYTEDEIRNGIMVRRVGGDNDPNVGV

SEQ ID NO: 2036 - DNA, 1494 bp, Oryza sativa
  CDS (1)..(1494)
atggcgtcgccgacccggccggggccgtacatgccgcgcccaccggcggtgccggagtggctgaacaccggggacaacgggtggcagctcgcggcggcgacgttcgtcgggctccagtcgatgcctgggctggtggtgctgtacggcagcatcgtgaagaagaagtgggccgtcaactcggccttcatggcgctgtacgcgtacgcgtccacgctcatcgtgtgggtgctggtcggcttccgcatggcgttcggcgaccggctgctcccgttctgggggaaggccggcgcggcgctgacggaggggttcctcgtggcgcgcgcgtcggtcccggccacggcgcactacgggaaggacggcgccctggagtcgccgcgcaccgagccgttctacccggaggcgtccatggtgctgttccagttcgagctcgccgccatcacgctggtgctgctcgccgggtcgctcctcgggaggatgaacatcaaggcgtggatggcgttcactccgctctggctcctcttctcctacaccgtctgcgccttcagcctctggggcggcggcttcctctaccagtggggcgtcatcgactactccggcggatacgtcatccacctctcctccggcatcgccggcttcaccgccgcctactgggtggggccgaggctgaagagcgacagggagcggttctcgccgaacaacatcctcctcatgatcgccggcggcgggctgctgtggctgggctgggccgggttcaacggcggcgcgccgtacgccccaaacatcaccgcgtccatcgccgtgctcaacaccaacgtcagcgccgcggcgagcctcctcacctggacctgcctcgacgtcatcttcttcggcaagccctccgtcatcggcgccgtgcagggcatgatgaccggtctcgtctgcatcacccccggcgcaggtctggtgcacacgtgggcggccatactgatgggcatctgtggcggcagcttgccgtggttctccatgatgatcctccacaagagatcggcgctgctccagaaggtggacgacaccctcgccgtcttccacacccacgccgtcgcgggcctcctcggcggcttcctcacgggcctgttcgccttgccggacctcaccgccgtccacacccacatccctggcgcgcgcggcgcgttctacggcggcggcatcgcccaggtggggaagcagatcgccggcgcgctcttcgtcgtcgtgtggaacgtcgtggccaccaccgtcatcctgctcggcgtcggcctcgtcgtcccgctccgcatgcccgacgagcagctcaagatcggcgacgacgcggcgcacggggaggaggcctacgcgctatggggagacggcgagaggttcgacgtgacgcgccatgagggggcgaggggcggcgcgtggggcgccgcggtcgtggacgaggcgatggatcaccggctggccggaatgggagcgagaggagtcacgattcagctgtag

SEQ ID NO: 2037 - protein, 497 aa, Oryza sativa
MASPTRPGPYMPRPPAVPEWLNTGDNGWQLAAATFVGLQSMPGLVVLYGSIVKKKWAVNSAFMALYAYASTLIVWVLVGFRMAFGDRLLPFWGKAGAALTEGFLVARASVPATAHYGKDGALESPRTEPFYPEASMVLFQFELAAITLVLLAGSLLGRMNIKAWMAFTPLWLLFSYTVCAFSLWGGGFLYQWGVIDYSGGYVIHLSSGIAGFTAAYWVGPRLKSDRERFSPNNILLMIAGGGLLWLGWAGFNGGAPYAPNITASIAVLNTNVSAAASLLTWTCLDVIFFGKPSVIGAVQGMMTGLVCITPGAGLVHTWAAILMGICGGSLPWFSMMILHKRSALLQKVDDTLAVFHTHAVAGLLGGFLTGLFALPDLTAVHTHIPGARGAFYGGGIAQVGKQIAGALFVVVWNVVATTVILLGVGLVVPLRMPDEQLKIGDDAAHGEEAYALWGDGERFDVTRHEGARGGAWGAAVVDEAMDHRLAGMGARGVTIQL

SEQ ID NO: 2038 - DNA, 1506 bp, Oryza sativa
  CDS (1)..(1506)
atgcacctaaggatggcgtcgccgccgcagcccgggccgtacatgccggacctgccggcggtgccggcgtggctgaacaagggcgacaccgcgtggcagctggtggcggcgacgttcgtcggcatccagtcgatgcctgggctggtggtgatctacggcagcatcgtgaagaagaagtgggccgtcaactccgccttcatggcgctgtacgcctacgcgtccacgcttatcgtgtgggtgctcgtcggcttccgcatggcgttcggcgaccggctgctcccgttctgggccaaggccgggccggcgctgacgcaggacttcctggtgcaacgcgcggtgttcccggcgacggcgcactacggcagcgacggcacgctcgagacgccgcgcaccgagccgttctacgcggaggcggcgctggtgctgttcgagttcgagttcgcggccatcacgctggtgctgctcgccgggtcgctcctggggcggatgaacatcaaggcgtggatggcgttcaccccgctctggctcctcttctcctacaccgtcggcgcgttcagcctctggggcggcggcttcctctaccagtggggcgtcatcgactactccggcggatacgtcatccacctctcctccggcgtcgccggcttcaccgccgcctactgggtgggcccgaggctgaagagcgacagggagcggttctcgccgaacaacatcctgctcatgatcgccggcggcgggctgctgtggttgggctgggccgggttcaacggcggcgcgccgtacgcccccaacgtcaccgccacggtcgccgtgctcaacaccaacgtcagcgccgcgacgagcctcctcacctggacctgcctcgacgtcatcttcttcggcaagccctccgtcatcggcgccgtgcagggtatgatgacggggctcgtctgcatcacgcccggcgccgggctggtgcacacgtggtcagcgatgctgatgggcatgttcgccggcagcgtcccgtggttcacgatgatgatcctgcacaagaaatccaccttcctcatgaaggtcgacgacaccctcgccgtcttccacacccacgccgtcgccggcatcctgggcggcgtcctcacgggcctcctcgccacgccggagctctgcgctctcgattgcccgatcccgaacatgcgcggcgtcttctacggcagcggcatcggccagctcgggaagcagctcggcggcgcgctgttcgtcaccgtctggaacctcatcgtcaccagcgccattctcctctgcatcggcctcttcatcccgctccgcatgtccgacgaccagctcatgatcggcgacgacgcggcgcacggggaggaggcctacgctctgtggggggacggtgagaagttcgacgtgacgcggccggagacgacgaggacgggaggtgcaggcggcgcgggcagggaggacaccatggagcagaggctgaccaacatgggagccaggggtgtcaccattcagttgtag

SEQ ID NO: 2039 - protein, 501 aa, Oryza sativa
MHLRMASPPQPGPYMPDLPAVPAWLNKGDTAWQLVAATFVGIQSMPGLVVIYGSIVKKKWAVNSAFMALYAYASTLIVWVLVGFRMAFGDRLLPFWAKAGPALTQDFLVQRAVFPATAHYGSDGTLETPRTEPFYAEAALVLFEFEFAAITLVLLAGSLLGRMNIKAWMAFTPLWLLFSYTVGAFSLWGGGFLYQWGVIDYSGGYVIHLSSGVAGFTAAYWVGPRLKSDRERFSPNNILLMIAGGGLLWLGWAGFNGGAPYAPNVTATVAVLNTNVSAATSLLTWTCLDVIFFGKPSVIGAVQGMMTGLVCITPGAGLVHTWSAMLMGMFAGSVPWFTMMILHKKSTFLMKVDDTLAVFHTHAVAGILGGVLTGLLATPELCALDCPIPNMRGVFYGSGIGQLGKQLGGALFVTVWNLIVTSAILLCIGLFIPLRMSDDQLMIGDDAAHGEEAYALWGDGEKFDVTRPETTRTGGAGGAGREDTMEQRLTNMGARGVTIQL

SEQ ID NO: 2040 - DNA, 1497 bp, Oryza sativa
  CDS (1)..(1497)
atgtcgggggacgcgttcaacatgtcggtggcgtaccagccgtcggggatggcggtgccggagtggctgaacaagggcgacaacgcgtggcagatgatctcggcgacgctggtggggatgcagagcgtgccggggctggtgatcctgtacggcagcatcgtgaagaagaagtgggcggtgaactcggcgttcatggcgctctacgccttcgccgccgtgtggctgtgctgggtcacctggggctacaacatgtcgttcggccacaagctcctcccgttctggggcaaggcgcggccggcgctgggccagagcttcctcctcgcccaggccgtgctcccgcagacgacgcagttctacaagggcggcggcggcgccgacgccgtggtggagacgccatgggtgaacccgctctacccgatggccaccatggtgtacttccagtgcgtgttcgccgccatcacgctcatcctcctcgccggctcgctgctggggcggatgaacatcaaggcgtggatgctgttcgtcccgctctggctcaccttctcctacaccgtcggcgccttctcgctgtggggcggcggcttcctcttccactggggggtcatggactactccggcggctacgtcatccacctctcgtcgggtgtcgccggcttcaccgcggcgtactgggtggggcccaggtcgaccaaggacagggagaggttcccgccaaacaacgtgctgctcatgctcaccggcgccggcatactgtggatggggtgggcggggttcaacggcggcgacccgtactccgccaacatcgactcctcgctcgccgtgctcaacaccaacatctgcgccgccaccagcctcctcgtctggacttgcctcgacgtcatcttcttcaagaagccgtccgtcatcggcgccgtccagggcatgatcaccggcctcgtctgcatcactcccggcgcaggcctggtgcagggttgggcggcgatcgtgatgggcatcctctccggcagcatcccgtggttcacgatgatggtggtgcacaagcggtcgcgcctcctgcagcaggtggacgacaccctgggcgtcttccacacccacgccgtcgccggattcctcggcggcgccaccacgggcctcttcgccgagcccgtcctctgctccctcttcctccccgtcaccaactcccgcggcgccttctaccccggccgcggcggcggcctccagttcgtccgccaggtggccggcgccctcttcatcatctgctggaacgtggtggtcaccagcctcgtctgcctcgccgtccgcgccgtggttcccctccggatgcccgaggaggagctcgccatcggcgacgacgccgtgcacggggaggaggcgtacgcgctgtggggcgacggcgagaagtacgactccaccaagcacggatggtactccgacaacaacgacacgcaccacaacaacaacaaggccgcgcccagcggcgtcacgcagaacgtctga

SEQ ID NO: 2041 - protein, 498 aa, Oryza sativa
MSGDAFNMSVAYQPSGMAVPEWLNKGDNAWQMISATLVGMQSVPGLVILYGSIVKKKWAVNSAFMALYAFAAVWLCWVTWGYNMSFGHKLLPFWGKARPALGQSFLLAQAVLPQTTQFYKGGGGADAVVETPWVNPLYPMATMVYFQCVFAAITLILLAGSLLGRMNIKAWMLFVPLWLTFSYTVGAFSLWGGGFLFHWGVMDYSGGYVIHLSSGVAGFTAAYWVGPRSTKDRERFPPNNVLLMLTGAGILWMGWAGFNGGDPYSANIDSSLAVLNTNICAATSLLVWTCLDVIFFKKPSVIGAVQGMITGLVCITPGAGLVQGWAAIVMGILSGSIPWFTMMVVHKRSRLLQQVDDTLGVFHTHAVAGFLGGATTGLFAEPVLCSLFLPVTNSRGAFYPGRGGGLQFVRQVAGALFIICWNVVVTSLVCLAVRAVVPLRMPEEELAIGDDAVHGEEAYALWGDGEKYDSTKHGWYSDNNDTHHNNNKAAPSGVTQNV

SEQ ID NO: 2042 - DNA, 1443 bp, Oryza sativa
  CDS (1)..(1443)
atggcggctggagcgattccaatggcgtaccagaccactccgtcatcgccagactggctgaacaagggcgacaacgcatggcagatgacatcggcgaccctcgtcggcctgcagagcatgccagggctggtgatcctgtacggcagcattgtcaagaagaagtgggctatcaactcggcgttcatggcgctgtatgccttcgctgctgtctggatctgctgggttgtctgggcatacaacatgtcgttcggcgaccgcctcctgccattctggggtaaggcacggccagcgctcgggcagagcttcctcgtggcgcagtctgagctcactgctaccgctattcgctaccacaatgggtcagctgaggcgcccatgctcaagccgttgtacccagtcgccaccatggtgtacttccagtgcatgtttgcgagcatcaccatcatcatcctcgcaggctcactgcttgggcgcatgaacatcaaggcgtggatggcctttgtgccgctctggatcaccttctcttacacggtctgcgccttctcgctctggggtggcggtttcctcttccagtggggtgtcatagactactctggtggctatgtcatccatctctcttctggcatcgcaggcctcactgctgcctactgggttggaccaaggtcagcatcagatagggagagattcccgcccaacaacatactgctggtgctagcaggggcggggctgctgtggcttgggtggacaggtttcaatggaggagacccatattcagccaatattgattcatccatggcagtgctcaacacacatatctgcgcatccaccagcctactcgtgtggacaatcctggatgtcttcttcttcgggaagccatcggtaattggcgcggtgcagggcatgatcactggcctggtatgcatcacccctggtgcaggcctggtgcaaggttgggcagctattgtgatgggaattctctctggtagcattccatggtacaccatgatggtgctgcacaagaaatggtcattcatgcagaggattgatgacacgcttggtgtcttccacacccatgcggtggctgggttccttggtggcgccaccactggactcttcgccgagcccatcctatgcagtctcttcctatctatcccagattctaaaggtgcattctacggtggccccggtggatcacagttcgggaagcagattgctggcgcactatttgtcactgcctggaatattgttatcacctccatcatctgtgtcatcatcagcctaatcctgcccctccgtatagctgatcaagaactgcttattggagatgatgctgtacacggtgaggaggcatatgctatctgggcagagggagagctcaatgacatgacccaccacaatgagagcacacatagtggtgtctctgtaggagtgacacagaatgtttga

SEQ ID NO: 2043 - protein, 480 aa, Oryza sativa
MAAGAIPMAYQTTPSSPDWLNKGDNAWQMTSATLVGLQSMPGLVILYGSIVKKKWAINSAFMALYAFAAVWICWVVWAYNMSFGDRLLPFWGKARPALGQSFLVAQSELTATAIRYHNGSAEAPMLKPLYPVATMVYFQCMFASITIIILAGSLLGRMNIKAWMAFVPLWITFSYTVCAFSLWGGGFLFQWGVIDYSGGYVIHLSSGIAGLTAAYWVGPRSASDRERFPPNNILLVLAGAGLLWLGWTGFNGGDPYSANIDSSMAVLNTHICASTSLLVWTILDVFFFGKPSVIGAVQGMITGLVCITPGAGLVQGWAAIVMGILSGSIPWYTMMVLHKKWSFMQRIDDTLGVFHTHAVAGFLGGATTGLFAEPILCSLFLSIPDSKGAFYGGPGGSQFGKQIAGALFVTAWNIVITSIICVIISLILPLRIADQELLIGDDAVHGEEAYAIWAEGELNDMTHHNESTHSGVSVGVTQNV

SEQ ID NO: 2044 - DNA, 1497 bp, Oryza sativa
  CDS (1)..(1497)
atggcgacgtgcttggacagcctcgggccgctgctcggcggcgcggcgaactccaccgacgcggccaactacatctgcaacaggttcacggacacctcctccgcggtggacgcgacgtacctgctcttctcggcctacctcgtgttcgccatgcagctcgggttcgccatgctctgcgcgggctccgtccgcgccaagaactccatgaacatcatgctcaccaacgtgctcgacgccgccgccggcgcgctcttctactacctcttcggcttcgccttcgcgttcgggacgccgtccaagggcttcatcgggaagcagttcttcgggctgaagcacatgccgcagacagggtacgactacgacttcttcctcttccagtgggccttcgccatcgccgccgccggcatcacgtccggttccatcgccgagcggacgcgcttcagcgcgtatctcatctactccgccttcctcaccgggttcgtgtacccggtggtgtcgcactggttctggtccaccgacgggtgggcttcggccggccggttgacgggtccgttgctgttcaagtcgggcgtcatcgacttcgccggctccggcgtcgtccatctggtcggtggcattgctggcctgtggggtgccttcatcgagggccctcgcatcgggcggttcgacgccgccggccgcacggtggcgatgaaagggcacagcgcctcactggtcgtgctcggcaccttcctgctgtggttcgggtggttcggcttcaacccggggtccttcaccaccatctccaagatctacggcgagtcgggcacgatcgacgggcagtggtcggcggtgggccgcaccgccgtgacgacgtcgctggcggggagcgtcgccgcgctgacgacgctctacggcaagagatggctgacggggcactggaacgtgaccgacgtctgcaacggtctcctcggcggcttcgccgcgatcaccgcgggctgctccgtggtcgacccgtgggcgtcggtgatctgcgggttcgtgtcggcgtgggtcctcatcggctgcaacaagctgtcgctgattctcaagttcgacgacccgctggaggcgacgcagctgcacgccgggtgcggcgcgtgggggatcatcttcaccgcgctgttcgcgcgcagggagtacgtcgagctgatctacggggtgccggggaggccgtacgggctgttcatgggcggcggcgggaggcttctcgcggcgcacatcgtgcagatcctggtgatcgtcgggtgggtcagcgccaccatggggacgctcttctacgtgctgcacaggttcgggctgctccgcgtctcgcccgcgacagagatggaaggcatggacccgacgtgccacggcgggttcgggtacgtggacgaggacgaaggcgagcgccgcgtcagggccaagtcggcggcggagacggctcgcgtggagcccagaaagtcgccggagcaagccgcggcgggccagtttgtgtag

SEQ ID NO: 2045 - protein, 498 aa, Oryza sativa
MATCLDSLGPLLGGAANSTDAANYICNRFTDTSSAVDATYLLFSAYLVFAMQLGFAMLCAGSVRAKNSMNIMLTNVLDAAAGALFYYLFGFAFAFGTPSKGFIGKQFFGLKHMPQTGYDYDFFLFQWAFAIAAAGITSGSIAERTRFSAYLIYSAFLTGFVYPVVSHWFWSTDGWASAGRLTGPLLFKSGVIDFAGSGVVHLVGGIAGLWGAFIEGPRIGRFDAAGRTVAMKGHSASLVVLGTFLLWFGWFGFNPGSFTTISKIYGESGTIDGQWSAVGRTAVTTSLAGSVAALTTLYGKRWLTGHWNVTDVCNGLLGGFAAITAGCSVVDPWASVICGFVSAWVLIGCNKLSLILKFDDPLEATQLHAGCGAWGIIFTALFARREYVELIYGVPGRPYGLFMGGGGRLLAAHIVQILVIVGWVSATMGTLFYVLHRFGLLRVSPATEMEGMDPTCHGGFGYVDEDEGERRVRAKSAAETARVEPRKSPEQAAAGQFV

SEQ ID NO: 2046 - DNA, 1491 bp, Oryza sativa
  CDS (1)..(1491)
atggcaacgtgcgcggataccctcggcccgctgctgggcacggcggcggcgaacgcgacggactacctgtgcaaccagttcgcggacacgacgtcggccgtggactcgacgtacctgctcttctcggcgtacctcgtgttcgccatgcagctcggcttcgccatgctctgcgccgggtccgtccgcgccaagaacaccatgaacatcatgcttaccaacgtgctcgacgccgccgccggcgcgctcttctactacctcttcggcttcgccttcgccttcggggcgccgtccaacggcttcatcgggaagcacttcttcggcctcaagcaggtcccacaggtcggcttcgactacagcttcttcctcttccagtgggccttcgccatcgccgccgcgggcatcacgtccggctccatcgccgagcggacccagttcgtggcgtacctcatctactccgccttcctcaccggcttcgtctacccggtggtgtcccactggatctggtccgccgacgggtgggcctcggcttcccggacgtcggggtcgctgctcttcgggtccggcgtcatcgacttcgccgggtcaggggttgtccacatggtgggcggcgtggccggactctggggcgccctcatcgagggcccccgcattgggcggttcgaccacgccggccgctcggtggcgctgcgcggccacagcgcgtcgctcgtcgtgctcggcagcttccttctgtggttcgggtggtacgggtttaaccccggctcgttcctcaccatcctcaaatcctacggcccgcccggtagcatccacgggcagtggtcggcggtgggacgcaccgccgtgaccaccaccctcgccggcagcacggcggcgctcacgacgctcttcgggaagaggctccagacggggcactggaacgtgatcgacgtctgcaacggcctcctcggcggcttcgcggcgatcaccgccggttgctccgtcgtcgacccgtgggccgcgatcatctgcgggttcgtctcggcgtgggtgctcatcggcctcaacgcgctggcggcgaggctcaagttcgacgacccgctcgaggcggcgcagctgcacggcgggtgcggcgcgtggggggtcatcttcacggcgctgttcgcgcgcaaggagtacgtggaccagatcttcggccagcccgggcgcccgtacgggctgttcatgggcggcggcggccggctgctcggggcgcacatagtggtcatcctggtcatcgcggcgtgggtgagcttcaccatggcgccgctgttcctggtgctcaacaagctgggcttgctgcgcatctcggccgaggacgagatggccggcatggaccagacgcgccacggcgggttcgcgtacgcgtaccacgacgacgacgcgagcggcaagccggaccgcagcgtcggcgggttcatgctcaagtcggcgcacggcacgcaggtcgccgccgagatgggaggccatgtctag

SEQ ID NO: 2047 - protein, 496 aa, Oryza sativa
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVGGVAGLWGALIEGPRIGRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSVGGFMLKSAHGTQVAAEMGGHV

SEQ ID NO: 2048 - DNA, 1440 bp, Oryza sativa
  CDS (1)..(1440)
atgtcgtcgtcggcgacggtggtgccgctggcgtaccaggggaacacgtcggcgtcggtggcggactggctgaacaagggcgacaacgcgtggcagctggtggcggcgacggtggtggggctgcagagcgtgccgggcttggtggtgctgtacggcggcgtggtgaagaagaagtgggcggtgaactcggcgttcatggcgctctacgccttcgccgccgtgtggatctgctgggtcacctgggcgtacaacatgtcgttcggggagaagctcctcccgatctgggggaaggcgcggccggcgctggaccagggcctcctcgtcggccgcgccgcgctgccggcgacggtccactaccgcgccgacggcagcgtggagacggcggcggtggagccgctgtacccgatggcgacggtggtgtacttccagtgcgtgttcgccgccatcaccctcatcctcgtcgccggctccctcctcggccgcatgagcttcctcgcctggatgatcttcgtcccgctctggctcaccttctcctacaccgtcggcgccttctccctctggggcggcggcttcctcttccactggggcgtcatcgactactgcggcggctacgtcatccacgtctccgccggcatcgccggcttcaccgccgcctactgggtggggccaagggcacagaaggacagggagaggttcccgccgaacaacatactgttcacgctgacgggggcagggttactatggatggggtgggcagggttcaacggcggtggtccgtacgccgccaactccgtcgcctccatggccgtcctcaacaccaacatctgcaccgccatgagcctcatcgtctggacatgcctcgacgtcatcttcttcaagaagccctccgtcgtcggcgccgtccagggcatgatcaccggcctcgtctgcatcacccccgctgcaggggtggtgcaggggtgggcggcgctggtgatgggggtgctcgccggcagcatcccgtggtacaccatgatgatcctccacaagcgctccaagatcctgcagcgcgtcgacgacaccctcggcgtcttccacacccacggcgtcgccggcctcctcggcggcctcctcaccggcctcttcgccgagcccaccctctgcaacctcttcctccccgtcgccgactcccggggcgccttctacggcggcgccggcggcgcccagttcggcaagcagatcgccggtggcctcttcgtcgtcgcctggaacgtcgccgtcacctccctcatctgcctcgccatcaacctcctcgtcccgctccgcatgcccgacgacaagctcgaggtcggcgacgacgccgtccacggcgaggaggcctacgcgctctggggcgacggcgagatgtacgacgtcaccaagcacggctccgacgccgccgttgcgcccgtcgtcgtatga

SEQ ID NO: 2049 - protein, 479 aa, Oryza sativa
MSSSATVVPLAYQGNTSASVADWLNKGDNAWQLVAATVVGLQSVPGLVVLYGGVVKKKWAVNSAFMALYAFAAVWICWVTWAYNMSFGEKLLPIWGKARPALDQGLLVGRAALPATVHYRADGSVETAAVEPLYPMATVVYFQCVFAAITLILVAGSLLGRMSFLAWMIFVPLWLTFSYTVGAFSLWGGGFLFHWGVIDYCGGYVIHVSAGIAGFTAAYWVGPRAQKDRERFPPNNILFTLTGAGLLWMGWAGFNGGGPYAANSVASMAVLNTNICTAMSLIVWTCLDVIFFKKPSVVGAVQGMITGLVCITPAAGVVQGWAALVMGVLAGSIPWYTMMILHKRSKILQRVDDTLGVFHTHGVAGLLGGLLTGLFAEPTLCNLFLPVADSRGAFYGGAGGAQFGKQIAGGLFVVAWNVAVTSLICLAINLLVPLRMPDDKLEVGDDAVHGEEAYALWGDGEMYDVTKHGSDAAVAPVVV

SEQ ID NO: 2050 - DNA, 1497 bp, Oryza sativa
  CDS (1)..(1497)
atggcgacgtgcgcggcggacctggcgccgctgctggggccggtggcggcgaacgcgacggactacctgtgcaaccggttcgccgacacgacgtcggcggtggacgcgacgtacctgctcttctcggcgtacctcgtgttcgccatgcagctcgggttcgcgatgctctgcgccgggtcggtgcgggccaagaacacgatgaacatcatgctcaccaacgtgctcgacgccgcggccggggcgctcttctactacctcttcggcttcgccttcgccttcggcacgccgtccaacggcttcatcgggaagcagttcttcggcctcaagcacatgccgcagaccgggttcgactacgacttcttcctcttccagtgggccttcgccatcgccgccgccgggatcacgtcgggctccatcgccgagaggacgcagttcgtcgcctacctcatctactccgccttcctcaccgggttcgtctacccggtggtgtcccactggatctggtccgccgatgggtgggcctctgcctcccgcacgtccggacctctgctgttcggctccggtgtcatcgacttcgccggctccggcgtcgtccacatggtcggcggtgtcgccgggctctggggcgcgctcatcgagggcccccgcatcgggaggttcgaccacgccggccgatcggtggcgctcaagggccacagcgcgtcgctcgtcgtgcttggcaccttcctgctgtggttcggctggtacggattcaaccccgggtcgttcaccaccatcctcaagacgtacggcccggccggcggcatcaacgggcagtggtccggagtcggccgcaccgccgtgacgacgaccctggccggcagcgtggcggcgctcaccacgctgttcgggaagcggctccagacggggcactggaacgtggtcgacgtctgcaacggcctcctcggcgggttcgccgccatcaccgccgggtgcagcgtcgtcgacccgtgggccgcgatcatctgcgggttcgtctcggcgtgggtgctcatcggcctcaacgcgctcgccgcgcgcctcaagttcgacgacccgctcgaggccgcccagctccacggcgggtgcggcgcgtgggggatcctcttcaccgcgctcttcgcgaggcagaagtacgtcgaggagatctacggcgccggccggccgtacggcctgttcatgggcggcggcggcaagctgctcgccgcgcacgtcatccagatcctggtcatcttcgggtgggtcagctgcaccatgggacctctcttctacgggctcaagaagctcggcctgctccgcatctccgccgaggacgagacgtccggcatggacctgacacggcacggcgggttcgcgtacgtctaccacgacgaggacgagcacgacaagtctggggttggtgggttcatgctccggtccgcgcagacccgcgtcgagccggcggcggcggctgcctccaacagcaacaaccaagtgtaa

SEQ ID NO: 2051 - protein, 498 aa, Oryza sativa
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAAASNSNNQV

SEQ ID NO: 2052 - DNA, 1461 bp, Oryza sativa
  CDS (1)..(1461)
atggcggcggcgggggcgtactcggcgagcctaccggcggtgccggactggctgaacaagggggacaacgcgtggcagctgacggcgtcgacgctggtggggatccagtcgatgcccgggctggtggtgctgtacggcagcatcgtgaagaagaagtgggcggtgaactcggcgttcatggcgctctacgcctacgcgtcgtcgctgctggtgtgggtgctggtcggcttccgcatggcgttcggcgaccagctgctgccgttctggggcaaggccggcgtggcgctgacccagagctacctcgtcggccgcgccacgctgccggccaccgcgcacggcgccatcccgcgcaccgagcccttctacccggaggccacgctggtgctcttccagttcgagttcgccgccatcacgctcgtcctcctcgccggctccgtcctcggccgcatgaacatcaaggcctggatggccttcaccccgctctggctcctcctctcctacaccgtcggcgccttcagcctctggggcggcggcttcctctaccgctggggcgtcatcgactactccggcggctacgtcatccacctctcctccggcatcgccggcttcaccgccgcctactgggtggggccaaggctgaagagcgaccgtgagcggttctcaccgaacaacatcctgctgatgatcgcgggcggcgggctgctgtggatggggtgggccgggttcaacggcggcgcgccgtacgccgccaacatcgcggcgtcggtcgccgtgctcaacaccaacgtctgcgccgccaccagcctcctcatgtggacctgcctcgacgtcatcttcttccgcaagccgtccgtcatcggcgccgtgcagggcatgatgaccggcctcgtctgcatcacccccggcgcagggctggtgcagacctgggcggccgtggtaatgggcatcttcgccggcagcgtgccgtggttcaccatgatgatcctgcacaagaagtcagcgctgctgatgaaggtggacgacacgctcgccgtgttccacacccacgccgtggcggggctcctcggcggcatcctcacgggcctcctggccaccccggagctcttctccctcgagtccacggtgccgggactccgcggcgcgttctacggcggcggtatcaagcagatcggcaagcagctcggcggcgccgcgttcgtgatcgcgtggaacctcgtggtcaccacggccatcctcctcggcatcggcctgttcatcccgctgcggatgcccgacgagcagctcatgatcggcgacgacgcggcgcacggcgaggaggcctacgcgctgtggggcgacggcgagaagttcgacgcgacgcggcacgacctgtcgaggggcggcggaggcggcgacagggacggccccgccggcgagcgcctctccgccctaggcgccaggggcgtcaccatccagctctag

SEQ ID NO: 2053 - protein, 486 aa, Oryza sativa
MAAAGAYSASLPAVPDWLNKGDNAWQLTASTLVGIQSMPGLVVLYGSIVKKKWAVNSAFMALYAYASSLLVWVLVGFRMAFGDQLLPFWGKAGVALTQSYLVGRATLPATAHGAIPRTEPFYPEATLVLFQFEFAAITLVLLAGSVLGRMNIKAWMAFTPLWLLLSYTVGAFSLWGGGFLYRWGVIDYSGGYVIHLSSGIAGFTAAYWVGPRLKSDRERFSPNNILLMIAGGGLLWMGWAGFNGGAPYAANIAASVAVLNTNVCAATSLLMWTCLDVIFFRKPSVIGAVQGMMTGLVCITPGAGLVQTWAAVVMGIFAGSVPWFTMMILHKKSALLMKVDDTLAVFHTHAVAGLLGGILTGLLATPELFSLESTVPGLRGAFYGGGIKQIGKQLGGAAFVIAWNLVVTTAILLGIGLFIPLRMPDEQLMIGDDAAHGEEAYALWGDGEKFDATRHDLSRGGGGGDRDGPAGERLSALGARGVTIQL

SEQ ID NO: 2054 - DNA, 1377 bp, Oryza sativa
  CDS (1)..(1377)
atggcgtcggtggcggtgccggagtggctgaacaagggcgacaacgcctggcagatgctctccgccacgctcgtcgccctgcagggcttccccggtctcgccctcttctacgccggcgccgtcacccgcaagtgcgcgctcacctccgcattcatggcgctctacgccatggccgccaccatgccgtgctgggcgctctgggcgcacaacatggccttcggccaccgcctcctgcccttcgtcggccgccccgccccggcgctcgcccagcactacatgctcacccaggcgctgctccccttcaccctccacctccactccaacggcgaggtggagacggccgcggtggcgccgctgtacccgtcggcgagcatggtgttcttccagtgggcctccgccggcgtcaccgtggggctggtcgccggcgccgtgctcgggcgcatgagcgtcaaggcgtggatggcgttcgtgccgctgtggacgacgctgtcctatacggtgggagcgtacagcatttggggcgggggcttcctcttccactggggcgtcatggactactccggcggctacgtcgttcacctcgccgccggcgtctccggctacacggccgcgtactgggtgggaccaaggaggaaggaggaggaggaaatgacaatggcgggtggtggcaacctggtggcgatggtggccggcgcgggcatcctgtggatggggtggaccggcttcaacggcggcgaccccttctccgccaacaccgactcgtcggtggcggtgctcaacacgcacatctgcaccaccaccagcatcctcgcttgggtttgctgcgacatcgccgtccgcgggaggccgtcggtggtgggcgcggtgcagggcatgatcaccggcctggtgtgcataactccggcggcagggctggtgcaggggtgggcagctctgctaatgggcgtcgcgtcggggacactgccatgctacaccatgaacgccgccatgtcgttcaaggtagacgacacgctgggcatcctgcacacccacgcggtgtccggtgttctgggcggcgtcctcaccggcgttttcgcgcaccctactctctgtgacatgttccttccggtgaccggctcaaggggcctcgtctacggcgtccgcgccggcggggtgcaggtgttgaagcaggtcgccgccgcattgttcgttgccgcatggaacgtggccgccacgtccatcatcttggtcgtcgtcagggcgttcgtgccgctgaggatgacggaagatgagctgctcgccggagacattgccgtacatggggaacaagcttattatttttcgagtggcaccaattgtagtttaagccatgagaccattgaggtcggaaattcataa

SEQ ID NO: 2055 - protein, 458 aa, Oryza sativa
MASVAVPEWLNKGDNAWQMLSATLVALQGFPGLALFYAGAVTRKCALTSAFMALYAMAATMPCWALWAHNMAFGHRLLPFVGRPAPALAQHYMLTQALLPFTLHLHSNGEVETAAVAPLYPSASMVFFQWASAGVTVGLVAGAVLGRMSVKAWMAFVPLWTTLSYTVGAYSIWGGGFLFHWGVMDYSGGYVVHLAAGVSGYTAAYWVGPRRKEEEEMTMAGGGNLVAMVAGAGILWMGWTGFNGGDPFSANTDSSVAVLNTHICTTTSILAWVCCDIAVRGRPSVVGAVQGMITGLVCITPAAGLVQGWAALLMGVASGTLPCYTMNAAMSFKVDDTLGILHTHAVSGVLGGVLTGVFAHPTLCDMFLPVTGSRGLVYGVRAGGVQVLKQVAAALFVAAWNVAATSIILVVVRAFVPLRMTEDELLAGDIAVHGEQAYYFSSGTNCSLSHETIEVGNS

SEQ ID NO: 2056 - DNA, 1512 bp, Brassica napus
  CDS (1)..(1512)
atgtcgggatctttatcttgctctgctgccgacctcgcagtcttgttaggccctaatgccacggctgcagctgactacatctgcggccaacttagcaccgttaacaacaaatttaccgacgttgctttcgccgtagacaacacataccttctcttctccgcttacctcgtcttctctatgcaactgggcttcgctatgctctgcgctggctctgtaagagccaagaacacgatgaacatcatgcttaccaacgtccttgacgctgcagctggaggtctcttctattatcttttcggttacgcctttgcctttggatctccctcaaacggcttcatcggaaaacacaaccttggtctcaaggactttccttcagcctccgccgactactctaactttctataccaatgggcttttgctatcgccgctgccggaatcaccagcggctccatcgctgaacggactcagtttgttgcatacctgatctattcatccttcttaacaggctttgtttacccagttgtttctcactggttctggtctgctgatgggtgggctagtccttttaggaccgacggagatctacttttcagcacaggagcaatcgatttcgctggctcgggtgttgttcacatggttggaggcatcgctggtctatggggtgcgttgatcgaaggtccacgacttggtcggtttgataacggtggacgagctatagccctacatggccactcggcctcactagttgtccttggaacattcctcctttggtttggatggtatggattcaaccctggttccttcaacaagatcctcgtcacttatgaatcaggcacgatcaacgggcagtggagcgctgtcggacggactgctgtcacaaccactttagctggctgcactgcggcgctcacaaccctcttcgggaaacgtcttctctcgggacactggaacgttactgacgtatgcaacggcctccttggagggtttgcagctataaccggtggctgttcggtcgtagagccttgggcggcgatcatctgcgggttcgtagcggccctggtactcctcgggtgcaacaagctcgcggagaaactcaaatacgatgacccgctcgaggcagcccagttacacggtgggtgcggagcctgggggctaatatttactgcactttttgctagagaaaagtacttgaaccagatctacggcgagaagcccggaaggccccacggtttgttcatgggcggtggaggaaaactgcttggagctcagcttattcaaatacttgttatcacaggttgggtaagtgcgaccatgggaacgcttttcttcatcctcaagaaaatgaaactgttgcgtatatctgctgaggatgagatggccggtatggatatgaccaggcatggtggctttgcttatatgtactatgatgatgatgagtctcacaaagccattcagctaaggaaagttgagcatagatctccttcaccttcgggtgttactaccacttctgtttga

SEQ ID NO: 2057 - protein, 503 aa, Brassica napus
MSGSLSCSAADLAVLLGPNATAAADYICGQLSTVNNKFTDVAFAVDNTYLLFSAYLVFSMQLGFAMLCAGSVRAKNTMNIMLTNVLDAAAGGLFYYLFGYAFAFGSPSNGFIGKHNLGLKDFPSASADYSNFLYQWAFAIAAAGITSGSIAERTQFVAYLIYSSFLTGFVYPVVSHWFWSADGWASPFRTDGDLLFSTGAIDFAGSGVVHMVGGIAGLWGALIEGPRLGRFDNGGRAIALHGHSASLVVLGTFLLWFGWYGFNPGSFNKILVTYESGTINGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAWGLIFTALFAREKYLNQIYGEKPGRPHGLFMGGGGKLLGAQLIQILVITGWVSATMGTLFFILKKMKLLRISAEDEMAGMDMTRHGGFAYMYYDDDESHKAIQLRKVEHRSPSPSGVTTTSV

SEQ ID NO: 2058 - DNA, 25 bp, Artificial sequence
  primer
atgtcttacaattttacaggtacgc

SEQ ID NO: 2059 - DNA, 26 bp, Artificial sequence
  primer
ttatactatatggtcagtgttcttag

SEQ ID NO: 2060 - protein, 543 aa, Artificial sequence
  consensus sequence
  Variant (2)..(3): Xaa in position 2 to 3 is any amino acid
  Variant (5)..(5): Xaa in position 5 is any amino acid
  Variant (6)..(6): Xaa in position 6 is any or no amino acid
  Variant (9)..(12): Xaa in position 9 to 12 is any amino acid
  Variant (14)..(14): Xaa in position 14 is any amino acid
  Variant (16)..(17): Xaa in position 16 to 17 is any amino acid
  Variant (19)..(19): Xaa in position 19 is any amino acid
  Variant (21)..(22): Xaa in position 21 to 22 is any amino acid
  Variant (24)..(39): Xaa in position 24 to 39 is any amino acid
  Variant (41)..(43): Xaa in position 41 to 43 is any amino acid
  Variant (46)..(48): Xaa in position 46 to 48 is any amino acid
  Variant (50)..(55): Xaa in position 50 to 55 is any amino acid
  Variant (56)..(65): Xaa in position 56 to 65 is any or no amino acid
  Variant (67)..(79): Xaa in position 67 to 79 is any amino acid
  Variant (80)..(110): Xaa in position 80 to 110 is any or no amino acid
  Variant (112)..(117): Xaa in position 112 to 117 is any amino acid
  Variant (118)..(118): Xaa in position 118 is any or no amino acid
  Variant (120)..(121): Xaa in position 120 to 121 is any amino acid
  Variant (124)..(125): Xaa in position 124 to 125 is any amino acid
  Variant (127)..(131): Xaa in position 127 to 131 is any amino acid
  Variant (133)..(136): Xaa in position 133 to 136 is any amino acid
  Variant (137)..(137): Xaa in position 137 is any or no amino acid
  Variant (139)..(146): Xaa in position 139 to 146 is any amino acid
  Variant (148)..(150): Xaa in position 148 to 150 is any amino acid
  Variant (152)..(155): Xaa in position 152 to 155 is any amino acid
  Variant (157)..(157): Xaa in position 157 is any amino acid
  Variant (159)..(163): Xaa in position 159 to 163 is any amino acid
  Variant (165)..(165): Xaa in position 165 is any amino acid
  Variant (166)..(185): Xaa in position 166 to 185 is any or no amino acid
  Variant (187)..(190): Xaa in position 187 to 190 is any amino acid
  Variant (191)..(201): Xaa in position 191 to 201 is any or no amino acid
  Variant (203)..(204): Xaa in position 203 to 204 is any amino acid
  Variant (206)..(214): Xaa in position 206 to 214 is any amino acid
  Variant (219)..(220): Xaa in position 219 to 220 is any amino acid
  Variant (223)..(225): Xaa in position 223 to 225 is any amino acid
  Variant (227)..(229): Xaa in position 227 to 229 is any amino acid
  Variant (231)..(236): Xaa in position 231 to 236 is any amino acid
  Variant (238)..(238): Xaa in position 238 is any amino acid
  Variant (240)..(245): Xaa in position 240 to 245 is any amino acid
  Variant (246)..(295): Xaa in position 246 to 295 is any or no amino acid
  Variant (298)..(301): Xaa in position 298 to 301 is any amino acid
  Variant (302)..(304): Xaa in position 302 to 304 is any or no amino acid
  Variant (306)..(308): Xaa in position 306 to 308 is any amino acid
  Variant (311)..(311): Xaa in position 311 is any amino acid
  Variant (314)..(314): Xaa in position 314 is any amino acid
  Variant (315)..(315): Xaa in position 315 is any or no amino acid
  Variant (319)..(319): Xaa in position 319 is any amino acid
  Variant (322)..(330): Xaa in position 322 to 330 is any amino acid
  Variant (331)..(346): Xaa in position 331 to 346 is any or no amino acid
  Variant (348)..(350): Xaa in position 348 to 350 is any amino acid
  Variant (352)..(361): Xaa in position 352 to 361 is any amino acid
  Variant (363)..(375): Xaa in position 363 to 375 is any amino acid
  Variant (376)..(378): Xaa in position 376 to 378 is any or no amino acid
  Variant (380)..(382): Xaa in position 380 to 382 is any amino acid
  Variant (384)..(385): Xaa in position 384 to 385 is any amino acid
  Variant (386)..(386): Xaa in position 386 is any or no amino acid
  Variant (390)..(390): Xaa in position 390 is any amino acid
  Variant (394)..(395): Xaa in position 394 to 395 is any amino acid
  Variant (397)..(397): Xaa in position 397 is any amino acid
  Variant (399)..(406): Xaa in position 399 to 406 is any amino acid
  Variant (408)..(424): Xaa in position 408 to 424 is any amino acid
  Variant (425)..(431): Xaa in position 425 to 431 is any or no amino acid
  Variant (434)..(434): Xaa in position 434 is any amino acid
  Variant (437)..(440): Xaa in position 437 to 440 is any amino acid
  Variant (443)..(444): Xaa in position 443 to 444 is any amino acid
  Variant (446)..(447): Xaa in position 446 to 447 is any amino acid
  Variant (449)..(452): Xaa in position 449 to 452 is any amino acid
  Variant (454)..(454): Xaa in position 454 is any amino acid
  Variant (457)..(469): Xaa in position 457 to 469 is any amino acid
  Variant (470)..(489): Xaa in position 470 to 489 is any or no amino acid
  Variant (491)..(517): Xaa in position 491 to 517 is any amino acid
  Variant (518)..(521): Xaa in position 518 to 521 is any or no amino acid
  Variant (523)..(525): Xaa in position 523 to 525 is any amino acid
  Variant (526)..(527): Xaa in position 526 to 527 is any or no amino acid
  Variant (529)..(529): Xaa in position 529 is any amino acid
  Variant (530)..(530): Xaa in position 530 is any or no amino acid
  Variant (532)..(532): Xaa in position 532 is any amino acid
  Variant (534)..(538): Xaa in position 534 to 538 is any amino acid
  Variant (539)..(539): Xaa in position 539 is any or no amino acid
  Variant (541)..(542): Xaa in position 541 to 542 is any amino acid
VXXMXXPGXXXXYXGXXRXKXXLXXXXXXXXXXXXXXXXWXXXGYXXXFXXXXXXXXXXXXXXXXGXXXXXXXXXXXXXXXXXXXXXXXXXXXXXXXXXXXXXXXXXXXXPXXXXXXXQXXFAXXTXXXXXGXXXXXRXXXXXXXXFXXXWXXXXYXPXXXXXWXXXXXXXXXXXXXXXXXXXXXGXXXXXXXXXXXXXXXGXXDXXXXXXXXXFAGGXXVHXXXGXXXLXXXXXXGXRXXXXXXXXXXXXXXXXXXXXXXXXXXXXXXXXXXXXXXXXXXXXXXXXXXXXXXXXPHXXXXXXXGXXXLWXGWXXGFNXGSXXXXXXXXXXXXXXXXXXXXXXXXXAXXXTXXXXXXXXXXWXXXXXXXXXXXXXXXXGXXXGXXXGLVXITPXXGXVXXXXXXXXGXXXXXXXXXXXXXXXXXXXXXXXXDDXLDXXXXHGXXGXXGXXXXGXFAXXXXXXXXXXXXXXXXXXXXXXXXXXXXXXXXXQXXXXXXXXXXXXXXXXXXXXXXXXXXXXXXXRXXXXXEXXGXDXXXXXXEXXY

SEQ ID NO: 2061 - protein, 13 aa, Artificial sequence
  protein pattern
  Variant (2)..(2): Xaa in position 2 is Ala or Gly
  Variant (3)..(3): Xaa in position 3 is Ile, Leu or Val
  Variant (4)..(4): Xaa in position 4 is Ala or Gly
  Variant (5)..(6): Xaa in position 5 to 6 is any amino acid
  Variant (8)..(8): Xaa in position 8 is Ala, Gly or Ser
  Variant (10)..(11): Xaa in position 10 to 11 is any amino acid
  Variant (12)..(12): Xaa in position 12 is any or no amino acid
PXXXXXYXGXXXR

SEQ ID NO: 2062 - protein, 20 aa, Artificial sequence
  protein pattern
  Variant (2)..(3): Xaa in position 2 to 3 is any amino acid
  Variant (5)..(5): Xaa in position 5 is Phe or Tyr
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (13)..(13): Xaa in position 13 is Glu or His
  Variant (14)..(15): Xaa in position 14 to 15 is any amino acid
  Variant (16)..(16): Xaa in position 16 is Ala, Gly or Ser
  Variant (17)..(17): Xaa in position 17 is Ala or Gly
  Variant (18)..(18): Xaa in position 18 is any amino acid
  Variant (19)..(19): Xaa in position 19 is Ala, Gly, Ser or Thr
  Variant (20)..(20): Xaa in position 20 is Ala, Gly or Ser
GXXDXAGXGXXVXXXXXXXX

SEQ ID NO: 2063 - protein, 16 aa, Artificial sequence
  protein pattern
  Variant (3)..(3): Xaa in position 3 is any amino acid
  Variant (4)..(4): Xaa in position 4 is Ala, Ile, Leu or Val
  Variant (5)..(5): Xaa in position 5 is Ala, Ser or Thr
  Variant (6)..(6): Xaa in position 6 is any amino acid
  Variant (7)..(7): Xaa in position 7 is Ala, Gly, Ile, Pro or Val
  Variant (8)..(8): Xaa in position 8 is Ile or Leu
  Variant (9)..(10): Xaa in position 9 to 10 is any amino acid
  Variant (11)..(11): Xaa in position 11 is Gly or Ser
  Variant (12)..(12): Xaa in position 12 is Ala, Cys, Gly or Ser
  Variant (13)..(14): Xaa in position 13 to 14 is any amino acid
  Variant (15)..(15): Xaa in position 15 is Ala, Asp, Glu or Gly
FAXXXXXXXXXXXXXR

SEQ ID NO: 2064 - protein, 33 aa, Artificial sequence
  protein pattern
  Variant (2)..(3): Xaa in position 2 to 3 is any amino acid
  Variant (4)..(4): Xaa in position 4 is any or no amino acid
  Variant (6)..(7): Xaa in position 6 to 7 is any amino acid
  Variant (8)..(8): Xaa in position 8 is any or no amino acid
  Variant (11)..(11): Xaa in position 11 is Gly or Val
  Variant (12)..(12): Xaa in position 12 is Ala, Cys, Gly, Ser, Thr or Val
  Variant (13)..(13): Xaa in position 13 is Ala, Ile, Leu or Val
  Variant (14)..(14): Xaa in position 14 is Ser or Thr
  Variant (16)..(17): Xaa in position 16 to 17 is Ala, Cys, Gly or Ser
  Variant (19)..(24): Xaa in position 19 to 24 is any amino acid
  Variant (25)..(25): Xaa in position 25 is Ala, Gly or Ser
  Variant (26)..(28): Xaa in position 26 to 28 is any amino acid
  Variant (29)..(29): Xaa in position 29 is Ala or Gly
  Variant (30)..(32): Xaa in position 30 to 32 is any amino acid
  Variant (33)..(33): Xaa in position 33 is Ala, Gly or Ser
GXXXGXXXGLXXXXPXXGXXXXXXXXXXXXXXX

SEQ ID NO: 2065 - DNA, 771 bp, Saccharomyces cerevisiae
  CDS (1)..(771)
atgacaaacatggctgccaagaatcagttcaaaggaagcagcttcacactagcgcagctaatcgaagaagtcggacgtaacggaggaaaaaagcctgtgttccagtataaggtaccacggtcgatacgatgggcttcaactgctctagctgtagtgtttctcacatatggcgctgcatacactgatatgtcgtggagaactgctcgagaagtgtacggaaacgctactgaggaagaaaaacacagcccgtggttcaagtgcaaaacttttgggcctgtggctttaggggttttgcctgtgatcctcgctgctgccacgaaacacgtaacgtcaagactagtcacagaaatgaaatatctgccaccgctcaagaatagtacggtgccacggtgtcaattgactcgacgcacttacttgttaggaagaccagtttctatcacgagggagatcaatgaactgtctaaaaataaggccaccaagatcttcacaggagtaggttctcaaggtatggaggataaggccacctttgttttcttcacagtggatgaaaaagcaccctcatttttcaataaattttacattttctcgagatctggtagcgttgtgaagaatgacgccaggatcttggactgctttttcaacagtgtggcagaaaataagctattgaacaggtcaatattaactcagatcctttcacatacgtctgccaagaccctatttcactcggggaattctagatcatccatcaagaatatcgtgaagcccaaatag

SEQ ID NO: 2066 - protein, 256 aa, Saccharomyces cerevisiae
MTNMAAKNQFKGSSFTLAQLIEEVGRNGGKKPVFQYKVPRSIRWASTALAVVFLTYGAAYTDMSWRTAREVYGNATEEEKHSPWFKCKTFGPVALGVLPVILAAATKHVTSRLVTEMKYLPPLKNSTVPRCQLTRRTYLLGRPVSITREINELSKNKATKIFTGVGSQGMEDKATFVFFTVDEKAPSFFNKFYIFSRSGSVVKNDARILDCFFNSVAENKLLNRSILTQILSHTSAKTLFHSGNSRSSIKNIVKPK

SEQ ID NO: 2067 - DNA, 867 bp, Candida glabrata CBS 138
  CDS (1)..(867)
atggcaaaggtctctttttctaagttaatagcatcactggtgtccaagggaaggcccgaggtaatttactcatataagacttcaccgttagtcaaatacggatctaaggggctgtcgctagtattcttcctctatggtgtctcattcacagattttactgtgagttcatcaactaaaatattgaattctgcgtcagaggagcaaaaatcagatgcctggttcatgttcaagacggtaggtcctatagggctgtgtgttttaccatttgcgctatcagctgcctcattatatgtcacctccagagttgttaacaaagtaatttacattccaaagcataatgcgaccccatcttgtcagttgattcggaagtcgatgtttctgggacgtgagataaagttgaccaggtccttaaagtacataaataggcccaagaagcccagagtattcactggtaaaggtattcaaggaatagatgacaacgggtcatttgtattttacctgactgacaaccacccagatgtgagaactagattgcagaaattctatttgcttccaagatcaggccatgtttggggctctgatggtaggataatagatgctatgttcggaggtgaatctataaaggaactcgatcttctggactttgagaattccgataaagaagggaacacttcaggagacttaagtaaacagcgtaatattgaacttgaaaaggactcgagtatactggatgagttgataagagtgaatgctgagaaagtgaaatttcattccgatgacataaagatgagtagttcaaagattatagacatagtaaactccaagaacacacacaagaataatcataaaattaccaaatctaactaa

SEQ ID NO: 2068 - protein, 288 aa, Candida glabrata CBS 138
MAKVSFSKLIASLVSKGRPEVIYSYKTSPLVKYGSKGLSLVFFLYGVSFTDFTVSSSTKILNSASEEQKSDAWFMFKTVGPIGLCVLPFALSAASLYVTSRVVNKVIYIPKHNATPSCQLIRKSMFLGREIKLTRSLKYINRPKKPRVFTGKGIQGIDDNGSFVFYLTDNHPDVRTRLQKFYLLPRSGHVWGSDGRIIDAMFGGESIKELDLLDFENSDKEGNTSGDLSKQRNIELEKDSSILDELIRVNAEKVKFHSDDIKMSSSKIIDIVNSKNTHKNNHKITKSN

SEQ ID NO: 2069 - DNA, 801 bp, Kluyveromyces lactis NRRL Y-1140
  CDS (1)..(801)
atgtcaatcccttttagcacgaaaatggcggctctactggccaaagctgccccagaacaaatatattcgtacaagccaggtaaactcattactttcggggcatattcactttcttttacttttatactgtatggagcttcctttgcggattggtcactaacaacctcatctggtctatataaagaggaatcagaagaaccgaagaaagatttaaaatggtacgaaaatgccaacgtcgcgtttcttggtagatctgcgggttctgtccttctttcagtgatacctttcactttagctgcagtggcactatacataccgaccagaattgtaaccaagatgcattacatccctgataagatcccaaaatgtaaagtgacgactaggactttattcaatggtgaaaagagtaaaacaattccattacgaaacttaagacgtcacgaaaaatccagagtatttacaggaataggtgaacaaggagttgaggaccgtggttcattttctttctccttgatggataaaggggcgccttttttcgataaagtctatattgtgaacagatcaggtaaattctggggatctgacggaagatttatggatgcattatttggaggtgaatctataactcagttggagttgaaagatttcaagaccgaaaagaacgaatacaccaagaacgagcagaagttagagaaaataattcaacaacaaatagcaaggccaagattgaatactaacgctgatattaagaatattgtgttaaattccaagagcaagcatcaccaagatggaaagaaatga

SEQ ID NO: 2070 - protein, 266 aa, Kluyveromyces lactis NRRL Y-1140
MSIPFSTKMAALLAKAAPEQIYSYKPGKLITFGAYSLSFTFILYGASFADWSLTTSSGLYKEESEEPKKDLKWYENANVAFLGRSAGSVLLSVIPFTLAAVALYIPTRIVTKMHYIPDKIPKCKVTTRTLFNGEKSKTIPLRNLRRHEKSRVFTGIGEQGVEDRGSFSFSLMDKGAPFFDKVYIVNRSGKFWGSDGRFMDALFGGESITQLELKDFKTEKNEYTKNEQKLEKIIQQQIARPRLNTNADIKNIVLNSKSKHHQDGKK

SEQ ID NO: 2071 - DNA, 1125 bp, Debaryomyces hansenii CBS767
  CDS (1)..(1125)
atgctattatcaaggataggatatggcattagagccagtacgttaagacaaacaagggttaatatactagggttgtcgctagcccaacggttcaaatcgaatttaccagaagactttaatcctaagaaggacctaccaactagtggagaatggaaacacatgaagcaccatataccaggggaagccgaacaaaagaatgatttgaagagtcgtattcctaagtttccactcggcaaagaagcggttcctacgttattgcctagaccaggagtgccccaggttggcccaaaatattcgttcagacaagtgatccagatattgaagaataaacagaagcctgaattgatctacgaatctgaaccacacagattatacttcctagcgtcgttctgctgttcgcttgtcttcactatatacgggtttgttctcttggaatatgcgtatttccaggctaacaaagactacgaagaaaacgagaaggagcttagcgagccactcagaaagagagaatggttcatttcgcttattaagtactcgtcgatcggtgtgattgcattggcggtggccactggatttgccaaattccccaccaggttaatcagaagaatgtggtatttaccaggcccagtcgaacacatcaaatttacgtcgtatccactctttccaggggctcctacacccgtgattacactcccgcttagctcgatagccagaaaacatacagccagggtatggaccggaaaagggttctacggaactgccgacaactcgatgttctgctttgtgctcaaggaaacaggtgccaggtcgagaaactggtttgtcgacagaaaagggttcttctggtcagacggccgggtttttgacttgttgtttggcaaagagacaatcgccgaggccgaggcgggtattccctacgacgaacaggtcggcatggtcaacagggaggttgaaagaaagagaaaagagttgcgggcaaaacacggatttttctacaagtggaaaatccaggcccaggacatgaagcaggatgtacagggagccactaactatgtgaacacgttgaggggttccaagaagcctaagtccaccaatcaaattaacggcaagaacgacaacatgtaa

SEQ ID NO: 2072 - protein, 374 aa, Debaryomyces hansenii CBS767
MLLSRIGYGIRASTLRQTRVNILGLSLAQRFKSNLPEDFNPKKDLPTSGEWKHMKHHIPGEAEQKNDLKSRIPKFPLGKEAVPTLLPRPGVPQVGPKYSFRQVIQILKNKQKPELIYESEPHRLYFLASFCCSLVFTIYGFVLLEYAYFQANKDYEENEKELSEPLRKREWFISLIKYSSIGVIALAVATGFAKFPTRLIRRMWYLPGPVEHIKFTSYPLFPGAPTPVITLPLSSIARKHTARVWTGKGFYGTADNSMFCFVLKETGARSRNWFVDRKGFFWSDGRVFDLLFGKETIAEAEAGIPYDEQVGMVNREVERKRKELRAKHGFFYKWKIQAQDMKQDVQGATNYVNTLRGSKKPKSTNQINGKNDNM

SEQ ID NO: 2073 - DNA, 1224 bp, Yarrowia lipolytica CLIB122
  CDS (1)..(1224)
atgcttctcgttttgaacacggcgaggcggggtctcttggcctcgcccggcaagtcgctggttcagcagcatctgcgaccgctttcgatgcttgtgaatcggcccatttctcgagctccagctgtccctgttcttatggctgttcgaggcaaaaagaccgactctgatctgccccgagatatcgatcctattgaccctcgaagcaactcgttgcgatctcgaatcccatctttccctctcggtaaggaggcccagccgaccatcattcccaaacccgacactcctgtggtcggccctcggctctctttcactgaaatgatgctgatcctgaaaaacaaaaaggagcccgagttgctgtacgaagccgagccccaccgtctctactttgtcatttgtttctgtggctcgtttgtgctggctttgtacggaatcatgtttggagagaacctgctgagtgctgcctacatggactggaagatgaaccccaccgacgagccatttgtgcaccagatgttcaagtttggactgagatctgctgtgcccattgcctttacctccattttcctcttcatgtcctacgttcttgctcgtttccctggcagactgatccgacgtctgtactaccttcctggcacctacatgaagggtgttcccgagcacatgcagggcgtggatcacattcggtttgtgacccacccctatcttcctggtagaccctctcccgtctacacagtgaacctcaaccagctgcgatgtggagagaggacaaccattttcaccaaggacggtttctacggtaccgcctccaagtcatccttcttcttcttcatctgggaaggcaagagttgggttccctgggtggtcgatcgatccggctggttctggggcgacggacgagtatgggatgtactgtttggaaagaaatccatcaaggaggccgaaaagggtctgtctgaggacgacaagatcaaacagcactggcgaatccaggacgccgccaaggccgagcgaaagctcaaggagggcaagtccttctatatcaacgagtacaagcgcggctttgagcgcgacttcaacaccctcaaggctaacaccgtcgggcttgtggaggacattaaggagaagcgaaaggaggacaaaaagaaggcgcttgaagagccccagacaaagttgacctggcaacagaagcataagcagaagttgaagaacaagaagaagcaataa

SEQ ID NO: 2074 - protein, 407 aa, Yarrowia lipolytica CLIB122
MLLVLNTARRGLLASPGKSLVQQHLRPLSMLVNRPISRAPAVPVLMAVRGKKTDSDLPRDIDPIDPRSNSLRSRIPSFPLGKEAQPTIIPKPDTPVVGPRLSFTEMMLILKNKKEPELLYEAEPHRLYFVICFCGSFVLALYGIMFGENLLSAAYMDWKMNPTDEPFVHQMFKFGLRSAVPIAFTSIFLFMSYVLARFPGRLIRRLYYLPGTYMKGVPEHMQGVDHIRFVTHPYLPGRPSPVYTVNLNQLRCGERTTIFTKDGFYGTASKSSFFFFIWEGKSWVPWVVDRSGWFWGDGRVWDVLFGKKSIKEAEKGLSEDDKIKQHWRIQDAAKAERKLKEGKSFYINEYKRGFERDFNTLKANTVGLVEDIKEKRKEDKKKALEEPQTKLTWQQKHKQKLKNKKKQ

SEQ ID NO: 2075 - DNA, 1158 bp, Candida albicans SC5314
  CDS (1)..(1158): transl_table=12
atgttgatgttgatgccagctagatttggctatcatatagcaaaaaacagtagctcgatattacgacctatttctattttgagattcaaatcaaatgttccttcagcaaagcaaagcaagaacaacttaccagcagatgggatccccaaaaaatcattaccttctgaaggagaatggaagcatttaaaattacatattccaggtgagaatgtggaaacgaatgatttgaaagacagaatacccaaattccctttaggaaaggaaaatgtaccaacattattaccacgtccaggagtacctcaagtgggtaaaaatttcacatttcgacaagttattgggattttgaagaataaaactcaaccggaattgatttatgaaagtgaacctcatcgattgtattttttaatgtgtttttgtgcatcaatcatctttgcaatatacggatgtgtgttatttgaatgggccacatggatagccaataaggaatacgatgaaaatgaaaaagaagagaccaatctagcaattcgtaaacgagaatgggctatatctttggctatgtacttggctccttcagctgcattgtttttgttggcttatggtgccgctcttttcccaacaaagcttgtcagaagaatctggtacttgcctggaccagttgaacatatcaaatttacatcgtatccgtttattcctggtagaccaaccccggtgtatactgtgccattggaaaatttaaagaggaaacacgcagccagagtatggactggtaaaggattttatggtactgctgacaaaggttttttctactttactttgttagaaacattacctaatgggaaaaccaagaattggattgtggacagaaaggggttcttttggtctgatggaagagtatttgattatttatttggtaaagaaactttgcaagaagcagaggcgggtattccatatgacaaacaatttggtattataaatcaagaagtgaaaaagaagaaacaacaattgagggaaaagcatggagtattatggagatacaagatggcagctgaggaatttggtaaagatattaaaaaattgggaggttatattaccaattcaaaatcaatcgataataaaaaaaagacagataacggaaagcaattgccaaaggggaaataa

SEQ ID NO: 2076 - protein, 385 aa, Candida albicans SC5314
MLMLMPARFGYHIAKNSSSILRPISILRFKSNVPSAKQSKNNLPADGIPKKSLPSEGEWKHLKLHIPGENVETNDLKDRIPKFPLGKENVPTLLPRPGVPQVGKNFTFRQVIGILKNKTQPELIYESEPHRLYFLMCFCASIIFAIYGCVLFEWATWIANKEYDENEKEETNLAIRKREWAISLAMYLAPSAALFLLAYGAALFPTKLVRRIWYLPGPVEHIKFTSYPFIPGRPTPVYTVPLENLKRKHAARVWTGKGFYGTADKGFFYFTLLETLPNGKTKNWIVDRKGFFWSDGRVFDYLFGKETLQEAEAGIPYDKQFGIINQEVKKKKQQLREKHGVLWRYKMAAEEFGKDIKKLGGYITNSKSIDNKKKTDNGKQLPKGK

SEQ ID NO: 2077 - DNA, 24 bp, Artificial sequence
  primer
atgacaaacatggctgccaagaat

SEQ ID NO: 2078 - DNA, 25 bp, Artificial sequence
  primer
ctatttgggcttcacgatattcttg

SEQ ID NO: 2079 - protein, 288 aa, Artificial sequence
  consensus sequence
  Variant (2)..(7): Xaa in position 2 to 7 is any amino acid
  Variant (9)..(10): Xaa in position 9 to 10 is any amino acid
  Variant (12)..(13): Xaa in position 12 to 13 is any amino acid
  Variant (16)..(17): Xaa in position 16 to 17 is any amino acid
  Variant (19)..(24): Xaa in position 19 to 24 is any amino acid
  Variant (26)..(33): Xaa in position 26 to 33 is any amino acid
  Variant (35)..(36): Xaa in position 35 to 36 is any amino acid
  Variant (38)..(39): Xaa in position 38 to 39 is any amino acid
  Variant (42)..(61): Xaa in position 42 to 61 is any amino acid
  Variant (63)..(95): Xaa in position 63 to 95 is any amino acid
  Variant (96)..(103): Xaa in position 96 to 103 is any or no amino acid
  Variant (105)..(110): Xaa in position 105 to 110 is any amino acid
  Variant (112)..(112): Xaa in position 112 is any amino acid
  Variant (114)..(128): Xaa in position 114 to 128 is any amino acid
  Variant (129)..(139): Xaa in position 129 to 139 is any or no amino acid
  Variant (141)..(144): Xaa in position 141 to 144 is any amino acid
  Variant (145)..(146): Xaa in position 145 to 146 is any or no amino acid
  Variant (148)..(149): Xaa in position 148 to 149 is any amino acid
  Variant (151)..(162): Xaa in position 151 to 162 is any amino acid
  Variant (165)..(165): Xaa in position 165 is any amino acid
  Variant (167)..(168): Xaa in position 167 to 168 is any amino acid
  Variant (170)..(171): Xaa in position 170 to 171 is any amino acid
  Variant (173)..(175): Xaa in position 173 to 175 is any amino acid
  Variant (177)..(177): Xaa in position 177 is any amino acid
  Variant (179)..(192): Xaa in position 179 to 192 is any amino acid
  Variant (193)..(198): Xaa in position 193 to 198 is any or no amino acid
  Variant (200)..(200): Xaa in position 200 is any amino acid
  Variant (202)..(203): Xaa in position 202 to 203 is any amino acid
  Variant (205)..(205): Xaa in position 205 is any amino acid
  Variant (206)..(206): Xaa in position 206 is any or no amino acid
  Variant (210)..(211): Xaa in position 210 to 211 is any amino acid
  Variant (213)..(214): Xaa in position 213 to 214 is any amino acid
  Variant (217)..(219): Xaa in position 217 to 219 is any amino acid
  Variant (220)..(221): Xaa in position 220 to 221 is any or no amino acid
  Variant (223)..(259): Xaa in position 223 to 259 is any amino acid
  Variant (260)..(287): Xaa in position 260 to 287 is any or no amino acid
FXXXXXXLXXKXXPEXXYXXXXXXLXXXXXXXXSXXFXXYGXXXXXXXXXXXXXXXXXXXXEXXXXXXXXXXXXXXXXXXXXXXXXXXXXXXXXXXXXXXXXXRXXXXXXYXPXXXXXXXXXXXXXXXXXXXXXXXXXXGXXXXXXTXXLXXXXXXXXXXXXTGXGXXGXXDXXXFXFXXXXXXXXXXXXXXXXXXXXRXGXXWXXDGRXXDXXFGXXXXXEXXXXXXXXXXXXXXXXXXXXXXXXXXXXXXXXXXXXXXXXXXXXXXXXXXXXXXXXXXXXXXXXXK

SEQ ID NO: 2080 - protein, 10 aa, Artificial sequence
  protein pattern
  Variant (2)..(2): Xaa in position 2 is Ile, Leu or Val
  Variant (3)..(3): Xaa in position 3 is Ile or Val
  Variant (4)..(4): Xaa in position 4 is any amino acid
  Variant (5)..(5): Xaa in position 5 is Glu, Lys or Arg
  Variant (6)..(6): Xaa in position 6 is Leu, Met or Val
  Variant (7)..(7): Xaa in position 7 is any amino acid
  Variant (9)..(9): Xaa in position 9 is Ile or Leu
RXXXXXXYXP

SEQ ID NO: 2081 - DNA, 1113 bp, Saccharomyces cerevisiae
  CDS (1)..(1113)
atggctgaagcaagcatcgaaaagactcaaattttacaaaaatatctagaactggaccaaagaggtagaataattgccgaatacgtttggatcgatggtactggtaacttacgttccaaaggtagaactttgaagaagagaatcacatccattgaccaattgccagaatggaacttcgacggttcttctaccaaccaagcgccaggccacgactctgacatctatttgaaacccgttgcttactacccagatcccttcaggagaggtgacaacattgttgtcttggccgcatgttacaacaatgacggtactccaaacaagttcaaccacagacacgaagctgccaagctatttgctgctcataaggatgaagaaatctggtttggtctagaacaagaatacactctatttgacatgtatgacgatgtttacggatggccaaagggtgggtacccagctccacaaggtccttactactgtggtgttggtgccggtaaggtttatgccagagacatgatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacgctaacgtttccaccaaggaaatgagacaaccaggtggtacgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataa

SEQ ID NO: 2082 - protein, 370 aa, Saccharomyces cerevisiae
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHANVSTKEMRQPGGTKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 2083 - DNA, 1041 bp, Mesorhizobium loti MAFF303099
  CDS (1)..(1041): transl_table=11
atgacgaaatacaagctcgagtacatttggctcgatggttacaccccggtccccaaccttcgcggcaagacgcagatcaaggaattcgccgaattcccgacgctcgaacagctgccgctgtggggcttcgacggttcctcgaccatgcaggccgaaggccgcagctccgattgcgtgttgaagccggtggcgctttacccggatccggcccgcaccaacggcattctcgtcatgtgcgaggtcatgatgcccgacggcgtcaccccgcatgaatcgaacagccgcgcgaccatcctcgacgacgaggacgcctggtttggtttcgagcaagagtacttcttctacaaggacggccgcccgctcggcttcccggagagcggttatcccgcgccgcagggcccttactacaccggcgtcggctacaagaacgtcggcgacgtcgcgcgcaagatcgtcgaagagcatctcgaccagtgcctcgcggccggcatcaaccatgaaggcatcaacgccgaagtggccaagggccagtgggaattccagattttcggcaagggctccaagaaggccgccgaccagatctggatggcgcgctacctgctcctgcgtctgaccgagacttacggcatcgacatcgagttccactgcaagccgctcggcgacaccgactggaacggctcgggcatgcactgcaatttctcgaccaagttcatgcgcgaagtcggcggcaaggcctatttcgaagccctgatggcgcagttcgacaaaaacctgatggaccacatcgccgtctacgggccggacaacgacaagcgcctgaccggcaagcacgagaccgcgccgtggaacaagtttagctatggcgtcgccgaccgtggcgcatcgatccgcgtgccgcactccttcgtcaagaatgactacaagggctatctggaagaccgtcgtccgaactcccagggcgacccctaccagatcgcttcgcaggtgctgaagacgatctcgcaggttgcgaccgacgcgaaggtctcggccgccgcctga

SEQ ID NO: 2084 - protein, 346 aa, Mesorhizobium loti MAFF303099
MTKYKLEYIWLDGYTPVPNLRGKTQIKEFAEFPTLEQLPLWGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDRRPNSQGDPYQIASQVLKTISQVATDAKVSAAA

SEQ ID NO: 2085 - DNA, 1104 bp, Agrobacterium tumefaciens str. C58
  CDS (1)..(1104): transl_table=11
atgtgcttccggtggcaaaagccacggcaagcctcaaggcttcgcattgttacctatgagaggttcgtaatgactaagttcaaactcgagtacatctggctggacggatacaagccggtcgcaaacctgcgcggcaagacacagatcaaggaattcgatgaattccccacactcgagcagttgccgctttggggttttgacggctcctccacccagcaggccgaaggccactcatcggattgcgtgctgaagcccgttgcgatctacccggatccggcccgcaccaacggcgcgctcgtcatgtgcgaagtcatgatgcccgatggcgtcaccccgcacgcttccaacagccgcgccacgatcctcgaagacgaagacgcatggttcggtttcgaacaggaatatttcttctaccaggacggccgcccgctcggtttcccggaacagggttaccccgctccgcagggtccgtattacaccggcgtcggcttcaagaacgtcggctcggttgcccgcgaaatcgttgaagagcacctcgatctctgcctcgaagccggcatcaaccatgaaggcatcaacgccgaagtggccaagggccagtgggaattccaggtattcggcaagggctccaagcgcgccgccgaccagatctggatcgcccgttacctgctgctgcgtctttgcgaacagtacggcatcgacgtcgagttccattgcaagccgctcggcgataccgactggaacggctccggcatgcattgcaacttctcgaccaagttcatgcgcgaagttggcggcaaggactatttcgaagccctcatggccgctttcgccaagaattggcaggagcacatcgacgtttacggtccggacaaccatctgcgcctgaccggcaagcacgaaaccgctccgtggaacaagttctcctatggcgtggcagaccgtggcgcctcgatccgcgttccgcactccttcgtcaacaacggttaccgtggttacctcgaagaccgtcgtccgaattcgcagggctgcccctaccagatcgcttccgtcgttctgaagacgatcgcagaagtgccgctcgcaaagtcggctgctgcctga

SEQ ID NO: 2086 - protein, 367 aa, Agrobacterium tumefaciens str. C58
MCFRWQKPRQASRLRIVTYERFVMTKFKLEYIWLDGYKPVANLRGKTQIKEFDEFPTLEQLPLWGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRAADQIWIARYLLLRLCEQYGIDVEFHCKPLGDTDWNGSGMHCNFSTKFMREVGGKDYFEALMAAFAKNWQEHIDVYGPDNHLRLTGKHETAPWNKFSYGVADRGASIRVPHSFVNNGYRGYLEDRRPNSQGCPYQIASVVLKTIAEVPLAKSAAA

SEQ ID NO: 2087 - DNA, 1035 bp, Sinorhizobium meliloti 1021
  CDS (1)..(1035): transl_table=11
atgaccaagtataagctcgagtacatctggctcgatggctacacgcccgtcccaaatctccgcgggaagacgcagatcaaggaattcgacgcgtttccgacgctcgagcagcttccgctctggggcttcgacggcagctcgacgcagcaggccgaagggcgcagctccgattgcgtcctgaagccggttgccgtctatcccgatccggtccgcacgaatggcgcattggtcatgtgcgaggtcatgatgcctgacggcaagacgccgcatccgtcgaatacccgtgcaacggttctcgacgatgaaagcgcctggttcggcttcgagcaggaatatttcttctacaagaacggccgcccgctgggcttcccggagcagggctatccggcgccgcagggcccgtactacaccggcgtgggctacaagaatgtcggcgacatcgcgcgccagatcgtcgaagagcatctcgacatctgcctggccgcgggcatcaaccacgaaggcatcaacgccgaagtggccaagggccaatgggaattccaggtcttcggcaagggctccaagaaggctgccgatgaagtctggctggcgcgctaccttctgctgcgcctaacagagaaatacggcatcgacgtcgagttccactgcaagccgctcggcgacacggactggaacggctccggcatgcacgccaacttctcgactgcctatctgcgcgaagtcggcggcaaggactatttcgaagcgctgatggcagccttcgagaagaacctgcacgaccacatcaacgtctatggcccggacaaccacttgcgcctgaccggcaagcacgagacggcgccgtgggacaagttcagctacggcgtggccgaccgcggcgcctccattcgcgttccgcacagcttcgtcaacaacggctatcgcggctatctcgaagatcgccgcccgaactcccagggcgacccctaccagatcgcttcggtcatcctgaagacgatctcgagcgtgccgacggcggttgccaaggtcgcttga

SEQ ID NO: 2088 - protein, 344 aa, Sinorhizobium meliloti 1021
MTKYKLEYIWLDGYTPVPNLRGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSFVNNGYRGYLEDRRPNSQGDPYQIASVILKTISSVPTAVAKVA

SEQ ID NO: 2089 - DNA, 1035 bp, Agrobacterium tumefaciens str. C58
  CDS (1)..(1035): transl_table=11
atgactaagttcaaactcgagtacatctggctggacggatacaagccggtcgcaaacctgcgcggcaagacacagatcaaggaattcgatgaattccccacactcgagcagttgccgctttggggttttgacggctcctccacccagcaggccgaaggccactcatcggattgcgtgctgaagcccgttgcgatctacccggatccggcccgcaccaacggcgcgctcgtcatgtgcgaagtcatgatgcccgatggcgtcaccccgcacgcttccaacagccgcgccacgatcctcgaagacgaagacgcatggttcggtttcgaacaggaatatttcttctaccaggacggccgcccgctcggtttcccggaacagggttaccccgctccgcagggtccgtattacaccggcgtcggcttcaagaacgtcggctcggttgcccgcgaaatcgttgaagagcacctcgatctctgcctcgaagccggcatcaaccatgaaggcatcaacgccgaagtggccaagggccagtgggaattccaggtattcggcaagggctccaagcgcgccgccgaccagatctggatcgcccgttacctgctgctgcgtctttgcgaacagtacggcatcgacgtcgagttccattgcaagccgctcggcgataccgactggaacggctccggcatgcattgcaacttctcgaccaagttcatgcgcgaagttggcggcaaggactatttcgaagccctcatggccgctttcgccaagaattggcaggagcacatcgacgtttacggtccggacaaccatctgcgcctgaccggcaagcacgaaaccgctccgtggaacaagttctcctatggcgtggcagaccgtggcgcctcgatccgcgttccgcactccttcgtcaacaacggttaccgtggttacctcgaagaccgtcgtccgaattcgcagggctgcccctaccagatcgcttccgtcgttctgaagacgatcgcagaagtgccgctcgcaaagtcggctgctgcctga

SEQ ID NO: 2090 - protein, 344 aa, Agrobacterium tumefaciens str. C58
MTKFKLEYIWLDGYKPVANLRGKTQIKEFDEFPTLEQLPLWGFDGSSTQQAEGHSSDCVLKPVAIYPDPARTNGALVMCEVMMPDGVTPHASNSRATILEDEDAWFGFEQEYFFYQDGRPLGFPEQGYPAPQGPYYTGVGFKNVGSVAREIVEEHLDLCLEAGINHEGINAEVAKGQWEFQVFGKGSKRAADQIWIARYLLLRLCEQYGIDVEFHCKPLGDTDWNGSGMHCNFSTKFMREVGGKDYFEALMAAFAKNWQEHIDVYGPDNHLRLTGKHETAPWNKFSYGVADRGASIRVPHSFVNNGYRGYLEDRRPNSQGCPYQIASVVLKTIAEVPLAKSAAA

SEQ ID NO: 2091 - DNA, 1032 bp, Streptomyces coelicolor A3(2)
  CDS (1)..(1032): transl_table=11
gtgaccttcaaggccgagtacatctggatcgacggcaccgagccgacggccaagctccgttccaagacgaagatcatcacggctgcccccgcgggtctggacgccctgccggtctggggcttcgacggctcctccaccaaccaggccgagggcagctcctcggactgcgtgctcaagccggtcttctcctgccccgacccgatccgcggaggcgaggacatcctggtgctgtgcgaggtcctggacacggacatgacgccgcacccgagcaacacccgtgccgcgctggccgagctgtccgagcgcttcgccgcgcaggagccggtcttcggcatcgagcaggagtacaccttcttcaagggcacccgcccgctcggcttccccgagggcggcttcccggccgcgcagggcggctactactgcggcgtgggctcggacgagatcttcggccgcgacgtcgtcgaggcgcacctggagaactgcctgaaggccggactcggcatctccggcatcaacgccgaggtcatgcccggccagtgggagttccaggtcggcccgctggcgccgctggaggtctccgaccagctgtgggtggcccgctggctgctctaccgcaccgcggaggacttcgaggtctccgccaccctcgaccccaagccggtcaagggcgactggaacggcgcgggcgcgcacaccaacttctccaccaaggcgatgcgcgagggttacgacgcgatcatcacggccgccgagtccctcggtgagggctccaagccgatggaccacgtcaagaactacggcgccggcatcgacgaccgactcaccggcctgcacgagaccgccccgtggaacgagtactcctacggcgtctccgaccgcggcgcctcggtgcgcatcccgtggcaggtcgagaaggacggcaagggctacatcgaggaccgccgtcccaacgccaacgtggacccgtacgtcgtgacgcgcctgctcgtcgacacctgctgcacggcgctggagaaggccggccaggtctga

SEQ ID NO: 2092 - protein, 343 aa, Streptomyces coelicolor A3(2)
MTFKAEYIWIDGTEPTAKLRSKTKIITAAPAGLDALPVWGFDGSSTNQAEGSSSDCVLKPVFSCPDPIRGGEDILVLCEVLDTDMTPHPSNTRAALAELSERFAAQEPVFGIEQEYTFFKGTRPLGFPEGGFPAAQGGYYCGVGSDEIFGRDVVEAHLENCLKAGLGISGINAEVMPGQWEFQVGPLAPLEVSDQLWVARWLLYRTAEDFEVSATLDPKPVKGDWNGAGAHTNFSTKAMREGYDAIITAAESLGEGSKPMDHVKNYGAGIDDRLTGLHETAPWNEYSYGVSDRGASVRIPWQVEKDGKGYIEDRRPNANVDPYVVTRLLVDTCCTALEKAGQV

SEQ ID NO: 2093 - DNA, 1080 bp, Coxiella burnetii RSA 493
  CDS (1)..(1080): transl_table=11
atgtttgctcaagttacctatatttggatggacggcgcgcagccaacccaaaagttacgatcaaaagttcggatcgtcaaacatcctgagcgagatattacgctggccgactttccagaatgggggttcgacggctcttcaacctaccaagcgacgggaaaggattccgatttgattttacaaccggtccattttgttaaagatccaatcttaggcgatggaaattacttggtgttatgtgaagtgatgaatcccgatggatctccacatgcttcaaacacccgtgcccgcttgcgccaaatcatggccaatggcgctgctgagcatgagccctggattggttttgagcaagaatacactctctttcaaggcgtccaacctctcggatggcccgatcgaggatatcccgcgcctcaaggccctttttattgcggcatcggtgcggatgaagtgtttggtcgcccgctggtggaagaacatgccaccgcttgtattgaggctgagctcatgatttttggaacgaacgccgaagtcatgccaggacaatgggagttccaaattggctatcgaggcgctgacgacgagacgcctgatcctttgacggtttctgatcatctttggttggctcgatggttgctctatcgtattggagaagattacgggatcacagcaaccctccagcctaaaccggttaaaggggattggaacggtgctggaaaacacacgaacttttctactaagttgatgcgcgaccccgccacaggccgggaagccatcgaacaggccatcgagcgattatcaaaacgtcatgacgctcatattgcggtgtacggtcatggtttagaagagcggctcacgggtaaacacgaaacggctcctattacgcaattttcttcaggcgtaggcaatcgcggcgcttccgttcgcatacctagcgcggtagcctctcggggttgtggttacttagaagatcgtcggcccggtgctaacgccgatccttaccaagtcgcggctattttgttagaaacgatttgtgggattcaattgccgaaaaacagtgggatcgaaacaaccgtttga

SEQ ID NO: 2094 - protein, 359 aa, Coxiella burnetii RSA 493
MFAQVTYIWMDGAQPTQKLRSKVRIVKHPERDITLADFPEWGFDGSSTYQATGKDSDLILQPVHFVKDPILGDGNYLVLCEVMNPDGSPHASNTRARLRQIMANGAAEHEPWIGFEQEYTLFQGVQPLGWPDRGYPAPQGPFYCGIGADEVFGRPLVEEHATACIEAELMIFGTNAEVMPGQWEFQIGYRGADDETPDPLTVSDHLWLARWLLYRIGEDYGITATLQPKPVKGDWNGAGKHTNFSTKLMRDPATGREAIEQAIERLSKRHDAHIAVYGHGLEERLTGKHETAPITQFSSGVGNRGASVRIPSAVASRGCGYLEDRRPGANADPYQVAAILLETICGIQLPKNSGIETTV

SEQ ID NO: 2095 - DNA, 1029 bp, Streptomyces avermitilis MA-4680
  CDS (1)..(1029): transl_table=11
gtgaccttcaaggctgagtacatctggatcgacggcaccgagccgacggccaagctccgttcgaagacgaagatcctggcggacgatgccaagggtgccgagctgccgatctggggcttcgacgggtcctccacgaaccaggccgaggggcacgcctccgaccgcgtactcaagccggtcgccacctacccggacccgatccgcggcggcgacgacgtcctcgtcatgtgcgaggtcctgaacatcgacatgacgccgcacgagtccaacacgcgtgccacgctggccgaggtcgaggagaagttcggcgcccaggagccgatcttcggcatcgagcaggagtacaccttcttcaagggctcgcgcccgctgggcttccccgagggcggcttcccggccgcgcagggcggctactactgcggtgtcggctcggacgagatcttcggccgtgacgtcgtcgaggcgcacctggagaactgcctcaaggcgggtctgggcatctccggcatcaacgccgaggtcatgcccggccagtgggagttccaggtcggcccgctggcgccgctcgaggtctccgaccagctgtgggtggcccgctggctgctctaccgcaccgccgaggacttcggcgtctccgcgacgctggacccgaagccggtgaagggcgactggaacggcgcgggcgcgcacaccaacttctccacgaaggcgatgcgcgagggctacgacgcgatcatcaccgcgtgcgagtcgctgggcgagggctccaagccgctcgaccacgtcaagaactacggcgcgggcatcgacgaccgcctgacgggcctgcacgagaccgccccgtggaacgagtactcgtacggcgtctcgaaccgtggcgcctcggtccgtatcccgtggcaggtcgagaaggacggcaagggctacatcgaggaccgccgtccgaacgccaacgtcgacccgtacgtcgtgacgcgtctgctcgtcgacacctgctgctccgccctggagaaggccggccaggtctga

SEQ ID NO: 2096 - protein, 342 aa, Streptomyces avermitilis MA-4680
MTFKAEYIWIDGTEPTAKLRSKTKILADDAKGAELPIWGFDGSSTNQAEGHASDRVLKPVATYPDPIRGGDDVLVMCEVLNIDMTPHESNTRATLAEVEEKFGAQEPIFGIEQEYTFFKGSRPLGFPEGGFPAAQGGYYCGVGSDEIFGRDVVEAHLENCLKAGLGISGINAEVMPGQWEFQVGPLAPLEVSDQLWVARWLLYRTAEDFGVSATLDPKPVKGDWNGAGAHTNFSTKAMREGYDAIITACESLGEGSKPLDHVKNYGAGIDDRLTGLHETAPWNEYSYGVSNRGASVRIPWQVEKDGKGYIEDRRPNANVDPYVVTRLLVDTCCSALEKAGQV

SEQ ID NO: 2097 - DNA, 1101 bp, Rhodopirellula baltica SH 1
  CDS (1)..(1101): transl_table=11
ttgtctgacagtttcattctttgctctggcaagaccgccacgggcaccaaaaaagtctttaggagactcgcatccatgaccaagtgtaagttggaatacatctggctcgacggctatcaaccgacccagagcatgcgcagcaaaaccaaaatcgtcgaagacttcagcggcaaagtggaagatgccgaaatgtggtcgttcgacggttcgtcaaccgaacaagcgcccggtggagccagtgactgcttgctgaagcccgtcttctgccttcccgatccggatcgtttgggcaccggcttcttggtgatgtgcgaagtgatgaatgccgatggcacgcctcaccgcagcaacggccgtgcaacgatcaaagacgatgacaatgacttctggttcggtttcgaacaggagtacacgatcttcgatccagaaaccaagaaaccaatcggcttccctgctgaaggtttcccaggacctcaaggtccttactactgctcggtcggtgctggcaaagcagtcggtcgtgaaatcgtcgaagagcacctcgaactgtgcttgcaagctggcttgaacgtcgaaggcatcaacgccgaagtcatgatgggccagtgggaattccaaatcttcgccaagggcgcagcccaagctggtgacgaaatttggctcgcacgctacttgctggatcgcaccggcgagaagtacggcatggaaattaactaccactgcaaaccagtcaaaggtgactggaacggcagcggcatgcacgccaacttcagcaacacgaccctgcgtacgtgcggcagcaaagaagtttacgaagcgatttgccaagccttcgagcctcgtatcaccgagcacatcgatgtttacggtgctgacaacgatcagcgtttgaccggtttgcacgaaacgcaatcgatcgacaagttcagctacggcatctcggaccgcggtgcatcgatccgcattccaatcgccacggttgaaaagggctggaagggctggttggaagatcgtcgcccagcttcgaacgctgacccatacatggttgccagtgcaatcatcgcaacggtcaagacagccaacgtcccagccggcgtttga

SEQ ID NO: 2098 - protein, 366 aa, Rhodopirellula baltica SH 1
MSDSFILCSGKTATGTKKVFRRLASMTKCKLEYIWLDGYQPTQSMRSKTKIVEDFSGKVEDAEMWSFDGSSTEQAPGGASDCLLKPVFCLPDPDRLGTGFLVMCEVMNADGTPHRSNGRATIKDDDNDFWFGFEQEYTIFDPETKKPIGFPAEGFPGPQGPYYCSVGAGKAVGREIVEEHLELCLQAGLNVEGINAEVMMGQWEFQIFAKGAAQAGDEIWLARYLLDRTGEKYGMEINYHCKPVKGDWNGSGMHANFSNTTLRTCGSKEVYEAICQAFEPRITEHIDVYGADNDQRLTGLHETQSIDKFSYGISDRGASIRIPIATVEKGWKGWLEDRRPASNADPYMVASAIIATVKTANVPAGV

SEQ ID NO: 2099 - DNA, 1038 bp, Rhodopseudomonas palustris CGA009
  CDS (1)..(1038): transl_table=11
atgaccaagtacaagctcgagtacatctggctcgacggctacaagccgacgccgaacctccgcggcaagacgaccatcaaggaattcgagatctatccgacgctcgagcagcttccgctttggggattcgacggctcgtcgacgatgcaggccgagggccacagctccgactgcgtgctgaagccggttgcgatgtaccccgacgctgcgcggaagaacggcattctggttctgtgcgaagtgatgatgccggacggcgtcaccccgcatccgaccaacacccgcgccaccattctggacgacgaaggcgcctggttcggctttgaacaggaatacttcttctacaagaatggccgcccgcttggcttccccgaggccggctatcccgcgccgcagggcccgtactacaccggcgtcggctacaagcacgtcggtgacatcgcccgtcagatcgtcgaagagcacctcgacctctgcctcgcagccggcatcaaccacgaaggcatcaacgccgaggtggcgaagggccagtgggaattccaggtgttcggcaaggggtcgaggaccgctgccgaccagatgtggatggcgcgctatctgatgcttcgtctcaccgagaagtacggcatcgacatcgaattccactgcaagccgctcggcgacaccgattggaacggctcgggcatgcactgcaacttctccaccgcctacatgcgcgaagtcggcggcaaggagtatttcgaagcgatgatgaaggcgttcgaggccaacctcgacgaccacatcgcggtgtatggtcctgacaaccacatgcggctcaccggcaagcacgagaccgcgccgtggaacaagttttcctacggcatcgccgatcgcggcgcgtcgatccgggtgccgcactccttcgtcaacaacggctacaagggctatctggaagatcgccgcccgaactcgcagggcgacccctaccagatcgcgtcccaggttctgaagacgatttcgtcggtccccacctcgaagtcggcagccgccgcctga

SEQ ID NO: 2100 - protein, 345 aa, Rhodopseudomonas palustris CGA009
MTKYKLEYIWLDGYKPTPNLRGKTTIKEFEIYPTLEQLPLWGFDGSSTMQAEGHSSDCVLKPVAMYPDAARKNGILVLCEVMMPDGVTPHPTNTRATILDDEGAWFGFEQEYFFYKNGRPLGFPEAGYPAPQGPYYTGVGYKHVGDIARQIVEEHLDLCLAAGINHEGINAEVAKGQWEFQVFGKGSRTAADQMWMARYLMLRLTEKYGIDIEFHCKPLGDTDWNGSGMHCNFSTAYMREVGGKEYFEAMMKAFEANLDDHIAVYGPDNHMRLTGKHETAPWNKFSYGIADRGASIRVPHSFVNNGYKGYLEDRRPNSQGDPYQIASQVLKTISSVPTSKSAAAA

SEQ ID NO: 2101 - DNA, 1077 bp, Magnaporthe grisea 70-15
  CDS (1)..(1077)
atggcgacagcaaatgtcacatacgtcgagaaccttcagaagtacctgaagctcgaccagaggggagcagtcatcgcagagtacgtctggatcgacagcgagggcggtgtcaggtcaaagtcgaggacattagaatcaaagaaggacggtttcaagcccgacgacctccccacatggaactttgacggttcatcgactggccaggctcctggcgacaactcagatgtctacctgaagcccgttgccgttttccccgaccccttccgcggaggcgagaacatcctcgttctctcggaatgcatcaacgccgatggcacccccaacaagttcaaccaccgccacgagtgcgcaaagttgatggagacccacgccgagcaccagccctggttcggtctggagcaggagtacacccttctcgaccttaacgaccgtcccttcggctggccccagaacggtttccccgccccgcaaggcccatactactgtggtgtcggtgccggcaaggtcgtccagcgcgacatcgtcgaggcccactacaagagctgtctgtacgccggcgtcaagatctctggcaccaacgccgaggtcatgcccgcccagtgggagttccaggtcggcccctgcaccggcatcgagatgggtgaccacctctggatcgcccgcttcctcctgcaccgcgttgctgaggagtttggcgccaaggtctcgttcgaccccaagcccatccccggcgactggaacggtgccggtctgcactccaacttcagcaccaaggagatgcgtgttgagggtggcatgaagcacattgaggccgccatcaagaagcttgagggccgccaccaggagcacattgccgtctacggtgagggtaacgagaagaggttgaccggcaggcacgagaccggcgccatcgacaccttcagctacggtgtcgccaaccgtggtgcgtcgatccgtattcccagggaatgcgccgccaagggctacggctacttcgaggaccgtcgcccggcatccaacgccgacccgtaccagatcactggtatcatcatggagacctgcttcggcgaggcatag

SEQ ID NO: 2102 - protein, 358 aa, Magnaporthe grisea 70-15
MATANVTYVENLQKYLKLDQRGAVIAEYVWIDSEGGVRSKSRTLESKKDGFKPDDLPTWNFDGSSTGQAPGDNSDVYLKPVAVFPDPFRGGENILVLSECINADGTPNKFNHRHECAKLMETHAEHQPWFGLEQEYTLLDLNDRPFGWPQNGFPAPQGPYYCGVGAGKVVQRDIVEAHYKSCLYAGVKISGTNAEVMPAQWEFQVGPCTGIEMGDHLWIARFLLHRVAEEFGAKVSFDPKPIPGDWNGAGLHSNFSTKEMRVEGGMKHIEAAIKKLEGRHQEHIAVYGEGNEKRLTGRHETGAIDTFSYGVANRGASIRIPRECAAKGYGYFEDRRPASNADPYQITGIIMETCFGEA

SEQ ID NO: 2103 - DNA, 1029 bp, Magnaporthe grisea 70-15
  CDS (1)..(1029)
atgtcactggaccaaaagggctccattatggcagagtacgtctggattgacagtgaaggtggcgtccgctcaaaatcaaggaccctcaaggaacaaaaatatgagcccaaggacctgcccacatggaactttgacggctcctcaacgggccaggcgggaggcgacaattcggacgtgttcctcaagcccgttgccgtctacccggatccgttccgcggtgagcccaacatcatcgtcctggccgagtgctgggactcggacggcacaccgaacaagttcaaccaccgccatgaagctgccaagctgatggaggcccacgccgaacacgagccttggtttggcctcgagcaggaatacaccctcctcaaccttgaggacaggccgttcggctggcccaagaatggcttcccggctccccagggaccgtattactgcggtgttggtgccggcaaggtcgtccagagggatatcgtcgaggcacattacaaagcgtgcttatatgcgggtgttaagatttcgggaacaaatgccgaggtcatgccggcacaatgggagttccaggtcggcccatgtgagggcatcgagatgggcgaccacctctcaatagcacgcttcctcctgcaccgcgtggcagaagaattcggagccaaggtttcgttcgaccccaagcccatcccgggcgactggaacggcgccggcctgcacagcaacttctccaccaaggagatgcgcgtcgacggcggcatgaagcacatcgaggccgccattaagaagctcgagggcaggcataaggagcatattgccgtttacggcgagggcaacgaaaagcgcctgacgggctcccacgagacgggcagcatcgaggagttctcttacggcatcgccaaccgcggcgccagcatccgcatcccccgggagtgtgccgcaaagggctacggttactttgaggaccgcaggcccgccagtaatgctgatccttaccagattaccggcattatcatggagacctgctttggtgcagtgaactaa

SEQ ID NO: 2104 - protein, 342 aa, Magnaporthe grisea 70-15
MSLDQKGSIMAEYVWIDSEGGVRSKSRTLKEQKYEPKDLPTWNFDGSSTGQAGGDNSDVFLKPVAVYPDPFRGEPNIIVLAECWDSDGTPNKFNHRHEAAKLMEAHAEHEPWFGLEQEYTLLNLEDRPFGWPKNGFPAPQGPYYCGVGAGKVVQRDIVEAHYKACLYAGVKISGTNAEVMPAQWEFQVGPCEGIEMGDHLSIARFLLHRVAEEFGAKVSFDPKPIPGDWNGAGLHSNFSTKEMRVDGGMKHIEAAIKKLEGRHKEHIAVYGEGNEKRLTGSHETGSIEEFSYGIANRGASIRIPRECAAKGYGYFEDRRPASNADPYQITGIIMETCFGAVN

SEQ ID NO: 2105 - DNA, 1065 bp, Gibberella zeae PH-1
  CDS (1)..(1065)
atggctgctcctattacctcaaggacggagactctccagaagtatctcaagcttgatcagaagggtatgatcatggctgagtacgtctgggttgatgctgagggtggcactcgatccaagtcccgaactctccccgagaaggactacaagcccgaggaccttcctgtctggaacttcgacggttcatccacaaaacaggcccctggcgagaactctgatgtctacctccgaccctgcgccgtctaccccgatcccttccgtggatctcccaacatcattgtcctggctgagtgttacgactcagatggcactcccaacaagtacaacttccgtcatgactgtgtgaaggtcatgaagacatacgccgacgaggagccttggttcggtctcgagcaggagtacactcttctcggatctgatgacagaccttatggctggcccgctggtggtttccctgctccccaaggcgagtactactgtggtgttggaactggcaaggtcgtccagcgagatatcgttgaggcccactacaaggcctgcttatacgccggtatccagatttctggaacaaatgccgaggtcatgcctgcccagtgggagtaccaggttggtccctgcactggcatcgagatgggtgaccagctctgggtttctcgcttcttccttcaccgcgtcgccgaggaattcggcgcaaaggtctccctgcaccccaagccaatagccggtgactggaatggcgctggactgcattcaaacttctccaccaaggccatgcgcgaggagggcggcatgaaggttattgaggaggccctgaagaagctcgagcctcatcacgtcgagtgcattgccgagtacggcgaggacaacgacctccgcttgactggtcgccatgagaccggctcgatcgactcattctcctggggcgttgccaaccgtggcacaagtattcgtgttccccgcgagactgccgccaagggctacggttacttcgaggaccgtcgtcctgcttccaacgctgacccttaccgggtcaccaaggtgctcctccaattctccatggaataa

SEQ ID NO: 2106 - protein, 354 aa, Gibberella zeae PH-1
MAAPITSRTETLQKYLKLDQKGMIMAEYVWVDAEGGTRSKSRTLPEKDYKPEDLPVWNFDGSSTKQAPGENSDVYLRPCAVYPDPFRGSPNIIVLAECYDSDGTPNKYNFRHDCVKVMKTYADEEPWFGLEQEYTLLGSDDRPYGWPAGGFPAPQGEYYCGVGTGKVVQRDIVEAHYKACLYAGIQISGTNAEVMPAQWEYQVGPCTGIEMGDQLWVSRFFLHRVAEEFGAKVSLHPKPIAGDWNGAGLHSNFSTKAMREEGGMKVIEEALKKLEPHHVECIAEYGEDNDLRLTGRHETGSIDSFSWGVANRGTSIRVPRETAAKGYGYFEDRRPASNADPYRVTKVLLQFSME

SEQ ID NO: 2107 - DNA, 1038 bp, Aspergillus nidulans FGSC A4
  CDS (1)..(1038)
atgaagtacatgagcctcgaccagcgagggtcggtcatggctgagtacatttggatcgacgcccacggcggtactcgaagtaagacaaagactctttctaaggccccttctagcgttgatgagctccccgaatggaatttcgacggttcatcaacagctcaggcccccggtgacaactcagatgtctaccttcgccctgtcgctatgtaccccgatcctttccgtcgcggcgataacatcctcgttctctgtgagacatgggactctgatggaagccccaacaagttcaactaccgtcacgactgcgcccgtctgatggaaacgcatgccaaggaggagttctggtttggtcttgagcaagagtacacccttctcggccctgacggctggccttacggttggcccaagggcggtttccccggtgcccagggaccgtactactgtggtgtcggtaccggcaaggtctactgccgtgacatcgttgaggcgcactaccgcgcctgtctctacgccggtgttaagatctctggtatcaacgcggaggtcatgccctctcaatgggagtaccaggttggtccttgccatggcatcgaaatgggtgaccacctctggatctctcgtttccttctccaccgcgtcgccgaagagttcggtgtgaagatctccttcgatcctaagcccatcaagggtgactggaacggtgccggtctgcacactaacgtctcaacgacgtcaacacgtgccgagggtggcatcaaggccattgagtcgtacatgaagaaacttgaagcccgccatgtcgagcacattgccgtctacggtgagggtaacgaggagcgtctcactggtcgtcacgagactggtaacatcgacaagttctcatacggtgttgctgaccgtggtggctccatccgaattccccggcaagtcgccaaggatggtaagggttacttcgaagaccgccgccccgcttccaacgcggacccttaccagattactggtatcattgctgaaactgtaagtttttctaatcgatga

SEQ ID NO: 2108 - protein, 345 aa, Aspergillus nidulans FGSC A4
MKYMSLDQRGSVMAEYIWIDAHGGTRSKTKTLSKAPSSVDELPEWNFDGSSTAQAPGDNSDVYLRPVAMYPDPFRRGDNILVLCETWDSDGSPNKFNYRHDCARLMETHAKEEFWFGLEQEYTLLGPDGWPYGWPKGGFPGAQGPYYCGVGTGKVYCRDIVEAHYRACLYAGVKISGINAEVMPSQWEYQVGPCHGIEMGDHLWISRFLLHRVAEEFGVKISFDPKPIKGDWNGAGLHTNVSTTSTRAEGGIKAIESYMKKLEARHVEHIAVYGEGNEERLTGRHETGNIDKFSYGVADRGGSIRIPRQVAKDGKGYFEDRRPASNADPYQITGIIAETVSFSNR

SEQ ID NO: 2109 - DNA, 1122 bp, Candida albicans SC5314
  CDS (1)..(1122): transl_table=12
atgactacttcccttacagaacaaactgctattttggccaaatatttggaattgtctcaaaatggtaaaatcttagctgaatacgtctggattgatgctgaaggtaacactagatccaaatgtagaactttatccaaaaaaccaactagtgttgatgatttacctgaatggaattatgatggttcatctactggtcaagctccaggccatgattctgatgtgtatttaagaccagttgctttttatcctgatccatttagaaaaggtgacaatatcattgttttaaatgaatgttggaacaatgatggtactccaaacaaatttaatcatcgtcatgaatgtgctaaattgatgaaggctcatgctagtgaagaagtttggtttggtttagaacaagaatatactttatttgatcaatatgattatccttatggttggccaaaaggtggattcccagctcctcaaggtccattctactgtggggttggtactggtaaagttgttgctagagatgtcattgaagctcattatcgtgcttgtctttatgctggtatcaacatttctggtattaatgccgaagttatgccatctcaatgggaattccaagttggtccatgtgaaggtattgaaatgggtgatcaattatggattgctcgttatttattacaaagagttgctgaagaatttgccgtcaagatttccttccatccaaaacctttgaaaggtgattggaatggtgctggttgtcatactaatgtttctaccaaatctatgagagtgcctggtggtatgaaagttattgaatctgctttgagtaaattggccaaaagacacaaggaacatatgttattgtatggtgccgataatgatcaaagattaactggtcgtcatgaaactggtcatatggatactttttcatcaggtgttgctaacagaggtgcatctatcagaattccaagacaagttgctaaagaaggatatggttatttcgaagatagaagaccagcttctaacattgatccatacttggtcactggtatcatggtggagacaatctgtggttctattccagatgctgatatggctaaagaattccttagagaaagcagtgatgataactaa

SEQ ID NO: 2110 - protein, 373 aa, Candida albicans SC5314
MTTSLTEQTAILAKYLELSQNGKILAEYVWIDAEGNTRSKCRTLSKKPTSVDDLPEWNYDGSSTGQAPGHDSDVYLRPVAFYPDPFRKGDNIIVLNECWNNDGTPNKFNHRHECAKLMKAHASEEVWFGLEQEYTLFDQYDYPYGWPKGGFPAPQGPFYCGVGTGKVVARDVIEAHYRACLYAGINISGINAEVMPSQWEFQVGPCEGIEMGDQLWIARYLLQRVAEEFAVKISFHPKPLKGDWNGAGCHTNVSTKSMRVPGGMKVIESALSKLAKRHKEHMLLYGADNDQRLTGRHETGHMDTFSSGVANRGASIRIPRQVAKEGYGYFEDRRPASNIDPYLVTGIMVETICGSIPDADMAKEFLRESSDDN

SEQ ID NO: 2111 - DNA, 1122 bp, Candida albicans SC5314
  CDS (1)..(1122): transl_table=12
atgactacttcccttacagaacaaactgctattttggctaaatatttggaattgtctcaaaatggtaaaatcttagctgaatacgtttggattgatgctgaaggtagcactagatccaaatgtagaactttatccaaaaaaccaactagtgttgatgatttgcctgaatggaattatgatggttcatctactggtcaagctccaggtcatgattctgatgtgtatttaagaccggttgctttttatcctgatccatttagaaaaggtgacaatatcattgttttaaatgaatgttggaacaatgatggtactccaaacaaatttaatcatcgtcatgaatgtgctaaattgatgaaggctcatgctagtgaagaagtttggtttggtttagaacaagaatatactttatttgatcaatatgattatccttatggttggccaaaaggtggattcccagctcctcaaggtccattctactgtggggttggtactggtaaagttgttgctagagatgtcattgaagctcattatcgtgcttgtctttatgctggtatcaacatttctggtattaatgccgaagttatgccatctcaatgggaattccaagttggtccatgtgaaggtattgaaatgggtgatcaattatggattgctcgttatttattacaaagagttgctgaagaatttgccgtcaagatttccttccatccaaaacctttgaaaggtgattggaatggtgctggttgtcatactaatgtttctaccaaatctatgagagtgcctggtggtatgaaagttattgaatctgctttgagtaaattggccaaaagacacaaggaacatatgttattgtatggtgccgataatgatcaaagattaactggtcgtcatgaaactggtcatatggatactttttcatcaggtgttgctaacagaggtgcatctatcagaattccaagacaagttgctaaagaaggatatggttatttcgaagatagaagaccagcttctaacattgatccatacttggtcactggtatcatggtggagacaatctgtggttccattccagatgctgatatggctaaagaattccttagagaaagcagtgatgataactaa

SEQ ID NO: 2112 - protein, 373 aa, Candida albicans SC5314
MTTSLTEQTAILAKYLELSQNGKILAEYVWIDAEGSTRSKCRTLSKKPTSVDDLPEWNYDGSSTGQAPGHDSDVYLRPVAFYPDPFRKGDNIIVLNECWNNDGTPNKFNHRHECAKLMKAHASEEVWFGLEQEYTLFDQYDYPYGWPKGGFPAPQGPFYCGVGTGKVVARDVIEAHYRACLYAGINISGINAEVMPSQWEFQVGPCEGIEMGDQLWIARYLLQRVAEEFAVKISFHPKPLKGDWNGAGCHTNVSTKSMRVPGGMKVIESALSKLAKRHKEHMLLYGADNDQRLTGRHETGHMDTFSSGVANRGASIRIPRQVAKEGYGYFEDRRPASNIDPYLVTGIMVETICGSIPDADMAKEFLRESSDDN

SEQ ID NO: 2113 - DNA, 1200 bp, Ustilago maydis 521
  CDS (1)..(1200)
atggctgttcccttcatcaagaaccctgcttgtgtcgtcaatgttgcatgcctcgcactcgctcgccaggtccgtagcacaggtcttgcaattgtagcgcccttactgaccgcctcgcctttcgtcttgctctgtcttacctctgcttgtctgaaaacaggtctcgtcaacccctacttcgagctcgaccagcgcggaaaggtccaggccgagtacatctggatcgacggcgatggtgaaattcgcggcaagaccaccaccctcgatggccccgtcaagtcgcttaaggacctcaaggagtggaactttgacggttcttccaccaaccaggcccctggcggcaactcggatgtctacctccgccccgtcgcttactaccccgaccctttccgtcgtggtgacaacgtcattgtccttgccgaatgctacaacaacgatggcacccctaacaagtcgaactaccgttaccagtgcaacaagatcatgacccagatcgccgacgagaagccctggttcggtctcgagcaggaatactcgctctttgacatggacgaccgcccgtacggttggcccaagggtggtttccctggcccccagggtccttactactgcggtgccggtgccggtaaggtatttgcccgtgaccttgtcgaggcccactaccgtgcctgcctctactcgggtgtcaacatctcgggcatcaacgccgaggtcatgcctgctcaatgggagttccaggtcggcccttgcgagggtatcgagatgggtgaccacctcactcttgcccgttacctcctcatccgagttgccgaagagtggggtgtcaaggtctcgttccaccccaaggctgtccccggtgactggaacggcgctggttgccacaccaactactcgaccgcttccatgcgcaaagagggcggtatgaaggcgatcgaggctgctatcgagaagctctcgaagcgccacaacgagcacattgctgtctacggtgccgacaatgacaagcgtcttactggtaagcacgagacgggccacattggtgacttctcgtccggtgttgccaaccgtggtgcttcaattcgtatcccccgtcacgttgcggcgcaaggctacggttaccttgaggacaggcgtcccgcttccaactgcgacccttaccttgtcactggtatcgtcgccgagaccaccctgcttctctaa

SEQ ID NO: 2114 - protein, 399 aa, Ustilago maydis 521
MAVPFIKNPACVVNVACLALARQVRSTGLAIVAPLLTASPFVLLCLTSACLKTGLVNPYFELDQRGKVQAEYIWIDGDGEIRGKTTTLDGPVKSLKDLKEWNFDGSSTNQAPGGNSDVYLRPVAYYPDPFRRGDNVIVLAECYNNDGTPNKSNYRYQCNKIMTQIADEKPWFGLEQEYSLFDMDDRPYGWPKGGFPGPQGPYYCGAGAGKVFARDLVEAHYRACLYSGVNISGINAEVMPAQWEFQVGPCEGIEMGDHLTLARYLLIRVAEEWGVKVSFHPKAVPGDWNGAGCHTNYSTASMRKEGGMKAIEAAIEKLSKRHNEHIAVYGADNDKRLTGKHETGHIGDFSSGVANRGASIRIPRHVAAQGYGYLEDRRPASNCDPYLVTGIVAETTLLL

SEQ ID NO: 2115 - DNA, 1062 bp, Frankia sp. CcI3
  CDS (1)..(1062): transl_table=11
gtgagttatcaggccgagtacatctggatcgacggcaccgagcccgagccgctgatgcgcagcaagacccgcatcatcagggacggtaaggaaccggagatctggggcttcgacggctcgagcaccaaccaggcgcccggatcgaactcggactgcgtgctgcggcccgtcttcgtcacgcccgacccgctgcggggtggcgacaacctcctggtgctctgcgaggtcgagctgaccgacttcacgccgcacccgacgaacacccgggccgccgcccggaccgtcgccgagaagtacgccgacatgacgccgatgttcggcatcgagcaggagtacaccttcttcaaggacggccgtccctacggctggccggaggtcggctaccccgcgccgcagggaccgtactactgtggcgtcggcggctcgaagatgcccggccgccagatcgtcgagaggcacgcgcaggcctgcctcgacgccggtctcgccatcgagggcaccaacgccgaggtcatgatgggccagtgggagttccagatcggcgtgctccccgccccggcgatcggcgaccagatctggttgggccgctggctgctccaccggatcgccgaggactacggcgtcgaggtgtcgttcgccgccaagccgatcccgggcgactggaacggcgccggcgcgcacaccaacttctccaccaggcagacgatggagggctgggacgccatcgtcgcctgctgcgaggcgctcggcacccgggtgctggagcacgtgacccactacggtcacggcatccaggaccggctgaccggtaagcacgagacagctccgtggaacaagttctcctggggcgcctccgaccgcggcgcgtcgatccgcattccgtgggctgtcgagaaggccaagaagggctggctggaagaccgccgcccgaacgcgaacatggacccgtacctggtctccgcgctcatgatcgacacctgctgcagcgccttggccggcgacaagccgacgctgttcgtgccgtcccagaccaccccgaccccggccgaggcgaccgtctga

SEQ ID NO: 2116 - protein, 353 aa, Frankia sp. CcI3
MSYQAEYIWIDGTEPEPLMRSKTRIIRDGKEPEIWGFDGSSTNQAPGSNSDCVLRPVFVTPDPLRGGDNLLVLCEVELTDFTPHPTNTRAAARTVAEKYADMTPMFGIEQEYTFFKDGRPYGWPEVGYPAPQGPYYCGVGGSKMPGRQIVERHAQACLDAGLAIEGTNAEVMMGQWEFQIGVLPAPAIGDQIWLGRWLLHRIAEDYGVEVSFAAKPIPGDWNGAGAHTNFSTRQTMEGWDAIVACCEALGTRVLEHVTHYGHGIQDRLTGKHETAPWNKFSWGASDRGASIRIPWAVEKAKKGWLEDRRPNANMDPYLVSALMIDTCCSALAGDKPTLFVPSQTTPTPAEATV

SEQ ID NO: 2117 - DNA, 1038 bp, Francisella tularensis subsp. holarctica
  CDS (1)..(1038): transl_table=11
atgaaagtaataaccgctgaatacatatgggctgatggttcagatcctgtgcctcatcttagatctaaagcaagagttttaccatttaaagaatttgaaactccagatgaatttccagaatggagttttgatggttcttcaacaaaccaagctacaggagataactcagattgtattcttaaacctgttaactttgtaattgatccactaagagattatggttacttagtattatgtgaagtttataatccagatggacaaactccgcatgcgacaaataatcgtgccaagctaagagctctattagctagtgctgactgccaagatatgtgggcaggtttcgaacaagagtatacaatgttcaaagatggtagaccacttggatggcctactacaggatttcctggtccacaaggtccttattattgtagtgctggtaatagcaaagcttttggtcgtgacttagttgaggctcatatgcaggcgtgtctagaggcgggaattttattctatggtataaatgctgaagttatgccagggcaatgggaatttcaaattggctatagaggtgttgatggtgaggacgctggtatattaaatgttgcagaccatactcaccttgctagatggctactagagagacttggtgaagaatatggtattgatatatcttttgataacaaacctatcaaaggcgactggaatggtgctggtcttcatactaacttctctacgagtaaaactagaaatcctcaaacaggtagagaagctattaagaagatatgtgcagcattagaaaaaaatcataaaaaagatatcttaaactatggtcacaatcttcatgagagattaacaggtaaactagaaacttctgatatgaatactttcagtgttggagatgctgatagaggatgttctattagaatcccaagacctgttgcacttaagggctatggctaccttgaagatagaagacctggcgcaaatgctgatccttatgttattgctatggctttagctaatgctgctataaactaa

SEQ ID NO: 2118 - protein, 345 aa, Francisella tularensis subsp. holarctica
MKVITAEYIWADGSDPVPHLRSKARVLPFKEFETPDEFPEWSFDGSSTNQATGDNSDCILKPVNFVIDPLRDYGYLVLCEVYNPDGQTPHATNNRAKLRALLASADCQDMWAGFEQEYTMFKDGRPLGWPTTGFPGPQGPYYCSAGNSKAFGRDLVEAHMQACLEAGILFYGINAEVMPGQWEFQIGYRGVDGEDAGILNVADHTHLARWLLERLGEEYGIDISFDNKPIKGDWNGAGLHTNFSTSKTRNPQTGREAIKKICAALEKNHKKDILNYGHNLHERLTGKLETSDMNTFSVGDADRGCSIRIPRPVALKGYGYLEDRRPGANADPYVIAMALANAAIN

SEQ ID NO: 2119 - DNA, 1020 bp, Cytophaga hutchinsonii ATCC 33406
  CDS (1)..(1020): transl_table=11
atggcaaaggtaaagtcaaaattagagtacatctggcttgatggttacaaaccaactcaaagcttacgtagcaagactaaaattgaagagaattttagcggtaaattagaagacctgagcaactggtcatttgatggttcttcaacagaacaagcaaaaggtggttcttctgactgtttattgaaaccagtatttgtttgcccggatcctcagagaaaaaacggttatttagtaatgtgtgaagtattgaatgctgatggtactccgcaccctacaaatggccgtgctcagattgaagatgatgacaatgatttctggttcggtttcgaacaggaatatttcttatatgatttatctacaaacatgccgttaggtttccctgctggtggatatccaaaaccacaaggaccttactactgttcagtaggtgcacagaatgcttacggtcgtgagatcattgaagagcatttggatgtatgtcttgacgctggcttgaacgttgaaggtatcaacgctgaggtagctgcaggtcagtgggaattccagatcttcgctaaaggtgcgaaacgtgccggagatgaaatctgggttgctcgttacttattagaaagaatcggggagaaatacggtgtttatgttaactaccactgtaagccgcttggcgaccttgactggaatggttcaggtatgcacgcgaacttctctaacacattattaagaactgccggaagcaaagaagtattcgataaagtatgtgaagcattccgtccggttgttaaagagcacatcgaagtgtacggtgcacacaacgaattacgtttaactggtaagcacgagactgcaagtattcatgatttcagctacggtgtatctgatcgtggtgcttctatccgtatcccggttttagttccggcaaaaggctggagcggttacttagaagatcgtcgtccgaactctgcggctgatccatacaaagttgctgcacgtatcatcaaaacagttaagccggttcagcgctaa

SEQ ID NO: 2120 - protein, 339 aa, Cytophaga hutchinsonii ATCC 33406
MAKVKSKLEYIWLDGYKPTQSLRSKTKIEENFSGKLEDLSNWSFDGSSTEQAKGGSSDCLLKPVFVCPDPQRKNGYLVMCEVLNADGTPHPTNGRAQIEDDDNDFWFGFEQEYFLYDLSTNMPLGFPAGGYPKPQGPYYCSVGAQNAYGREIIEEHLDVCLDAGLNVEGINAEVAAGQWEFQIFAKGAKRAGDEIWVARYLLERIGEKYGVYVNYHCKPLGDLDWNGSGMHANFSNTLLRTAGSKEVFDKVCEAFRPVVKEHIEVYGAHNELRLTGKHETASIHDFSYGVSDRGASIRIPVLVPAKGWSGYLEDRRPNSAADPYKVAARIIKTVKPVQR

SEQ ID NO: 2121 - DNA, 1041 bp, Rhizobium leguminosarum bv. viciae 3841
  CDS (1)..(1041): transl_table=11
atgacaaaatataagctcgagtatatttggctcgatgggtacactccggtaccgaacctgcgtggcaagacgcagatcaaggaattcgacgtattcccgacgctggaacagcttccgctctggggctttgacggatcctcgacgcagcaggctgaaggccgcagctccgattgcgtgctgaagccggtcgccatctatcccgacccggcccgtaccaacggcgctctcgtcatgtgcgaagtcatgatgccggatggcgtcacgccgcacgcatcgaatgcccgcgccaccatcctcgacgacgaagatgcatggttcggcttcgagcaggaatatttcttttaccagaacggccgtccgctcggcttccctgagcagggctaccccgctccgcagggcccgtactacaccggcgtcggctattcgaacgtcggcgacgttgcccgcgaaatcgtcgaagagcacctcgatctctgcctcgctgccggcatcaatcacgaaggcatcaatgccgaagtggccaagggccagtgggaattccagattttcggcaagggctccaagaaagccgccgaccagatctggatggcacgctacctcttgcagcgcctgaccgaaaagtacgggatcgacatcgagtatcactgcaagccgctcggcgacaccgactggaacggctcgggcatgcattgcaacttctcgaccaagtacatgcgcgaagtcggcggcaaggcctatttcgaagcgctgatggcgcagttcgacaagaacctgatggaccacatcgacgtctacggtcctgacaacgacaagcgcctgaccggcaagcacgagacggctccgtggaacaagttctcctacggcgttgccgaccgtggtgcctcgatccgcgtgccgcactccttcgtcaagaacgactacaagggttatctggaagatcgccgcccgaattcgcagggctgcccctaccagatcgcttcgcaggttctgaagacgatctcggaagttccgaccgcaagctcggcttccgctgcagcttga

SEQ ID NO: 2122 - protein, 346 aa, Rhizobium leguminosarum bv. viciae 3841
MTKYKLEYIWLDGYTPVPNLRGKTQIKEFDVFPTLEQLPLWGFDGSSTQQAEGRSSDCVLKPVAIYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYMREVGGKAYFEALMAQFDKNLMDHIDVYGPDNDKRLTGKHETAPWNKFSYGVADRGASIRVPHSFVKNDYKGYLEDRRPNSQGCPYQIASQVLKTISEVPTASSASAAA

SEQ ID NO: 2123 - DNA, 1035 bp, Xanthobacter autotrophicus Py2
  CDS (1)..(1035): transl_table=11
atgccaaagtttaaactcgagtatatctggctggacggttacaccccgaccccgaatctgcgtggcaagacgcagatcaaggaatacgacgtgtttccgaccctcgagcaactgccgctgtggggcttcgatggcagctccacccagcaggccgaaggccgcagctccgactgcgtgctgaagcccgtggcggtctatcccgatccggcccgcaccgacggcgccctggtcatgtgcgaagtgatgatgcccgatggcgtcaccccgcacccgaccaacaagcgcgccaccatcctcgacgatgccggcgcctggttcggtttcgagcaggaatacttcttctacaaggacggccgtcccctcggcttccccgagcacggctatccggcgccccagggcccgtactacaccggcgtcggcttcaagaatgtcggcaacatcgcccgccagatcgtcgaggagcacctcgacctctgcctcgcggccggcatcaaccacgaaggcatcaacgcggaagtcgcgaagggccagtgggaattccagatcttcggcaagggctccaagaaggcggccgacgaagtgtggatggcgcgctacctgctgctccgtctcaccgagaagtatggcgtggacatcgagttccactgcaagccgctcggcgacaccgactggaacggctcgggcatgcacgccaacttctccaccacctatctgcgcgaagtgggcggcaaggcctatttcgaggcgctgatggcggcgttcgaggccaacctcgaggaccacatcgctgtctacggcccggacaaccacatgcgcctcaccggcaagcatgagaccgcgccgtggaacaagttctcctatggcgtggccgaccgtggcgcgtcgatccgcgtgccccactcgttcgtgaagaacgactacaagggttaccttgaggatcgccgccccaactccatgggcgacccctaccagatcgcctcgcagatcctgaagaccatcgcgtcggttcccaccgacgtgtcggctgcggcctga

SEQ ID NO: 2124 - protein, 344 aa, Xanthobacter autotrophicus Py2
MPKFKLEYIWLDGYTPTPNLRGKTQIKEYDVFPTLEQLPLWGFDGSSTQQAEGRSSDCVLKPVAVYPDPARTDGALVMCEVMMPDGVTPHPTNKRATILDDAGAWFGFEQEYFFYKDGRPLGFPEHGYPAPQGPYYTGVGFKNVGNIARQIVEEHLDLCLAAGINHEGINAEVAKGQWEFQIFGKGSKKAADEVWMARYLLLRLTEKYGVDIEFHCKPLGDTDWNGSGMHANFSTTYLREVGGKAYFEALMAAFEANLEDHIAVYGPDNHMRLTGKHETAPWNKFSYGVADRGASIRVPHSFVKNDYKGYLEDRRPNSMGDPYQIASQILKTIASVPTDVSAAA

SEQ ID NO: 2125 - DNA, 1071 bp, Camellia sinensis
  CDS (1)..(1071)
atgtctctgctctcagatctcatcaacatgaacctctccgactctacggagaagatcattgccgagtacatatggattggtggtactggcttggacctcagaagcaaagcaaggactctttctggacccgttaatgatcccaaaaagcttcccaagtggaattatgatggatctagcacaggtcaagctcctggagaagacagtgaagtgatcatataccctcaagcaatttttaaagatccattcaggaagggaaacaatatattggtcatgtgtgatgcttacactcctgctggtgaaccaattccaaccaacaagaggtacaatgctgagaagattttcagccacactgatgttgttgctgaagaaccttggtatggtattgagcaagagtacaccttgttgcaaaaagatgttaagtggcctatcgggtggccaaagggaggttatcctggacctcagggaccatactactgtggcgctggtgccgacaaagcttttggacgtgatattgttgattcacactacaaggcttgcctttatgccgggattaacataagtggaatcaatggtgaggtgatgccgggccagtgggagtttcaagttggacctgctgttggcatctcagccggggatgaattgtgggtggctcgttacattctagagaggatcactgagatcgctggggttgtggtatcttttgaccccaaacctatcgagggtgattggaatggagccggtgctcatacaaattacagcaccaagtctatgaggaaagatggaggttatcaggtcatcaaaaaggctattgagaagcttggactgaagcacaaagaacatattgctgcatatggtgaaggcaacgagcgtcgtctcactggacgacacgagacagctgacatcaacaccttcttatggggggttgcaaaccgtggtgcatcagttcgtgttggccgagacactgaaaaggcagggaaagggtattttgaggacaggaggcctgcttcgaacatggatccatacgtggttacctccatgattgcagctaccaccattctgtggaagccatga

SEQ ID NO: 2126 - protein, 356 aa, Camellia sinensis
MSLLSDLINMNLSDSTEKIIAEYIWIGGTGLDLRSKARTLSGPVNDPKKLPKWNYDGSSTGQAPGEDSEVIIYPQAIFKDPFRKGNNILVMCDAYTPAGEPIPTNKRYNAEKIFSHTDVVAEEPWYGIEQEYTLLQKDVKWPIGWPKGGYPGPQGPYYCGAGADKAFGRDIVDSHYKACLYAGINISGINGEVMPGQWEFQVGPAVGISAGDELWVARYILERITEIAGVVVSFDPKPIEGDWNGAGAHTNYSTKSMRKDGGYQVIKKAIEKLGLKHKEHIAAYGEGNERRLTGRHETADINTFLWGVANRGASVRVGRDTEKAGKGYFEDRRPASNMDPYVVTSMIAATTILWKP

SEQ ID NO: 2127 - DNA, 1305 bp, Pisum sativum
  CDS (71)..(1141)
gaggattcatcatccaacgatccacagtgattcaatttcaagtttcttttttcttcactttttcaaaaccatgtctcttctttcagatctcatcaaccttgatctctcaggaaccaccgagaaaatcatagcagaatacatatggattggtggttctggtttggacttgaggtgcaaagcaaggactcttcccggaccagttactgacccttcagagctccccaagtggaattatgatggttccagcacaggacaagctcctggacaagatagtgaagttattttatacccacaagccatttttaaggatccattcagaaggggtaaccatatcttggttatgtgtgatgcatacagtcctgctggagaaccaattcctactaacaaaagacacgcagctgctaaggtttttagccatcctgatgttgttgctgaagaaacatggtatggtatagagcaggaatacaccttgttgcagaaagacatcaattggcctcttggttggccagctggtggttatcctggacctcagggaccatattattgcagtgttggtgctgacaaggcttttggccgtgacgttgttgaggcacattacaaagcctgtctttttgccggcatcaacatcagtggaatcaatggagaagtcatgcctggtcaatgggaatttcaagttggtccctcagtcggtatctctgctggtgatgagatatgggttgctcgctacattttggagaggatcactgaggttgctggtgtggttcttacctttgaccctaaaccaattaagggtgactggaatggtgctggtgctcacacaaactacagcaccaagtctatgagagaagacggtggatatgaaatcatcaagaaagcaattgagaagctcgggaagaggcacgccgagcacatctccgcttatggagaaggcaacgagcgcagattgacagggaaacacgaaacagctgacattaataccttctcatggggtgttgcaaaccgaggcgcttcggttcgggttggaagggacacagagaaagaagggaagggttattttgaggacaggaggccagcatctaacatggacccatacgttgttacttccatgattgcagagactaccatcctcttgaaaccataagctaccacttgtaccacaaaaaacttatactacattgtattgcaacctttgagagtcattgttggttcctcgttagagattggttcttggtttttctaggacatggctttgtgttcttgttatggttcacacgttgtttgtttcaaaaaaaaaaaaaaaaaaaa

SEQ ID NO: 2128 - protein, 356 aa, Pisum sativum
MSLLSDLINLDLSGTTEKIIAEYIWIGGSGLDLRCKARTLPGPVTDPSELPKWNYDGSSTGQAPGQDSEVILYPQAIFKDPFRRGNHILVMCDAYSPAGEPIPTNKRHAAAKVFSHPDVVAEETWYGIEQEYTLLQKDINWPLGWPAGGYPGPQGPYYCSVGADKAFGRDVVEAHYKACLFAGINISGINGEVMPGQWEFQVGPSVGISAGDEIWVARYILERITEVAGVVLTFDPKPIKGDWNGAGAHTNYSTKSMREDGGYEIIKKAIEKLGKRHAEHISAYGEGNERRLTGKHETADINTFSWGVANRGASVRVGRDTEKEGKGYFEDRRPASNMDPYVVTSMIAETTILLKP

SEQ ID NO: 2129 - DNA, 1597 bp, Brassica napus
  CDS (97)..(1383)
gtcaactctttctttgccatttgttgcaaacactcaagtctcttgaatcagagttaagtcttctttaagttcccagggatccaagctttaaacaaaatggcgcaaatcttggcagcttctccaacatgtcaaatgaaattgactaaaccgagccccattgcatcttcaaagttatggagctcggttatgttgaaacagaagaaacagaacagcagcaaactcagaagctttaaagcgatggctctccaatctgataacagtacaatcaatagagttgagagtcttctcaatttagacaccaaacctttcactgaccgcatcatcgctgagtacatttggattggaggatcaggaattgaccttaggagcaagtcaaggactcttgaaaagcctgtggaagatccttctgagcttcccaagtggaattatgatggttctagcaccggacaagcacctggtgaagatagtgaagtgattttatatccgcaagctatcttcagagatcctttccgtggaggcaataacatattggttatttgtgatacctacacaccagctggtgagccaattccaacaaacaaacgtgcccgagctgctgagattttcagcaacaagaaggtcaatgaagagattccatggtttggcattgaacaagagtacactttacttcagccaaacgtaaactggcctttgggttggcccgttggagcgtatcctggtcctcagggtccttactactgtggagttggagctgaaaagtcatggggacgtgacatttcagatgctcattacaaagcttgtttatatgcgggaattaacatcagtggtactaatggcgaagttatgccaggacagtgggaattccaagttggcccgagtgtaggaatcgaagcaggtgatcatgtttggtgtgcaagataccttcttgagagaatcacagaacaagctggtgttgtcttaacacttgatcccaaacccatagagggtgactggaacggtgctggttgccataccaattacagtactaaaagcatgagagaggaaggaggatttgatgtgattaaaaaggacatcttgaacctctcgcttcgtcacatggagcacatcagtgcatacggtgaaggcaatgagagaaggttgaccggaaagcacgagacagctagtatcgaccaattctcatggggcgtggctaaccgtggatgctcaattcgtgtgggacgtgataccgagaagaaaggaaaaggttacttggaagatcgacgtccagcatcaaacatggacccatacattgtgacttcactcttggcagagaccacacttctctgggagccgacccttgaggctgaagcacttgcagctcaaaagctttctttgaaggtttaagttaattaaaccaaagctatcataaatctttgaagttaatgtttatctaagtagtcttgccgggataataaatgttatttaaaatgttggttcggataagacattcttgttgtaaacttaaggattacaatccgtaacttcttatcattaattaaaacatatggtgtcttaggaactaattaaaaaaaaaaaaaaaaaaaaaaaaaaaaaaaaa

SEQ ID NO: 2130 - protein, 428 aa, Brassica napus
MAQILAASPTCQMKLTKPSPIASSKLWSSVMLKQKKQNSSKLRSFKAMALQSDNSTINRVESLLNLDTKPFTDRIIAEYIWIGGSGIDLRSKSRTLEKPVEDPSELPKWNYDGSSTGQAPGEDSEVILYPQAIFRDPFRGGNNILVICDTYTPAGEPIPTNKRARAAEIFSNKKVNEEIPWFGIEQEYTLLQPNVNWPLGWPVGAYPGPQGPYYCGVGAEKSWGRDISDAHYKACLYAGINISGTNGEVMPGQWEFQVGPSVGIEAGDHVWCARYLLERITEQAGVVLTLDPKPIEGDWNGAGCHTNYSTKSMREEGGFDVIKKDILNLSLRHMEHISAYGEGNERRLTGKHETASIDQFSWGVANRGCSIRVGRDTEKKGKGYLEDRRPASNMDPYIVTSLLAETTLLWEPTLEAEALAAQKLSLKV

SEQ ID NO: 2131 - DNA, 1344 bp, Brassica napus
  CDS (32)..(1102)
ctacaaccttcttgtcattttctctgtaaccatgagtcttctgaccgatctcgttaaccttgacctctcagacaacactgagaaaatcatcgctgaatacatatgggttggtggttcaggaatggatatgagaagcaaagccaggactctccctggacctgtgaccgatccatcaaagctcccaaaatggaattatgatggttcaagcactggccaagctcctggtgaagacagtgaagtgatcttataccctcaagcgattttcaaagatccgttccgtagaggcaacaacattcttgtcatgtgtgatacttacacccctgcgggtgaaccaatccctacgaacaagagacatgctgcagctcagatctttagcaaccctgatgttgttgctgaagtgccatggtatggaatcgaacaagagtacactctgttgcagaaagatgtgaagtggcctgttggatggcccattggtggattccccggccctcagggaccatactactgcagtgttggagctgacaaatcttttggaagagacattgttgatgctcactacaaggcttgtttgtatgccggaattaacatcagtggaatcaatggagaagtcatgcctggtcagtgggagttccaagtcggaccatcggttggtatctcagctgctgatgaagtgtggattgctcgttacattttggagaggatcacagagattgctggtgtggttgtatcttttgacccaaaaccaattccgggtgactggaacggagctggtgctcacaccaattacagtactaaatcgatgagggaggaaggaggatacgagataatcaagaaggcaattgataagctcggactgagacacaaggagcacatttctgcttacggtgaaggcaacgagcgtcgtctcaccggacaccatgaaactgctgacatcaacactttcaaatggggtgttgcaaaccgtggagcatcaatccgtgtaggacgtgacacggagaaggaagggaaaggatactttgaggataggaggccagcttccaacatggacccttacactgtaacttccatgattgcagagactacacttctttggaatccttgaagaaatatgacaataatataacttgaatctggttctctggggcttcaagtttgtgttttctacagtttattaagcaattaccgggttgatactgccggagtttgtggtttgaggctttcttttaatctctttgtgttttggggtttgtgattgaagcaaaaaccctgatttgctctgtttctttgaccttttatttgaaccctttgtatttctattaataagacgatctgagaaggccaaaa

SEQ ID NO: 2132 - protein, 356 aa, Brassica napus
MSLLTDLVNLDLSDNTEKIIAEYIWVGGSGMDMRSKARTLPGPVTDPSKLPKWNYDGSSTGQAPGEDSEVILYPQAIFKDPFRRGNNILVMCDTYTPAGEPIPTNKRHAAAQIFSNPDVVAEVPWYGIEQEYTLLQKDVKWPVGWPIGGFPGPQGPYYCSVGADKSFGRDIVDAHYKACLYAGINISGINGEVMPGQWEFQVGPSVGISAADEVWIARYILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYTVTSMIAETTLLWNP

SEQ ID NO: 2133 - DNA, 1425 bp, Medicago truncatula
  CDS (73)..(1143)
cctctatagctatttgtctattacttgcttttcacacactgtgttcttcttcttccttcactattcatcatcatgtctttgctttcagatctcatcaacctcaatctctcagaatcctctgaaaagattattgctgaatacatatgggttggtggatctggtatggaccttagaagcaaagccaggactctacctggtccagtgagtgacccttcaaaacttcctaaatggaactatgatggatcaagcacaaatcaagctccaggacaagatagtgaagttatcttatatccacaagctattttcaaggatccatttagacaaggcaacaatattcttgtgatttgtgatgtttacaccccagctggtgagccactcccaacaaacaagaggtacaatgctgccaaaattttcagccaccctgatgttgctgctgaggtaccatggtatggaattgagcaagaatatacattattgcagaaagatactaattggccactaggatggcctattggtggctatccaggaccacaaggcccatattattgtgggattggtgctgataaagcctatggtcgtgacattgttgatgcacattacaaagcttgtctttatgctggcattaacattagtggcatcaatggagaggttatgcctggtcagtgggagttccaagttggcccttctgttggtatttctgctggagatgagatatgggctgctcgttacattctagagaggatcacagagatagctggagtggttgtttcatttgaccctaagccaattccgggtgattggaatggagctggtgctcacacaaactatagcaccaagtcaatgagagagaatggaggctatgaaatcatcaagaaggccattgaaaagcttggattgaggcataaggaacacattgctgcctatggagaaggaaatgagagacgtctcactggaaaacatgaaacagcagacatcaacaccttttcttggggtgtggcaaaccgtggtgcatctgttagggttggaagagacacagaaaaagatggcaaaggttactttgaggatagaaggccttcttctaatatggatccctatgtggttacttccatgattgctgaaactacccttctatggaaaccatgaagtcacaaccacttgtctttggatttggaccacatcacattatgtgttcaataaatagactagtttatatctattatcattatcattatgcaaagtgttgcttcattagtagtaattgtccaagtggtctttaagcacaaagcatttagtccatgtatttggatgaaaataattttatcattaataacatggttgcttcttgattttactctaataatttcatggatcaataatgcaatgtttgttgctctttcttggattcaaaaaaaaaaaaaaaaaaaa

SEQ ID NO: 2134 - protein, 356 aa, Medicago truncatula
MSLLSDLINLNLSESSEKIIAEYIWVGGSGMDLRSKARTLPGPVSDPSKLPKWNYDGSSTNQAPGQDSEVILYPQAIFKDPFRQGNNILVICDVYTPAGEPLPTNKRYNAAKIFSHPDVAAEVPWYGIEQEYTLLQKDTNWPLGWPIGGYPGPQGPYYCGIGADKAYGRDIVDAHYKACLYAGINISGINGEVMPGQWEFQVGPSVGISAGDEIWAARYILERITEIAGVVVSFDPKPIPGDWNGAGAHTNYSTKSMRENGGYEIIKKAIEKLGLRHKEHIAAYGEGNERRLTGKHETADINTFSWGVANRGASVRVGRDTEKDGKGYFEDRRPSSNMDPYVVTSMIAETTLLWKP

SEQ ID NO: 2135 - DNA, 1488 bp, Medicago truncatula
  CDS (145)..(1215)
aaataaagacccaactctgcctcatttctctctctattcacaatatttccgttttgattttcatttgattcattcattgaatcaaatcgaatctttaggattcaatacagattccttcgattttactaagtttgaaaccaaaacatgtctctcctttcagatctcatcaaccttgacctctccgaaaccaccgagaaaatcatcgccgaatacatatggattggtggatctggtttggacttgaggagcaaagcaaggactctaccaggaccagttactgacccttcacagcttcccaagtggaactatgatggttccagcacaggtcaagctcctggagaagatagtgaagttattatatacccacaagccattttcaaggatccattcagaaggggtaacaatatctttgttatgtgtgatgcatacactccagctggagaacccattcccaccaacaagagacacgcagctgccaaggttttcagccatcctgatgttgttgctgaagtaccatggtatggtattgaacaagaatacaccttgttgcagaaagacatcaactggcctcttggttggccagttggtggttttcctggacctcagggaccatactattgtggtgctggtgctgacaaggcatttggccgtgacattgttgactcacattacaaagcctgtctttatgccggcatcaacatcagtggaatcaatggtgaagtgatgcctggtcaatgggaattccaagttggtccctcagttggcatctctgctggtgatgaaatttgggttgctcgttacattttggagaggatcactgagattgctgatgtggtgctttcctttgacccaaaaccaattaagggtgattggaatggtgctggtgctcacacaaattacagcaccaagtctatgagagaagatggtggctatgaagtcatcttgaaagcaattgagaagcttgggaagaagcacaaggagcacattgctgcttatggagaaggcaacgagcgtaggttgacagggcgacatgagacggctgacattaacaccttcttatggggtgttgcaaaccgtggtgcgtcgattagagttggaagggacacagagaaagcaggaaaaggttatttcgaggacaggaggccatcatctaacatggatccatatgttgttacttccatgattgcagacaccaccattctctggaaaccataagccaccacgctacttctgctataaaacacacacatgcattgtagtctttcaaagtcattgttgattccgcattagaatttggtcattggtttttctaggatttgatttgtgttattgttatggttcacactttgtttgtttggatctgagtccttgttatggtttcatatttctttttcttgttctaagtaaatgtctgaataataatgtaatgattatcggtaaaataattattgttgattatgattattgataaaaaaaaaaaaaaaaaaa

SEQ ID NO: 2136 - protein, 356 aa, Medicago truncatula
MSLLSDLINLDLSETTEKIIAEYIWIGGSGLDLRSKARTLPGPVTDPSQLPKWNYDGSSTGQAPGEDSEVIIYPQAIFKDPFRRGNNIFVMCDAYTPAGEPIPTNKRHAAAKVFSHPDVVAEVPWYGIEQEYTLLQKDINWPLGWPVGGFPGPQGPYYCGAGADKAFGRDIVDSHYKACLYAGINISGINGEVMPGQWEFQVGPSVGISAGDEIWVARYILERITEIADVVLSFDPKPIKGDWNGAGAHTNYSTKSMREDGGYEVILKAIEKLGKKHKEHIAAYGEGNERRLTGRHETADINTFLWGVANRGASIRVGRDTEKAGKGYFEDRRPSSNMDPYVVTSMIADTTILWKP

SEQ ID NO: 2137 - DNA, 1333 bp, Raphanus sativus
  CDS (37)..(1101)
ttcacctaaacaaacactgattctcgtaacgccgccatgtctctcctctcagatctcgtcaacctcaacctctctgactccaccgagaaaatcatcgctgaatacatatggatcggtggatctggaatggacatcagaagcaaagccagaacgctcccaggaccagtgagcgatccatcaaagcttcccaagtggaactacgacggatccagcaccggtcaggccgctggagatgatagtgaagtcattatataccctcaggcgatcttccgtgatccgttcaggagaggcaacaacattctggtgatgtgtgatgcttacacaccggccgggaatccaattcctaccaacaagagacacaacgctgctaagatctttagcacctccaaagttgcctccgaggagccttggtatgggattgagcaagagtacacattgatgcagaagggtgtgaactggcctattggttggcctgttggtggcttccctggcccacagggaccatactactgtggtgtgggagctgacaaagccattggtcgtgacattgtcgatgcacactacaaggcctgtctctacgcaggtatcagcatctctggtgtcaatggagaagtcatgcctggccagtgggagttccaagtcggtccagttgaaggtattagcgctggtgatcaagtctgggtcgctagattccttctcgagaggatcactgagatctctggtgtaaatgtcagcttcgacccaaaaccagtcccgggtgactggaacggggctggagctcactgcaactacagtacgaagtcgatgaggaacgacggaggattagcggtgatcaagaaagccatagagaagcttcaggtgaagcacaaggagcacattgctgcttacggtgaaggcaacgagcgtcgtctcacggggaagcacgagacggcagacatcaacacgttctcttggggagtggcgaaccgtggagcttcggttagagtgggacgtgacactgagaaagaaggcaaaggttacttcgaggacagaaggccggcttctaacatggatccttatgtcgttacgtccatgattgctgaaaccaccatcctcggttaaaagtcatcacattttagtaatgtttggttttctccggtttggttttatgatttgaagacttttctgcttgtgatgacattttgtgtttttttcttcttttagtttcgaataattaaaataaagtattcttgtggtgaaaatttgatcagcgacttttgtgttgtgttgctgttgttgaaatgataataataacaaggaagtacggcctggcatgttacaggttgaactaatt

SEQ ID NO: 2138 - protein, 354 aa, Raphanus sativus
MSLLSDLVNLNLSDSTEKIIAEYIWIGGSGMDIRSKARTLPGPVSDPSKLPKWNYDGSSTGQAAGDDSEVIIYPQAIFRDPFRRGNNILVMCDAYTPAGNPIPTNKRHNAAKIFSTSKVASEEPWYGIEQEYTLMQKGVNWPIGWPVGGFPGPQGPYYCGVGADKAIGRDIVDAHYKACLYAGISISGVNGEVMPGQWEFQVGPVEGISAGDQVWVARFLLERITEISGVNVSFDPKPVPGDWNGAGAHCNYSTKSMRNDGGLAVIKKAIEKLQVKHKEHIAAYGEGNERRLTGKHETADINTFSWGVANRGASVRVGRDTEKEGKGYFEDRRPASNMDPYVVTSMIAETTILG

SEQ ID NO: 2139 - DNA, 1484 bp, Raphanus sativus
  CDS (170)..(1240)
gaaaacagaggctctctctccctatctctgtagtatgtaccctcgttgctccctataagtactcccacaaccacgaacaccaaaacatcatctcataaacgaaaaaccacattgtccgagatttaattgtttctcactacaaccttcttgtcagtttttttctgtaaccatgagtcttctgaccgatctcattaaccttgacctctcagacaacactgagaaaatcatcgctgaatacatatgggttggtggttcaggaatggacatgagaagcaaagctaggactctctctggacctgtgaccgatccatcacaactcccaaagtggaactatgatggttcaagcactggccaagctcctggtgaagacagtgaagtgatcttataccctcaagcgattttcaaggatccgttccgtagaggcaaccacattcttgtcatgtgtgatacttacacccctgcgggtgaaccaattcctacgaacaagagacatgctgcagctcagatctttagccaccctgatgttgtagctgaagtgccatggtacggaattgaacaggagtacactctgttgcagaaggatgtgaagtggcctgttggatggcccattggtggcttccctggccctcagggaccatactattgcagtgttggagctgacaaatcttttggaagagacattgttgatgctcactacaaggcttgtttgtatgccggaattaacatcagtgggatcaatggagaagtcatgcctggtcagtgggagttccaagtcggaccatcggttggtatctcagccgctgatgaagtgtggatcgctcgttacattttggagaggatcacagagattgctggtgtggttgtatcttttgacccaaaaccaattcctggtgactggaacggagctggtgctcacacgaactacagtactaagtcgatgagggaggaaggaggatacgagataatcaagaaggcaatcgataagctaggactgagacacaaggagcacatttctgcttatggtgaaggcaacgagcgccgtctcaccgggcaccatgaaactgctgacatcaacactttcaaatggggtgttgcaaaccgtggagcatcaatccgagtaggacgtgacacggagaaggaagggaaaggatactttgaggataggaggccagcttccaacatggacccttacattgttacttccatggttgcagagactactatcctttggaatccttgaagaaatatgacaataatataacttgaatcttttggggtttcaagtttgtgttttctataattatttaagcaattaccgggttgatgttaccggggtttgtggtttggggcctttcttttaatctctttgtgttttgggatttgtgattggagcaaaacctgatttgctctgtttccttgaccttttatttgaccccttaaaatttgtattaataagacgatctgaaaaggccttttcatgtttc

SEQ ID NO: 2140 - protein, 356 aa, Raphanus sativus
MSLLTDLINLDLSDNTEKIIAEYIWVGGSGMDMRSKARTLSGPVTDPSQLPKWNYDGSSTGQAPGEDSEVILYPQAIFKDPFRRGNHILVMCDTYTPAGEPIPTNKRHAAAQIFSHPDVVAEVPWYGIEQEYTLLQKDVKWPVGWPIGGFPGPQGPYYCSVGADKSFGRDIVDAHYKACLYAGINISGINGEVMPGQWEFQVGPSVGISAADEVWIARYILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYIVTSMVAETTILWNP

SEQ ID NO: 2141 - DNA, 1326 bp, Raphanus sativus
  CDS (65)..(1135)
attcgattttatctgtcatttgcgtcaactgttactatcgcgaccaatctcggtgttcgtagccatgagtcttcttacagatctcattaaccttaacctctcggagaccactgacaaaatcattgcggaatacatatgggttggaggttctggaatggatatgagaagcaaagccaggactcttcctggaccagtgagtgacccttcggagctaccaaagtggaactatgatggttcaagcacaggccaagctcctggtgaagatagtgaagtcatcttatacccacaagcgatattcaaagatcctttccgtagagccaataacattcttgtcatgtgcgacgcttacactccagcgggtgaaccaatcccaacaaacaaaagacacgctgcggctaaggtctttagccagcctgatgtggtagctgaagtgccatggtatggtattgagcaagagtatactttacttcagaaagatgtgaagtggcctgttggttggcctattggcggcttccccggtcctcagggaccatactattgtggtgttggagcagataaatcttttggcagagacgttgttgatgctcactacaaggcctgcttatacgctggtatcaacattagtggcatcaatggagaagtcatgccgggtcagtgggagttccaagttggttcagctgttggtatttcggccggtgatgaaatatgggtcgcacgttatattttggagaggatcacggagattgctggcgtggtggtatcttttgacccaaaaccgattccaggtgactggaatggtgctggtgctcactgcaactatagtaccaagtcaatgagggaagatggtggttacgagattatcaagaaggctatcgataaactgggactgagacacaaagaacacattgctgcttacggtgaaggcaatgagcgccgtctcacgggtcaccacgagactgctgacatcaacactttcctctggggtgttgcgaaccgtggagcatcaatccgtgtaggacgtgacacagagaaagaagggaaaggatactttgaggataggaggccggcttcgaacatggaaccttacatcgtgacttccatgattgcagagaccacaatcctctggaacccttgatcagatcgaagaagattgttgaattttcactccatttgggtttcttgcatgattcaacgtttgtatgttctctatcaagcattgtctcagaacaagtcgagagatttgctctgttcttatggcttttattgtttcacatccattgaaaacatctctctgtatcattttatgagtaaagtttggtttggttc

SEQ ID NO: 2142 - protein, 356 aa, Raphanus sativus
MSLLTDLINLNLSETTDKIIAEYIWVGGSGMDMRSKARTLPGPVSDPSELPKWNYDGSSTGQAPGEDSEVILYPQAIFKDPFRRANNILVMCDAYTPAGEPIPTNKRHAAAKVFSQPDVVAEVPWYGIEQEYTLLQKDVKWPVGWPIGGFPGPQGPYYCGVGADKSFGRDVVDAHYKACLYAGINISGINGEVMPGQWEFQVGSAVGISAGDEIWVARYILERITEIAGVVVSFDPKPIPGDWNGAGAHCNYSTKSMREDGGYEIIKKAIDKLGLRHKEHIAAYGEGNERRLTGHHETADINTFLWGVANRGASIRVGRDTEKEGKGYFEDRRPASNMEPYIVTSMIAETTILWNP

SEQ ID NO: 2143 - DNA, 1152 bp, Phaeosphaeria nodorum
  CDS (1)..(1152)
atggcttcctccacgattgtttccaacactgccaacctgcaaaaatacctctcgctccctcagagcggtaaggtcatcgccgaatacgtgtggatcgacggctcgaacggtatccgctcaaaatcaaagactctagacaagaaggtcgagaaggtcgaggagctcccagaatggaactttgacggttcgtcaacgggccaggcgcccggcgacaactcggatgtttacctccgccccgtctccttttaccctgaccccttccgtctgggcgacaacatcctcgtcatgtgcgagacgtacatgtcagacggcaagcccaacgcatacaacttccgccacgacgccgccatcatcttcaagcagcactcggccgccgagttctggttcggtctcgagcaagaatacacgcttctcgacgagtttggctggccatacggctggcccaagaacggcttccctgcgccccagggcccgtactactgcggtgtgggcactggcaaggtcttctgccgtgacattgtcgaggctcactacaaggcatgcctgtacgccaacatcaacatctccggcaccaacgccgaggtcatgcccgcgcaatgggagtaccaagtcggcccctgcccagacatctcgctcggtgaccagctctggatgtcgcgcttcctcctgcaccgcgttgcagaggagttcggcgccaaggtgacgtttgcgcccaagcccatccccggcgactggaacggcgctggtctgcacaccaacgtgtccaccaaggacacccgtgctgacggcggcatgaaggccattgaggccgccatggagaagctctccacccgccaggccgagcacatggccgtgtacggttccgacaaccagctacgcatgacgggcaagcacgagactgcctcatacgacaagttcacctggggcgtggccaaccgcggctcctcggtgcgcatcccccgcgccgtcgcctcggaaaacaagggctacttcgaggaccgccgcccagcgtccaacggtgacccataccagatcacgggcataatcgcagagaccatgtacggcaaggtcgacggcgcggatattgcgcgcttcgcggccaaggccgagtcggttgagcaggagatggttgtcgaagtgcccaagccgtag

SEQ ID NO: 2144 - protein, 383 aa, Phaeosphaeria nodorum
MASSTIVSNTANLQKYLSLPQSGKVIAEYVWIDGSNGIRSKSKTLDKKVEKVEELPEWNFDGSSTGQAPGDNSDVYLRPVSFYPDPFRLGDNILVMCETYMSDGKPNAYNFRHDAAIIFKQHSAAEFWFGLEQEYTLLDEFGWPYGWPKNGFPAPQGPYYCGVGTGKVFCRDIVEAHYKACLYANINISGTNAEVMPAQWEYQVGPCPDISLGDQLWMSRFLLHRVAEEFGAKVTFAPKPIPGDWNGAGLHTNVSTKDTRADGGMKAIEAAMEKLSTRQAEHMAVYGSDNQLRMTGKHETASYDKFTWGVANRGSSVRIPRAVASENKGYFEDRRPASNGDPYQITGIIAETMYGKVDGADIARFAAKAESVEQEMVVEVPKP

SEQ ID NO: 2145 - DNA, 1440 bp, Arabidopsis thaliana
  CDS (92)..(1162)
gatcatctcattaacaaaaataaaacacacaatctcaagattttctacttcttattacaaagattcaatcttcttgtttcttcttgcaaccatgagtcttcttgcagatcttgttaaccttgacatctcagacaacagtgaaaagatcatcgctgaatacatatgggttggtggttctggtatggacatgagaagcaaagccaggactctccctggacctgtgaccgatccatcaaaacttccaaagtggaactatgatggttcaagcactggtcaagctcctggtcaagacagtgaagtgatcttataccctcaagcaattttcaaagatccattccgtagaggcaacaacatccttgttatgtgtgatgcttacactccagcgggagagccaatccctactaacaagcgacatgctgcggctgagatctttgctaaccctgatgttattgctgaagtgccatggtatggaatcgaacaagaatacactttgttgcagaaggatgtgaactggcctcttggatggcccattggtggcttccctggccctcagggaccatactactgcagtattggagctgacaaatcttttggaagagacattgttgatgctcactacaaagcctctttgtatgctggaatcaacatcagtgggatcaatggagaagtcatgccgggacaatgggagttccaagtcggcccatcggtcggtatctcagctgctgatgaaatatggatccctcgttacattttggagaggatcacagagattgctggtgtggttgtatcttttgacccaaaacctattcctggtgactggaatggagctggtgctcacaccaattacagtactaaatcaatgagggaagaaggaggatacgagataatcaagaaggcgatcgagaagcttggcttgagacacaaggaacacatttccgcttacggtgaaggaaacgagcgtcgtctcacgggacaccatgaaactgctgacatcaacactttcctttggggtgttgcgaaccgtggtgcatcgatccgagtaggacgtgacaccgagaaagaagggaagggatactttgaggataggaggccagcttcaaacatggacccttacgttgttacttccatgattgcagagactacactcctctggaacccttgaaaggatgatccgtaactcttgaagttgcttctgattgggttttttggaagttccaagcttgtcttttctctacagtgtgtattaagcaattgtaccggttgacactgccggagtttgtgatttggggcctttctttctttttcttctttttataatcttttgggttctgtggttagagcaaattcggtttgctctgtttgtttgacctttattgaaacctttggtattggtactaataatacaatctgaaaaggcctcttcatgttccaaaaaaaaaa

SEQ ID NO: 2146 - protein, 356 aa, Arabidopsis thaliana
MSLLADLVNLDISDNSEKIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIPRYILERITEIAGVVVSFDPKPIPGDWNGAGAHTNYSTKSMREEGGYEIIKKAIEKLGLRHKEHISAYGEGNERRLTGHHETADINTFLWGVANRGASIRVGRDTEKEGKGYFEDRRPASNMDPYVVTSMIAETTLLWNP

SEQ ID NO: 2147 - DNA, 1308 bp, Stevia rebaudiana
  CDS (7)..(1068)
cccaaaatggctctgctcaacgatcttatcaatctcaacctcacagattccaccgagaaaatcatcgcggaatatatttggattggtggatcgggtatggacctccgaagcaaagcaagaactcttccaaaaccagagagtgatcccaagaagttgccaaaatggaattatgatggttcaagcactggtcaagccccaggagaggacagtgaagttatcctctatcctcaagctattttcaaggatccattcaggggtggaaacaatatcttggtaatctgcgatgcatacactccggccggagagccaattccaaccaacaagagacacgccgctgccaaaatcttcagccacccggaagttgagaaggaagttccatggtacggaattgaacaagaatataccttactgcagaaggatgtcaactggccgttgggctggcccaaaggcgggtttccaggacctcaagggccatattattgtggtattggtgctgataaagcttttgggcgtgatgtcgtcgatgctcactacaaagcttgtctttatgccggattaatattagcggcattaaacggtgaagttatgcctggacagtgggagttccaagtaggaccatcggttggtatttctgctggtgacgagatttgggctgctcgttacattcttgagaggatcactgagattgctgggatagtggtgtcatttgacccaaagcctattcctggtgactggaacggtgctggagctcacacaaactacagcacaaaatcaatgagggaagagggaggatatgagatcatcaagaaagcaattgaaaagttgggcctcaagcacaaagaacacattgctgcttacggtgaagggaatgaacgtcggctcactggccatcacgagaccgccaacatcaacacatttaaatggggtgtcgccaaccgcggggcgtcaattcgtgtcgggcgggacactgagaaggaagggaagggttattttgaggaccgtaggcccgcttccaacatggacccatatgtggttacctcgatgatagccgagacgacactcttgtgaattggtgtttgattattcaattgcgtgggggagaattggatcagaatttggaaacaatccttgtgtttattcgtgtttctgtattttggaagtaattgaagtttggtgataaatcctaggttgtttgttggtaataacgttagtaaatttcattgtctaataacaatgtttacgattggtttaaatcctctatcatctgcttttggctaaaaaaaaaaaaaaaaaaaaaaaaaaaaaaaa

SEQ ID NO: 2148 - protein, 353 aa, Stevia rebaudiana
MALLNDLINLNLTDSTEKIIAEYIWIGGSGMDLRSKARTLPKPESDPKKLPKWNYDGSSTGQAPGEDSEVILYPQAIFKDPFRGGNNILVICDAYTPAGEPIPTNKRHAAAKIFSHPEVEKEVPWYGIEQEYTLLQKDVNWPLGWPKGGFPGPQGPYYCGIGADKAFGRDVVDAHYKACLYAGLILAALNGEVMPGQWEFQVGPSVGISAGDEIWAARYILERITEIAGIVVSFDPKPIPGDWNGAGAHTNYSTKSMREEGGYEIIKKAIEKLGLKHKEHIAAYGEGNERRLTGHHETANINTFKWGVANRGASIRVGRDTEKEGKGYFEDRRPASNMDPYVVTSMIAETTLL

SEQ ID NO: 2149 - DNA, 1161 bp, Helicosporidium sp
  CDS (1)..(1161)
atgtctcctcccactggcgaaaagtactctctgccccccgtcttcgggacgcaggggcagatcacccagctgcttgaccctatcatggctgagcgcttcaaggacctctctcagcacggcaaagtgatggcggagtacgtctggattggcggcacgggcagcgacctgcggtgcaagacccgcgttctggactcggtccccaacagcgtcgaggatctgccggtgtggaactacgacggctcctccacaggccaggcccccggcgacgattcggaagtattcctcatcccccgcgccatctaccgcgatcctttccgcggcggggacaacatcctggtgctggcggacacgtacgagcccccacgcgtgctccccaacggcaaggtttccccccccgtgccgctgcccaccaactcccgccacgcctgcgccgaggccatggacaaggctgcggcgcacgagccctggttcgggatcgagcaggagtacacggtgctggacgcccgcaccaagtggcccctgggctggccctccaacggcttccccggtccccaaggcccttactactgcgcggctggcgcggggtgtgccatcggccgagacctgatcgaggcgcatctcaaggcgtgcctgttcgcgggcatcaacgtctcgggcgtgaacgccgaggtgatgcccagccagtgggagtaccaggtgggtccctgcaccggcatcgaaagcggagaccagatgtggatgagccggtacattctcatccggtgcgccgagctctacaacgtggaggtttctttcgaccccaagcccgtgcctggcgactggaacggcgccggcgggcacgtcaactactccaacaaggccacccgcacggccgagacgggctgggcggccatccagcagcaagtcgagaagctgggcaagcgccatgccgtgcacatcgccgcttacggcgagggcaacgagcgccgcctcacgggcaagcacgagaccagctccatgaacgacttctcgtggggcgtggccaaccgcggcgcctcggtgcgggtgggccgtctcgtgccggtggagaagtgcggctactacgaagaccgacgcccggcctccaacctggacccttacgtggtcacgcgcctgctggtggagaccacgctgctcatgtag

SEQ ID NO: 2150 - protein, 386 aa, Helicosporidium sp
MSPPTGEKYSLPPVFGTQGQITQLLDPIMAERFKDLSQHGKVMAEYVWIGGTGSDLRCKTRVLDSVPNSVEDLPVWNYDGSSTGQAPGDDSEVFLIPRAIYRDPFRGGDNILVLADTYEPPRVLPNGKVSPPVPLPTNSRHACAEAMDKAAAHEPWFGIEQEYTVLDARTKWPLGWPSNGFPGPQGPYYCAAGAGCAIGRDLIEAHLKACLFAGINVSGVNAEVMPSQWEYQVGPCTGIESGDQMWMSRYILIRCAELYNVEVSFDPKPVPGDWNGAGGHVNYSNKATRTAETGWAAIQQQVEKLGKRHAVHIAAYGEGNERRLTGKHETSSMNDFSWGVANRGASVRVGRLVPVEKCGYYEDRRPASNLDPYVVTRLLVETTLLM

SEQ ID NO: 2151 - DNA, 1071 bp, Aspergillus oryzae
  CDS (1)..(1071)
atgtctgaatcaacaaccatctccaacacggagaatctcatgaagtacatgaacctcgaccagcgcggacgcgtgcaggccgagtatgtctggattgactccgttggtggatgccgcagcaagaccaagactctctctaagaaggttacgtccgttgacgaactccccgaatggaacttcgacggttcctcaaccggccaggcccctggtgacaactccgatgtctacctgcgtcccgttgctatctaccccgaccctttccgtcttggtgacaacatcctcgtcctttgcgaaacctgggattcggatggaacccctaacaagtacaaccaccgccacgatgccaaccgcctgatggaggtcaacgccaaggaggagttctggttcggtcttgagcaggagtacaccctcctcggcaacgatggctggccttacggatggcccaagggcggtttccccggtgcccagggtccttactactgcggtgttggaactggcaaggtttactgccgtgacatcgtcgaggctcactaccgtgcttgcttgtacgccggcatcaacatctctggtatcaacgccgaggtcatgccctcccagtgggagtaccaggttggcccctgccccggtatcgagatgggcgaccagctttggatgtcccgtttcctcctccaccgtgtcgctgaagagttcggcgttcgtatctccttcgaccccaagcccatcaagggtgaatggaacggagctggtctccacagcaacgtctccaccgtcgccactcgtgctgagggtggtatgaaggccattgaggcttacatgaagaagttcgaggcccgtcacgttgagcacattgctgtctacggtgagggtaacgaggagcgtctcactggccgccacgagaccggcagcattgataagttcagctacggtgttgccgaccgtggtggtagcattcgtattcctcgccaggtggctaaggatggcaagggttacttcgaggaccgccgccccgccagcaatgcttgcccttaccaaatcactggtatcatcgttgagactctctccaataaatag

SEQ ID NO: 2152 - protein, 356 aa, Aspergillus oryzae
MSESTTISNTENLMKYMNLDQRGRVQAEYVWIDSVGGCRSKTKTLSKKVTSVDELPEWNFDGSSTGQAPGDNSDVYLRPVAIYPDPFRLGDNILVLCETWDSDGTPNKYNHRHDANRLMEVNAKEEFWFGLEQEYTLLGNDGWPYGWPKGGFPGAQGPYYCGVGTGKVYCRDIVEAHYRACLYAGINISGINAEVMPSQWEYQVGPCPGIEMGDQLWMSRFLLHRVAEEFGVRISFDPKPIKGEWNGAGLHSNVSTVATRAEGGMKAIEAYMKKFEARHVEHIAVYGEGNEERLTGRHETGSIDKFSYGVADRGGSIRIPRQVAKDGKGYFEDRRPASNACPYQITGIIVETLSNK

SEQ ID NO: 2153 - DNA, 1807 bp, Cucumis melo
  CDS (171)..(1469)
  misc_feature (783)..(783): w is a or t
  misc_feature (814)..(814): r is g or a
acgcggggaggatctttgtttctcttccattttaacacaagccacaggagaatctctatctctatcctgcaaccttcatccccacattgttcttcctccattatcggaaaaacccagtacagggtttgctttccggccactatccggttgttcttttagaggcaaaaacaatggctcagattttagctccatccactcaatggcaactgagaactaaactgacttcaatgagttcaagccccattactcctaagatgtggagctccattcttctgaagcagaacaagaaaggagcagtaaaaagctcttcaaaatacagagtcttgtctgttaaatctgtaggtggcacaatcaatagaatggaagatctactaaatttggacgtcactccatataccgacaagattattgctgaatatatctggattggaggatctggcatcgatttgcgtagtaagtcgaggaccatatcaaagcctgtggaacatccatctgagctacccaagtggaactatgatggatctagtactgggcaagcacctggggaagacagtgaagtcattctctatcctcaagcaattttcaaggatcccttccgtggtggcaacaacattttggtgatttgtgatgcatacacaccagcaggcgtgcccatccctactaacaaacgacatagagctgctgagattttcagcaacaagaaagttgtggatgaaattccttggtatggcatagagcaagagtacaccttacttcagacaaatgtgaagtggcctttaggtwggccagttggagcttatccaggtcctcaggrcccttattactgtggtgttggagctgataagtcattcggtcgagacatatcagatgcccactacaaggcttgtttatatgccggaatcaacattagtggcaccaatggagaagttatgcctggccagtgggagtatcaagttggtcctagtgttgggatcgaagctggtgatcatatttggtgctctagatacattcttgagaggatcaccgagcaagctggagtagttctctcactggatccaaaaccaattgagggtgactggaatggagctggatgccacaccaattacagtacaaagagcatgagagaggaaggaggctttgaagtcatcaagaaggcaattctgaatctgtctcttcgccacaaagatcatatcagtgcttatggagaaggaaatgagagaaggttgacaggaaagcacgaaacagcaagtatcaacacgttttcctggggagtggctaaccgtggctgttcaatccgtgtgggacgtgacactgagaagcaaggcaaaggttatttggaagaccgacgtccggcttcaaacatggacccatatgtcgtgacctcactgctagcagaaacaacgatactgtgggagccaacacttgaagccgaagcactggctgctcagaaactgtcattgaaggtttgaagccaacgagtcatatttggtcttgagggcaaagttctaagtggattcgcacaatttaccaaaccccttgcgaagaatttccctcattctgttagataatgcagagaagaccttttgtaaataaaggtcttgaagtcttccagtcagcttttcagaacagtcatacatccaaaaaatattttgaagcaaaaaaaccttcatctgtgtactttgcagatggtgtttgccaattctgattgaaatttatgtgatgtcagatgttcactttatttgaatgtttattcaattggatttagacggttccccctcaaaaaaaaaaaaaaaaaaaaaaaaaaaaa

SEQ ID NO: 2154 - protein, 432 aa, Cucumis melo
  misc_feature (205)..(205): The Xaa at location 205 stands for Arg, or Trp.
  misc_feature (215)..(215): The Xaa at location 215 stands for Asp, or Gly.
MAQILAPSTQWQLRTKLTSMSSSPITPKMWSSILLKQNKKGAVKSSSKYRVLSVKSVGGTINRMEDLLNLDVTPYTDKIIAEYIWIGGSGIDLRSKSRTISKPVEHPSELPKWNYDGSSTGQAPGEDSEVILYPQAIFKDPFRGGNNILVICDAYTPAGVPIPTNKRHRAAEIFSNKKVVDEIPWYGIEQEYTLLQTNVKWPLGXPVGAYPGPQXPYYCGVGADKSFGRDISDAHYKACLYAGINISGTNGEVMPGQWEYQVGPSVGIEAGDHIWCSRYILERITEQAGVVLSLDPKPIEGDWNGAGCHTNYSTKSMREEGGFEVIKKAILNLSLRHKDHISAYGEGNERRLTGKHETASINTFSWGVANRGCSIRVGRDTEKQGKGYLEDRRPASNMDPYVVTSLLAETTILWEPTLEAEALAAQKLSLKV

SEQ ID NO: 2155 - DNA, 1354 bp, Brassica napus
  CDS (62)..(1132)
ttcgattttatctgtcatttgcttcaactgttactatcgaccaatctcggtgttcgtagccatgagtcttcttacagatctcgttaaccttaacctctcagagaccactgacaaaatcattgcggaatacatatgggttggaggttcaggaatggatatgagaagcaaagccaggactcttcctggaccagtgagtgacccttcggagctaccaaagtggaactatgatggctcaagcacaggccaagctcctggtgaagacagtgaagtcatcttataccctcaagccatcttcaaagatcctttccgtagaggcaataacattcttgtcatgtgcgatgcttacactccagcgggcgaaccaatcccaacaaacaaaagacacgctgcggctaaggtctttagccaccctgatgttgtagctgaagtgccatggtatggtattgagcaagagtatactttacttcagaaagatgtgaactggcctcttggttggcctattggcggcttccctggccctcagggaccatactattgtagtgttggagcagataaatcttttggtagagacatcgttgatgctcactacaaggcctgcttatacgctggcatcaatattagtggcatcaacggagaagtcatgcctggtcagtgggagttccaagttggtccagctgttggtatctcggccggtgatgaaatttgggtcgcacgtttcattttggagaggatcacagagattgctggtgtggtggtatcttttgacccaaaaccgattcccggtgactggaatggtgctggtgctcactgcaactatagtaccaagtcaatgagggaagatggtggttacgagattatcaagaaggcaattgataaactgggactgagacacaaggaacacattgctgcttatggtgaaggcaatgagcgtcgtctcacgggtcaccacgagactgctgacatcaacactttcctctggggtgttgcgaaccgtggagcatcaatccgtgtaggacgtgacacagagaaagaagggaaaggatactttgaggataggaggccagcttcgaacatggatccttacattgtgacttccatgattgcagagaccacaatcctctggaaaccttgatcagatcaaagaagcttgttgaagaatgttcactccgtttgggtttcttgcatggttcaacgtttgtgtgtttctctatcaagcattgtctcagagcaagtcaagagatttgctttgttcttatggcttttattgtttcacatccattgaaaacatctctttgtatcaatttatgaataaagtgtggtttggttaaaaaaaaaaaaaaaaaaaaaaaaaaaa

SEQ ID NO: 2156 - protein, 356 aa, Brassica napus
MSLLTDLVNLNLSETTDKIIAEYIWVGGSGMDMRSKARTLPGPVSDPSELPKWNYDGSSTGQAPGEDSEVILYPQAIFKDPFRRGNNILVMCDAYTPAGEPIPTNKRHAAAKVFSHPDVVAEVPWYGIEQEYTLLQKDVNWPLGWPIGGFPGPQGPYYCSVGADKSFGRDIVDAHYKACLYAGINISGINGEVMPGQWEFQVGPAVGISAGDEIWVARFILERITEIAGVVVSFDPKPIPGDWNGAGAHCNYSTKSMREDGGYEIIKKAIDKLGLRHKEHIAAYGEGNERRLTGHHETADINTFLWGVANRGASIRVGRDTEKEGKGYFEDRRPASNMDPYIVTSMIAETTILWKP

SEQ ID NO: 2157 - DNA, 1400 bp, Brassica napus
  CDS (68)..(1138)
caaaaaccacattatccgagatttgagtatatttcattgcaaccttcttgtcattttctctgtaaccatgagtcttctgaccgatctcgttaaccttgacctctcagacaacactgagaaaatcatcgctgaatacatatgggttggtggttcaggaatggatatgagaagcaaagccaggactctccctggacctgtgaccgatccatcaaagctcccaaaatggaattatgatggttcaagcactggccaagctcctggtgaagacagcgaagtgatcttataccctcaagcgattttcaaagatccgttccgtagaggcaacaacattcttgtcatgtgtgatacttacacccctgcgggtgaaccaatccctacgaacaagagacatgctgcagctcagatctttagcaaccctgatgttgttgctgaagtgccatggtatggaatcgaacaagaatacactctgttgcagaaagatgtgaattggcctgtcggatggcccattggtggattccccggccctcagggaccatactactgcagtgttggagctgacaaatcttttggaagagacattgttgatgctcactacaaggcttgtttgtatgctggaattaacatcagtggaatcaatggagaagtcatgcctggtcagtgggagttccaagtcggaccgtcggttggtatctcagctgctgatgaagtgtggattgctcgttttattttggagaggatcacagagattgctggtgtggttgtatcttttgacccaaaaccaattccgggtgactggaacggagctggtgctcacaccaattacagtactaaatcgatgagggaggaaggaggatacgagataatcaagaaggcaattgataagctcggactgagacacaaggagcacatttctgcttacggtgaaggcaacgagcgtcgtctcactggacaccatgaaactgctgatatcaacactttcaaatggggtgttgcaaaccgtggagcatcaatccgtgtaggacgtgacacggagaaggaagggaaaggatactttgaggataggaggccagcttccaacatggacccttacactgtaacttccatgattgcagagactacacttctttggaatccttgaagaaatatgacaataatataacttgaatctggtttcaagtttgtgtttctacagtttattaagcaattaccgggttgatactgccggagtttgtggtttgaggcctttcttttaatctctttgtgttttggggtttgtgattggagcaaaagccctgatttgctctgtttctttgaccttttatttgaaccctttgtatttgtattaataaggcgatctgaaaaggccttttcatgtttctatcaaaaaaaaaaaaaaaaaa

SEQ ID NO: 2158 - protein, 356 aa, Brassica napus
MSLLTDLVNLDLSDNTEKIIAEYIWVGGSGMDMRSKARTLPGPVTDPSKLPKWNYDGSSTGQAPGEDSEVILYPQAIFKDPFRRGNNILVMCDTYTPAGEPIPTNKRHAAAQIFSNPDVVAEVPWYGIEQEYTLLQKDVNWPVGWPIGGFPGPQGPYYCSVGADKSFGRDIVDAHYKACLYAGINISGINGEVMPGQWEFQVGPSVGISAADEVWIARFILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYTVTSMIAETTLLWNP

SEQ ID NO: 2159 - DNA, 1433 bp, Glycine max
  CDS (70)..(1137)
tcgatccgggaagagaaagaaatttgttctctctaaagagtctccgctgaactttttggtttcttgaagatgtcgttactctccgatcttatcaaccttaacctctccgacatcaccgataaagtgatcgcagagtacatatgggttggtggatctggcatggatatgaggagcaaagcaaggacactctcaggactggttaatgacccttcagcacttcccaagtggaactatgatggttccagcacaggtcaagctcctggagaagatagtgaagtgatctatatccacaagcaatttcgggatccattcagaaggggtaacaatatcctggttatgtgtgatgcttacactcctgctggggaacccattcccaccaacaagagaaataaagctgcaaagatattcatacatccggatgttgctgctgaagaaccctggtatggtcttgagcaggaatatacattattgcagaaagatgtccaatggcctcttggatggcctcttggtggtttcctgggcccccagggaccatactattgtggaactggtgctaacaaggcttttgggcgtgatattgttgactcacattacaaagcatgtatttatgcgggatttaacataagtggaatcaatggagaagtgatgccaggtcagtggggattccaagttggtccatcggttggcatctcagctgctgacgagttgtgggttgctcgttacattttggagaggatcaccgagattgctggactggtgctttcctttgaccctaagccaattcagggtgattggaatggtcctggtgctcacacaaattacagtaccaagttgatgagagacgatggtggctatgaaatcatcaaaaaagcaattgctaagttggaaaagaggcacaaagagcacattgctgcttacggagaaggcaatgaacgtcgtttgaccggacccgacgagacggctgacatgaacacctttttatggggagttgcaaaccgtggtgcttctgttagggtagggagacagactctaaaggcagggaagggatactttgaggagaggaggcctgcctctaacatggacccttatgtggtcacttccatgattgctgacacaactattctttggaaaccataagcaacgtcaaagaatcacatggtgccttccgcatagcattgttgtttagatggtcaatttgtttttctatgtttttgtgtgcattctagttgtgactacctcgcctgttgttaggatattgtttgttggtggtactcatgattaccaagcgaggaattgttgtttcattttcttaatgtacgttttaagtgttccaataatgtgtaatggccctcaagtattgttatttgctgcgaatttatattgtgaagcatctcatgatttctctttgagcaatcaagttcttattaactgta

SEQ ID NO: 2160 - protein, 355 aa, Glycine max
MSLLSDLINLNLSDITDKVIAEYIWVGGSGMDMRSKARTLSGLVNDPSALPKWNYDGSSTGQAPGEDSEVIYIHKQFRDPFRRGNNILVMCDAYTPAGEPIPTNKRNKAAKIFIHPDVAAEEPWYGLEQEYTLLQKDVQWPLGWPLGGFLGPQGPYYCGTGANKAFGRDIVDSHYKACIYAGFNISGINGEVMPGQWGFQVGPSVGISAADELWVARYILERITEIAGLVLSFDPKPIQGDWNGPGAHTNYSTKLMRDDGGYEIIKKAIAKLEKRHKEHIAAYGEGNERRLTGPDETADMNTFLWGVANRGASVRVGRQTLKAGKGYFEERRPASNMDPYVVTSMIADTTILWKP

SEQ ID NO: 2161 - DNA, 1071 bp, Nicotiana tabacum
  CDS (1)..(1071)
atgtctccgctttcagatcttatcagcctcaatctctctgattctacccagaaaatcatcgctgaatacatatggataggtggatcaggcatggacttaaggagcaaggccaggactctttctggtcctgttactgatccttcagaactacccaaatggaactatgatggatctagcacaggtcaagctcctggagaagatagtgaagtgatcttataccctcaagtatactttaaggatccattcagaagaggcaacaatatcttggtcatgtgtgatgcctatactcctgctggcgagcctatcccgacaaacaagaggcatgctgctgccaagatcttcagcaaccctgatgttgttgctgaggaaccctggtatggtattgagcaagaatacaccttgttgcaaagggatattaactggcctctagcgtggcctattggaggcttccctggacctcagggaccatactactgtggaaccggagctgataaggcctttggacgtgatattgtggactcccattacaaggcttgtctttatgctgggtttaacatcagtggtatcaacggagaagtgatgcccggacagtgggaattccaagtcggaccttctgttggcatctcagccggtgatgaagtgtgggtagctcgttacattcttgagaggattgcggagattgctggagtggttgtgtcatttgaccccaagcctattccgggcgattggaacggtgcaggtgctcacacaaactacagcaccaagtcgatgagggaagatggaggctatgaagtcattttgaaggctattgagaagcttggcctgaagcacaaagtgcacattgctgcatatggtgaaggcaatgagcgtcgtctcactggaaagcacgaaacagccaacatcagcaccttcaaatggggggttgcgaaccgcggtgcatctgtccgtgtaggaagggacacatataaggctgggaagggatattttgaggacagaaggacggcttcaaatatggatccatacgccgttactgccatgatcgcggacaccaaccatatctgcaaatcttga

SEQ ID NO: 2162 - protein, 356 aa, Nicotiana tabacum
MSPLSDLISLNLSDSTQKIIAEYIWIGGSGMDLRSKARTLSGPVTDPSELPKWNYDGSSTGQAPGEDSEVILYPQVYFKDPFRRGNNILVMCDAYTPAGEPIPTNKRHAAAKIFSNPDVVAEEPWYGIEQEYTLLQRDINWPLAWPIGGFPGPQGPYYCGTGADKAFGRDIVDSHYKACLYAGFNISGINGEVMPGQWEFQVGPSVGISAGDEVWVARYILERIAEIAGVVVSFDPKPIPGDWNGAGAHTNYSTKSMREDGGYEVILKAIEKLGLKHKVHIAAYGEGNERRLTGKHETANISTFKWGVANRGASVRVGRDTYKAGKGYFEDRRTASNMDPYAVTAMIADTNHICKS

SEQ ID NO: 2163 - DNA, 1381 bp, Nicotiana tabacum
  CDS (54)..(1124)
ttttattctctcatatacgaactcagccaatttcacaactcttattttccaatatggctcatctttcagatctcgttaatctcaatctctctgactccactcagaaaattattgctgaatacatatggattggtggatcaggaatggacgtcaggagcaaagccagaacactttctggacctgttgatgatccttcaaagcttcccaaatggaattatgatggttctagcacaggacaagctcctggagaagacagtgaagagatcctatatcctcaagcaattttcaaggatccattcagaaggggcaacaatatcttggtcatttgtgattgttacaccccagctggtgaacccattccaacaaacaaaaggcacagtgctgccaagattttcagccaccctgatgttgttgttgaggaaccctggtatggtcttgagcaagaatacaccttgttgcaaaaagatatcaattggcctcttggatggcctcttggtggttttcctggaccacagggaccatactattgcggaattggagctggaaaggtctttggacgcgatatcgttgactctcattataaggcatgtctctatgctgggattaacatcagtggtatcaatggagaagtgatgcccggacagtgggaatttcaagttggaccttcagttggcatttcagcagctgatgaattgtgggcagctcgttacattcttgagaggattactgagattgctggagttgtggtctcatttgaccccaaacctattccgggtgactggaatggtgctggagctcacacaaactacagcacaaagtctatgaggaatgaaggaggctatgaagtcattaagaaggcaattgagaaccttggactgaggcacaaggagcatattgcagcatatggtgaaggcaacgagcgtcgtctcactggaagacacgaaacagctgacatcaacacattcaaatggggagttgcgaaccgtggtgcatctattcgtgtgggaagagacacggagagagaagggaagggatacttcgaggataggaggcctgcttcgaatatggatccattcgtcgtgacttccatgattgctgagaccactatcctatccgagccttgagtgtgtagtcgtcttttgaggattcaatgagtattaattcttgggtgtaatatttggagaaagaattgaatttcggaacaaccctttcctcacaatgtccttatacagttagctatcttgttatattctgctgttttcctggtttgtatttgtattgtactcacgcaaagctcaggtcattgcctgtgatttggcaatggtgtaaaataacagtgttaatcttattgattaataacaatagggaagggtttaactgt

SEQ ID NO: 2164 - protein, 356 aa, Nicotiana tabacum
MAHLSDLVNLNLSDSTQKIIAEYIWIGGSGMDVRSKARTLSGPVDDPSKLPKWNYDGSSTGQAPGEDSEEILYPQAIFKDPFRRGNNILVICDCYTPAGEPIPTNKRHSAAKIFSHPDVVVEEPWYGLEQEYTLLQKDINWPLGWPLGGFPGPQGPYYCGIGAGKVFGRDIVDSHYKACLYAGINISGINGEVMPGQWEFQVGPSVGISAADELWAARYILERITEIAGVVVSFDPKPIPGDWNGAGAHTNYSTKSMRNEGGYEVIKKAIENLGLRHKEHIAAYGEGNERRLTGRHETADINTFKWGVANRGASIRVGRDTEREGKGYFEDRRPASNMDPFVVTSMIAETTILSEP

SEQ ID NO: 2165 - DNA, 1310 bp, Glycine max
  CDS (62)..(1129)
gaaaggaaaagagaaaaaatttctcagaagagtctccgctgaaagttttggtttcttgaagatgtcgttgctctccgatcttatcaaccttaacctctccgacatcaccgataaagtgatcgcagagtacatatgggtaggtggatctggcatggatatgaggagcaaagcaaggacactcccaggaccagttagagacccttcaggacttcccaagtggaactatgatggttccagcacaggtcaagctcctggtgaagatagtgaagtgatttatatccataagccatttcaggatccattcagaaggggtagcaatatcctggttatgtgtgatgcttacactcctgctggggaacccattcccacaaacaagagaaataatgctgcaaagatattcggccatcctgatgttgctgctgaagaaccctggtatggcattaagcaagaatacaccttgttgcaaaaagatgtccaatggcctctagggtggcctcttggtggtttcctgggccacaagggaccatattattgtggtactggtgctaacaaggctttcgggcgtgatattgttgactcacattacaaagcatgtatttatgcgggattcaacatcagtggaatgaatccagaagtgatgccaggtcagtgggaattccaagttggtccttcaattggcatctcagctgctgatgaattgtgggaagctcgttatattttggagaggatctccgagattgcaggagtggtgctttcctttgaccctaagccaattccgggtgattggaatggtgctggtgctcacacaaattacagtaccaagtccatgagagacgatggtggctatgaagtcatcaaagcagcaattgctaagttggaaaagagacacaaggagcacattgcagcttacggagaaggcaacgaacgtcgtttgactggacacgacgagacagctgacatgaactccttgttatggggtgttgcaaaccgtggtgcttctgttagagtagggagggacactgagaaagcagggaaggggtattttgaggataggaggcctgcctctaatatggacccttatgtggtcacttccatgattgctgacacaaccattctttggaaaccataagcagcctcaaaaataatcacacatgccttgttttttcatgttttgtgtgcactcttgttgtgactacctcgccttttcttaggcattgtttgttggtagtactgaagtgaagaattgtcgtgtcattccattaatgtacgtttttcaaaggaattgtttgtgtgcacccttgttgtgatta

SEQ ID NO: 2166 - protein, 355 aa, Glycine max
MSLLSDLINLNLSDITDKVIAEYIWVGGSGMDMRSKARTLPGPVRDPSGLPKWNYDGSSTGQAPGEDSEVIYIHKPFQDPFRRGSNILVMCDAYTPAGEPIPTNKRNNAAKIFGHPDVAAEEPWYGIKQEYTLLQKDVQWPLGWPLGGFLGHKGPYYCGTGANKAFGRDIVDSHYKACIYAGFNISGMNPEVMPGQWEFQVGPSIGISAADELWEARYILERISEIAGVVLSFDPKPIPGDWNGAGAHTNYSTKSMRDDGGYEVIKAAIAKLEKRHKEHIAAYGEGNERRLTGHDETADMNSLLWGVANRGASVRVGRDTEKAGKGYFEDRRPASNMDPYVVTSMIADTTILWKP

SEQ ID NO: 2167 - DNA, 1689 bp, Triticum aestivum
  CDS (140)..(1423)
ccacgcgtccgcgcgatctcgcaaggtcgttccgccccccttccctccctcctctcctccctcgtctcgtccccgtcgttgtctctctgctagcgctgaaggggaaggcggcggcggagtaagtaagtaagcagcggcgatggcgcaggcggtggtgccggcgatgcagtgccaggtgggcgtgcggggcaggtcggccgtcccggcgaggcagcccgcgggcagggtgtggggcgtcaggaggaccgcccgcgccacctccggcttcaaggtgctggccctcggcccggagaccaccggcgtcatccagaggatgcagcagctgctcgacatggacaccacgcccttcaccgacaagatcatcgccgagtacatctgggttggaggatctggaattgacctcagaagcaaatcaaggacgatttcgaagcctgtggaggacccgtcagagctaccaaaatggaactacgacggatcgagcaccgggcaggctccgggtgaagacagtgaagtcattctatacccacaggccatattcaaggacccattccgaggaggcaacaacatcctggttatctgtgacacctacacgccacaaggggaacccatccctactaacaagcgacacatggctgcacaaatcttcagtgaccccaaggtcactgcacaagtgccatggtttggaatcgaacaggagtacactctgatgcagagggatgtgaactggcctcttggctggcctgttggagggtaccctggcccccagggtccatactactgcgccgtaggatcagacaagtcatttggccgtgacatttcagatgctcactacaaggcatgcctttacgccggaattgaaatcagtggaacaaacggggaggtcatgcctggtcagtgggagtaccaggttggacccagcgttggtattgatgcaggagatcacatatgggcttcaagatacattctcgagagaatcacggagcaagctggtgtcgtgctcacccttgacccaaaaccaatccagggtgactggaatggagctggctgccacacaaattacagcacattgagcatgcgtgaggatggaggtttcgacgtgatcaagaaggcaatcctgaacctttcacttcgccatgacttgcacatagccgcatatggtgaaggaaacgaacggaggttgacagggctacatgagacagctagcatatcagacttctcatggggtgtcgcgaatcgtggctgctctattcgtgtggggcgagagaccgaggcaaagggcaaaggatacctggaggaccgtcgcccggcctcgaacatggacccatacaccgtgacggcgctgctggccgagaccacgatcctgtgggagccgaccctcgaggcggaggccctcgctgccaagaagctggcgctgaaggtatgaaggacctgaaaaggccgaattcttccggggaaaagaaaataaatcggcgggtccgtcgtccattcttgttgatcctgtggttccgtcggggcactgtctgtacaaaatcctcacagtttgtagaaccgctccgcatgttttttcgcttgaactgagtccatttgatctgttgggtctgtacaatccctgtacctgagtccattcggagaactacgttattataaggataatgaatcacacaaaggatttttctttgtgctgctttc

SEQ ID NO: 2168 - protein, 427 aa, Triticum aestivum
MAQAVVPAMQCQVGVRGRSAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTAQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 2169 - DNA, 1593 bp, Triticum aestivum
  CDS (114)..(1397)
cgatctcgcaggtcgccccggccccttccctccgtcccctcctccctcgtctcgtccgcgtccttgtcaggtttggaggcggcagagtacctgtaagtaagtaagtagcggcgatggcgcaggcggtggtgccggcgatgcagtgccaggtgggcgtgcggggcaggtctgccgtcccggcgaggcagcccgcgggcagggtgtggggcgtgaggaggaccgcccgcgccacctccgggttcaaggtgctggccctcggcccggagaccaccggcgtcatccagaggatgcagcagctgctcgacatggacaccacgcccttcaccgacaagatcatcgccgagtacatctgggttggaggatctggaattgacctcagaagcaaatcaaggacgatttcgaagccagtggaggacccgtcagagctaccgaaatggaactacgacggatcgagcacaggccaggctcctggagaagacagtgaagtcatcctatacccacaggccatattcaaggacccattccgaggaggcaacaacatactggttatctgtgtcacctacacaccacaaggggaacccatccctactaacaaacgacacatggctgcacaaatcttcagtgaccccaaggtcacttcacaagtgccatggtttggaatcgaacaggagtacactctgatgcagagggatgtgaactggcctcttggctggcctgttggagggtaccctggcccccagggtccatactactgcgccgtaggatcagacaagtcatttggccgtggcatatccgatgctcactacaaggcctgcctttacgcgggaattgaaatcagtggaacaaacggggaggtcatgcctggtcagtgggagtaccaggttgggcctagtgttggtattgatgcaggagaccacatatgggcttcaagatacattctcgagagaatcacggagcaagctggtgtggtgctcacccttgacccaaaaccaatccagggtgactggaatggagctggctgccacacaaattacagcacattgagcatgcgtgaagatggaggtttcgacgtgatcaagaaggcaatcctgaacctttcacttcgccatgacttgcacatagccgcatatggtgaaggaaacgagcggagactgacagggctacacgagacagctagcatatcagacttctcatggggtgtcgcgaaccgtggctgctctattcgtgtggggcgagaaaccgaggcaaagggcaaaggatatctggaggaccgtcgcccggcctcgaacatggacccatacaccgtgacagcgctgctggccgagaccacgatcctgtgggagccgacccttgaggcggaggccctcgccgccaagaagctggcgctgaaggtatgaaggacctcaaaacaacgaattcttccggcgaaaagaaaataaatcggcggcggcggaccgttggccgtccattcttgttgatcctgtggttccgtcggggcactgtctgtacaaaatccatcctcacagtttgtagaaccgctccgcatgtttgtttcgcttgaactgagtccatttgatctgttgggtctgtaca

SEQ ID NO: 2170 - protein, 427 aa, Triticum aestivum
MAQAVVPAMQCQVGVRGRSAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICVTYTPQGEPIPTNKRHMAAQIFSDPKVTSQVPWFGIEQEYTLMQRDVNWPLGWPVGGYPGPQGPYYCAVGSDKSFGRGISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 2171 - DNA, 1713 bp, Triticum aestivum
  CDS (185)..(1468)
tcccccgcaatctaaattacttataccaccggcctccgctcccataaatataaataatatttcgagcaaggtcgcctccccttccctccatcctctcctccctcgtctcgtccgcgtccttgtccgtctctctgctagcgctgaaggggaaggcggcggcggagtaagtaagtaagcagcggcgatggcgcaggcggtggtgccggcgatgcagtgccaggtgggcgtgcggggcaggtcggccgtcccggcgaggcagcccgcgggcagggtgtggggcgtcaggaggaccgcccgtgccacctccggcttcgaggtgctggccctcggcccggagaccaccggcgtcatccagaggatgcagcagctgctcgacatggacaccacgcccttcaccgacaagatcatcgccgagtacatctgggttggaggatctggaattgacctcagaagcaaatcaaggacgatttcgaagccagtggaggacccgtcggagctacccaaatggaattatgacggatcgagcaccgggcagcctcctggagaagacagtgaagtcattctatacccacaggccatattcaaggacccattccgaggaggcaacaacatcctggttatctgtgacacctacacgccacaaggggaacccgtccctactaacaagcgacacatggctgcacaaatcttcagtgaccccaaggtcactgcacaagtgccatggtttggaatcgaacaggagtacactctgatgcagagggatgtgaactggcctcttggctggcctgttggagggtaccctggcccccagggtccatactactgcgccgtaggatcagacaagtcatttggccgtgacatatccgatgctcactacaaggcctgcctttacgcgggaattgaaatcagtggaacaaacggggaggtcatgcctggtcagtgggagtaccaggttggacctagcgttggtattgatgcgggagaccacatatgggcttcaggatacattctcgagagaatcacggagcaagctggtgtggtgctcacccttgacccaaaaccaatccagggtgactggaatggagctggctgccacacaaattacagtacactgagcatgcgcgaagatggaggtttcgacgtgatcaagaaggcaatcctgaacctttcacttcgccatgacttgcacatagccgcatatggtgaagggaacgagcggaggttgacagggctacacgagacagctagcatttcagacttctcatggtgtgttgcgaaccgtggctgctctattcgtgtgggccgagagaccgaggcaaagggcaaaggatacctggaggaccgtcgcccgccgtcgaacatggacccgtacaccgtgacggcgctgctggccgagaccacgatcctgtgggagccgaccctcgaggcggaggccctcgctgccaagaagctggcgctgaaggtatgaaggacctgaaaaggccgaattcttctggggaaaagaaaataaatcggcggtggcgaggctgttcgtccgtcgtccattcttgttgatcctgtggttccgtcggggcactgtctgtacaaaatcttcacggtttgtagaaccgctccgcatgttttttcgcttgaactgagtccatttgatctgttgggtctgtacaatccctgtacctgagtccattcggagaactacgttattataagggataa

SEQ ID NO: 2172 - protein, 427 aa, Triticum aestivum
MAQAVVPAMQCQVGVRGRSAVPARQPAGRVWGVRRTARATSGFEVLALGPETTGVIQRMQQLLDMDTTPFTDKIIAEYIWVGGSGIDLRSKSRTISKPVEDPSELPKWNYDGSSTGQPPGEDSEVILYPQAIFKDPFRGGNNILVICDTYTPQGEPVPTNKRHMAAQIFSDPKVTAQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASGYILERITEQAGVVLTLDPKPIQGDWNGAGCHTNYSTLSMREDGGFDVIKKAILNLSLRHDLHIAAYGEGNERRLTGLHETASISDFSWCVANRGCSIRVGRETEAKGKGYLEDRRPPSNMDPYTVTALLAETTILWEPTLEAEALAAKKLALKV

SEQ ID NO: 2173 - DNA, 1071 bp, Triticum aestivum
  CDS (1)..(1071)
atggcgctcctcaccgatctcctcaacctcgacctcaccgactccacggagaagatcatcgccgagtacatatggatcggcggatctggcatggatctcaggagcaaagccaggaccctccccggcccggtcaccgaccccagcaagctgcccaagtggaactacgacggctccagcaccggccaggcccccggcgaggacagcgaggtcatcctgtacccacaggccatcttcaaggacccgttcaggaagggcaacaacatccttgtcatgtgcgattgctacaccccagctggagtgccaatccccaccaacaagagatacaacgctgtcaagatctttagcaaccctgatgttgccaaggaggagccatggtacggtatcgagcaggagtacaccctcctacagaaggacatcaactggcctctcggctggcctgttggtggattccctggtcctcagggtccttactactgtagtattggtgctgacaagtcgtttgggcgtgacatagttgactcccactacaaggcctgcctctttgccggcgtcaacatcagtggcatcaacggcgaggtcatgcccggacagtgggagttccaagttggcccgactgttggcatttctgctggtgaccaagtgtgggttgctcgctaccttcttgagaggatcaccgagatcgccggagttgtcgtcacatttgaccccaagcccatcccaggcgactggaacggtgctggtgctcacacaaactacagtaccgagtcgatgaggaaggacggcgggttcaaggtcatcgtggacgctgtcgagaagctcaagctgaagcacaaggagcacatcgccgcctacggcgagggcaacgagcgccgtctcaccggcaagcacgaaaccgccgacatcaacaccttcagctggggtgtcgcgaaccgtggcgcgtcggtgcgcgtgggacgggagacggagcagaacggcaagggctacttcgaggaccgccggccggcgtccaacatggacccctacgtggtcacctccatgatcgccgagaccaccatcctgtggaagccctga

SEQ ID NO: 2174 - protein, 356 aa, Triticum aestivum
MALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAVKIFSNPDVAKEEPWYGIEQEYTLLQKDINWPLGWPVGGFPGPQGPYYCSIGADKSFGRDIVDSHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 2175 - DNA, 1071 bp, Triticum aestivum
  CDS (1)..(1071)
atggcgctcctcaccgatctcctcaacctcgacctcaccgactccacggagaagatcatcgccgagtacatatggatcggcggatctggcatggatctcaggagcaaggccaggaccctccccggcccggtcaccgatcccagcaagctgcccaagtggaactacgacggctccagcaccggccaggcccccggcgaggacagcgaggtcatcctgtacccacaggccatcttcaaggacccgttcaggaagggcaacaacatccttgtcatgtgcgattgctacaccccagctggagtgccaatccccactaacaagagatacaacgctgctaagatctttagcaaccctgatgttgccaaggaggagccatggtacggtattgagcaggagtacaccctcctacagaaggacatcaactggcctctcggctggcctgttggtggcttccctggtcctcagggtccttactactgtagtatcggtgctgacaagtcgttcgggcgtgacatagttgactcccactacaaggcctgcctctttgccggcgtcaacatcagtggcatcaacggcgaggtcatgcccggacagtgggagttccaagttggcccgactgttggcatttctgctggtgaccaagtgtgggttgctcgctaccttcttgagaggatcaccgagatcgccggagttgtcgtcacatttgaccccaagcccatcccaggcgactggaacggtgctggtgctcacacaaactacagtaccgagtcgatgaggaaggacggcgggttcaaggtcatcgtggacgccgtcgagaagctcaagctgaagcacaaggagcacatcgccgcctacggcgagggcaacgagcgccgtctgaccggcaagcacgagaccgccgacatcaacaccttcagctggggtgtcgcgaaccgtggcgcgtcggtgcgcgtgggccgggagacggagcagaacggcaagggctacttcgaggaccgccggccggcgtccaacatggacccctacgtggtcacctcgatgatcgccgagaccaccatcctgtggaagccctga

SEQ ID NO: 2176 - protein, 356 aa, Triticum aestivum
MALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDSHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 2177 - DNA, 1292 bp, Triticum aestivum
  CDS (64)..(1134)
ccacccgccttccttcctgccttcctgcccccagtcagccggagccggattgctcctcccgccatggcgctcctcaccgatctcctcaacctcgacctcaccgactccacggagaagatcatcgccgagtacatatggatcggcggatctggcatggatctcaggagcaaggccaggaccctccccggcccggtcacggatcccagcaagctgcccaagtggaactacgacggctccagcaccggccaggcccccggcgaggacagcgaggtcatcctgtacccacaggccatcttcaaggacccgttcaggaagggcaacaacatccttgtcatgtgcgattgctacaccccagctggagtgccaatccccaccaacaagagatacaacgctgccaagatctttagcaaccctgatgttgccaaggaggagccatggtatggtattgagcaggagtacaccctcctacagaaggacatcaactggcctctcggctggcctgttggtggattccctggtcctcagggtccttactactgtagtattggtgctgacaagtcgtttgggcgtgacatagttgacgctcactacaaggcctgcctctttgccggtgtcaacatcagtggcatcaatggcgaggtcatgcccggacagtgggagttccaagtcggcccgactgttggcatttctgctggcgaccaagtgtgggtcgctcgctaccttcttgagaggatcactgagatcgccggagttgtcgtcacatttgaccccaagcccatcccaggcgactggaacggtgctggtgctcacacaaactacagtaccgagtcgatgaggaaggacggcgggttcaaggtcatcgtggatgccgtggagaagctcaagctcaagcacaaggagcacatcgccgcctacggcgagggcaacgagcgccgcctcaccggcaagcacgagaccgccgacatcaacaccttcagctggggcgtcgcaaaccgtggcgcgtcggtgcgcgtgggccgggagacggagcagaacggcaagggctacttcgaggaccgccggccggcgtccaacatggacccatacgtggtcacctcgatgatcgccgagaccaccatcctgtggaagccctgaagccgatcggcgccgatcgccgtgcgatgatcagtgatgggttgggttggatttggtgggtggccactggaggatttggacgaaattcttccaacatatttgcttttccgtttggttgcatactacgcgtagtccgcttaggtaggtcgcatcatcgt

SEQ ID NO: 2178 - protein, 356 aa, Triticum aestivum
MALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDAHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 2179 - DNA, 1241 bp, Paxillus involutus
  CDS (55)..(1122)
tcctcttctttctataccgcatcgttgtcgcactagacttcttacatcgacatcatggccgcatctacttaccacaacgacctccttgctcccttcctcgcccttccccagggtgacaaggttcaagccgagtacgtttggatcgacggtgatagtggtcttcgttcgaagacgacgaccgtgtccaagaaggtcaccgacattggccagctccgtatctgggactttgacggttcttcaaccaaccaagccccaggacacgactcggatgtctacctccgtcctgccgctatcttcaaggatccattccgtggtggtgacaacatcctcgttcttgccgagacttacaacagtgatggcacccccaaccgaacaaactaccgccaccatgcctccaaggtcatggaccttgccaaagacagcgtaccttggttcggtctcgagcaggaatacactctcttcgacgccgatggctccccattcggttggccgaagggtggtttccctggtcctcagggtccttactactgtggtgcaggcactggaaaggtcgtcgcacgtgatctcattgaggctcactaccgtgcttgcctgtactctggtatcaacatcagcggtatcaacgctgaggtcatgccttctcagtgggagttccaggtcggtccttacgagggtatttccatgggtgaccacctctggatggctcgttaccttttggtccgcattgccgagcaatggggaatcaaggtctccttccaccctaaacctctccagggtgactggaacggcgctggttgccacaccaactacagcaccttgcccatgcgtgagcccggaggaatgaagcacatcgatgcggccatcgaaaagcttgcaaagaggcacaacgagcacattgcagtctacggagaggacaacgagttgaggctcactggtcgtcacgagaccggtcacatcggtgatttcagttctggtgtagccaaccgtggtgcttccatccgtgttcctaggcacgtcgctgctcagggctatggttacttggaggaccgtcgcccggcttccaacatcgatccttaccgtgtcaccggcatcatcgttgagaccacgctcttggacaagtgaggaatctctttggttatatacactttgtaggcatggaagtaaaaagcagcgcatcattataccagggtaacgacgcccttggtctctaataaactatttgtgtggatacaaaaaaaaaa

SEQ ID NO: 2180 - protein, 355 aa, Paxillus involutus
MAASTYHNDLLAPFLALPQGDKVQAEYVWIDGDSGLRSKTTTVSKKVTDIGQLRIWDFDGSSTNQAPGHDSDVYLRPAAIFKDPFRGGDNILVLAETYNSDGTPNRTNYRHHASKVMDLAKDSVPWFGLEQEYTLFDADGSPFGWPKGGFPGPQGPYYCGAGTGKVVARDLIEAHYRACLYSGINISGINAEVMPSQWEFQVGPYEGISMGDHLWMARYLLVRIAEQWGIKVSFHPKPLQGDWNGAGCHTNYSTLPMREPGGMKHIDAAIEKLAKRHNEHIAVYGEDNELRLTGRHETGHIGDFSSGVANRGASIRVPRHVAAQGYGYLEDRRPASNIDPYRVTGIIVETTLLDK

SEQ ID NO: 2181 - DNA, 1508 bp, Camellia sinensis
  CDS (146)..(1216)
ataaagtgcaaccgtcccctctgcttacgctctgtaatactaatcaacaatcacaaacacacagataatataaacgcagaagagataagagagagggagagagagagggagagagaaccagagcaatttgtgatagtgtgaaaacatggctcagctttcagatctcatcaacatgaacctctccgactctacggagaagatcattgccgagtacatatggattggtggtactggcttggacctcagaagcaaagcaaggactctttctggacccgttaatgatcccaaaaagcttcccaagtggaattatgatggatctagcacaggtcaagctcctggagaagacagtgaagtgatcatataccctcaagcaatttttaaagatccattcaggaagggaaacaatatattggtcatgtgtgatgcttacactcctgctggtgaaccaattccaaccaacaagaggtacaatgctgagaagattttcagccacactgatgttgttgctgaagaaccttggtatggtattgagcaagagtacaccttgttgcaaaaagatgttaagtggcctatcgggtggccaaagggaggttatcctggacctcagggaccatactactgtggcgctggtgccgacaaagcttttggacgtgatattgttgattcacactacaaggcttgcctttatgccgggattaacataagtggaatcaatggtgaggtgatgccgggccagtgggagtttcaagttggacctgctgttggcatctcagccggggatgaattgtgggtggctcgttacattctagagaggatcactgagatcgctggggttgtggtatcttttgaccccaaacctatcgagggtgattggaatggagccggtgctcatacaaattacagcaccaagtctatgaggaaagatggaggttatcaggtcatcaaaaaggctattgagaagcttggactgaagcacaaagaacatattgctgcatatggtgaaggcaacgagcgtcgtctcactggacgacacgagacagctgacatcaacaccttcttatggggggttgcaaaccgtggtgcatctgttcgtgttggccgagacactgaaaaggcagggaaagggtattttgaggacaggaggcctgcttcgaacatggatccatacgtggttacctccatgattgcagctaccaccatcctgtggaaaccatgaacgttcacttagttacactctttgagattgtgccctgctctttcatagtaggccgattcagagatatgaaaaagagctgtatttcggagccactttgagtagttgtcgtcttcttattttttcatgtaccaggtggttattatttcaagtagtaaggtgacctcctcccatgcctatgcctttgcctttgtcttgtcatgaataacagtaacattttacattaaaaacaatatggtggggttaattttattatcatctttcttttaaaaaaaaaaaaaaaaaaaaaaaaaaa

SEQ ID NO: 2182 - protein, 356 aa, Camellia sinensis
MAQLSDLINMNLSDSTEKIIAEYIWIGGTGLDLRSKARTLSGPVNDPKKLPKWNYDGSSTGQAPGEDSEVIIYPQAIFKDPFRKGNNILVMCDAYTPAGEPIPTNKRYNAEKIFSHTDVVAEEPWYGIEQEYTLLQKDVKWPIGWPKGGYPGPQGPYYCGAGADKAFGRDIVDSHYKACLYAGINISGINGEVMPGQWEFQVGPAVGISAGDELWVARYILERITEIAGVVVSFDPKPIEGDWNGAGAHTNYSTKSMRKDGGYQVIKKAIEKLGLKHKEHIAAYGEGNERRLTGRHETADINTFLWGVANRGASVRVGRDTEKAGKGYFEDRRPASNMDPYVVTSMIAATTILWKP

SEQ ID NO: 2183 - DNA, 1595 bp, Camellia sinensis
  CDS (82)..(1152)
ctcatgtcctctgttcacggctctgcattaaaagcacagacagagagagagagaagcagagcgagagagacagagagagccatgtctttgctatcagatctcatcaacctcaacctttcggacactacggagaaggtgattgctgagtacatatggattggtggttctggcatggacctcagaagcaaagcaaggactctttctggacctgtgagtgaccccaaaaagcttccaaagtggaattatgacggatctagcacaggacaagctcctggtgaagatagtgaagtcattatctaccctcaagcaatttttaaggacccattcaggaggggaaacaatatattggtcatgtgtgatacttacacacctggtggtgagccaattccaacaaacaagaggttcaacgctgcaaagattttcagccaccctgatgttgtagctgaagaaccttggtatggtattgagcaagagtacaccttgctccaaaaacaagttaagtggccgcttggctggccgcttggaggttttccaggacctcagggaccatactattgtggtattggtgttgacaaagcttatggacgcgatattgtggattcgcattacaaggcttgcctctatgctggtgtaaacataagtggaataaatggtgaagtgatgcctggccagtgggagtttcaagttggaccttctgttggtatctcagccggggatgaattgtgggtggctcgttacatccttgagaggatcacggagattgctggggtcgtggtttcctttgatcccaaacctatcgagggtgattggaatggtgctggagctcataccaattacagcaccaagtctacgaggagtgatgggggttttgaggtcatcaaaaaggccattgagaagcttggcctaaggcacaaagaacatattgctgcttatggtgaaggcaacgagcgtcgtctcactggacgacatgagaccgccgacatcaacaccttcttatggggagttgcaaaccgtggtgcatcgatcagggtcgggagggacacagagaaagccggaaaagggtattttgaggacaggaggcctgcttcgaatatggatccatatgtggttacttccatgattgcagagaccactctgctgtggaagccatgagtacgagcgttgttcacttatgctatgtttggttggggatttgaggatggatttggaaaagaaaatgaaaaaggtatgtgaaatgtgaaaaaaatatacttatatttcacatagtttcacacattttttttctttccttttccaaatctgtctcaaaatctcccaatcaaacacagcgttagcgacgcctacatttgaatttaatattgtgctctgctctgtctgtttcattgtttagtgatttcaaagaggaaaagaaattgtatttcataatcccaacccaacctttgtgtctatttttccaaattgaagtaagtggagagtatgtcttgttattttcttggcactgggctctgtttgtgtctcgagtagcaaacatgatttccagtctctgtctttgaataaaaacagtaacattttacattaaaaaaaaaaaaaaaaaa

SEQ ID NO: 2184 - protein, 356 aa, Camellia sinensis
MSLLSDLINLNLSDTTEKVIAEYIWIGGSGMDLRSKARTLSGPVSDPKKLPKWNYDGSSTGQAPGEDSEVIIYPQAIFKDPFRRGNNILVMCDTYTPGGEPIPTNKRFNAAKIFSHPDVVAEEPWYGIEQEYTLLQKQVKWPLGWPLGGFPGPQGPYYCGIGVDKAYGRDIVDSHYKACLYAGVNISGINGEVMPGQWEFQVGPSVGISAGDELWVARYILERITEIAGVVVSFDPKPIEGDWNGAGAHTNYSTKSTRSDGGFEVIKKAIEKLGLRHKEHIAAYGEGNERRLTGRHETADINTFLWGVANRGASIRVGRDTEKAGKGYFEDRRPASNMDPYVVTSMIAETTLLWKP

SEQ ID NO: 2185 - DNA, 1477 bp, Saccharum officinarum
  CDS (86)..(1189)
  misc_feature (1458)..(1458): n is a, g, c or t
gccggctctacccacgcgtccgcacagagatcaatcacgcttgcaaccatcctcttctcgcgcgtgctctgccttcgtcgtcgccatggctctgctctccgatctcatcaacctcgacctctcggactgcaccgagaagatcatcgccgagtacatctgggttggcggttctgggatggatgtgaggagcaaagccaggacgctgtccggacctgttgatgaccctagcaagcttccaaaatggaatttcgacggctccagcaccggccaagctccgggtgacgacagtgaagtcatcctttgccctcgggccatcttcagagacccgttcaggaagggggagaacatactggtcatgtgtgactgctatgagccaaatggaaaaccgattccaagcaacaagaggcacggggctgcgacgatctttagccaccctgatgtcatggctgaggaaccatggtttgggattgagcaagagtacacccttcttcagaaggacaccaactggcctcttggttggccgctgggcggctaccctggccctcagggaccatactactgtgccgccggagcggacaaatcctacgggcgggacatcgtggacgcgcactacaaggcctgcctctacgccggcatcgacatcagcggcatcaacggggaggtcatgccagggcagtgggagttccaggttggccctgccgtcggcgtctcggccggcgaccagctctgggtggctcgctacattcttgagaggatcaccgagatcgccggtgtggtcgtctccttcgaccccaagccaattccgggggactggaacggcgctggtgctcacaccaactacagcaccaagtcgatgaggagcgacggcgggtacgaggtgatcaagaaggcgatcagcaagctgggcctccggcaccgggagcacatcgctgcctacggggacggcaacgagcgccgcctcaccggccgccacgagaccgccgacatcaacaccttcatctggggcgtcgcgaaccgcggggcgtcggtgcgggtgggccgcgacaccgagaaggaaggcaaaggatacttcgaggacaggaggccggcgtccaacatggacccctacgtggtgacctcgctcatcgcggagacaaccatcctgtgggagcccagccactccaacggcaaggacgccgtggctccttgattctccggcggcgactgacctctgtgtcagagccgggctgcgtagatggcaaatgagactgacgctgtcagaaacttgagatgaccataataatacctgcagtgtgctggttgttggataacaagccaagaacacttttttcaagctttcttcgaaattagcataatttttatttatatagtctcctgaattatcaacttcaaaccagtttaatgagccgagacgaagtcaaagtcattcaaaatctttttttttcattttaaaagaanaacgagttcgtccggccca

SEQ ID NO: 2186 - protein, 367 aa, Saccharum officinarum
MALLSDLINLDLSDCTEKIIAEYIWVGGSGMDVRSKARTLSGPVDDPSKLPKWNFDGSSTGQAPGDDSEVILCPRAIFRDPFRKGENILVMCDCYEPNGKPIPSNKRHGAATIFSHPDVMAEEPWFGIEQEYTLLQKDTNWPLGWPLGGYPGPQGPYYCAAGADKSYGRDIVDAHYKACLYAGIDISGINGEVMPGQWEFQVGPAVGVSAGDQLWVARYILERITEIAGVVVSFDPKPIPGDWNGAGAHTNYSTKSMRSDGGYEVIKKAISKLGLRHREHIAAYGDGNERRLTGRHETADINTFIWGVANRGASVRVGRDTEKEGKGYFEDRRPASNMDPYVVTSLIAETTILWEPSHSNGKDAVAP

SEQ ID NO: 2187 - DNA, 1422 bp, Saccharum officinarum
  CDS (67)..(1140)
cttcagacagttcttcttgcctactaagctctcttgtgttcttgtcttctgcctgtgctgtgagtgatggccagcctcaccgatctcgttaacctcgacctgagtgactgcaccgacaagatcatcgccgagtacatctggattggaggatccggcatagacctcaggagcaaagcaaggacggtgaaaggccccatcaccgatccgagccagcttccaaaatggaactacgacggctccagcactgggcaggctcccggagaggacagcgaagtcatcctctaccctcaagccattttcaaggacccgttcaggaagggcgacaacatccttgtgatgtgtgactgctacacgccacaaggcgagccaatccctactaacaagaggtacaatgctgccaaggttttcagccaccccgacgttgcagctgaggtgccatggtacggtattgagcaggagtacactctccttcagaaggatgtgagctggccccttggctggcctgttggtggataccctggtccccagggaccatactactgcgctgccggtgccgataaggcatttgggcgcgacgtggtcgacgcccactacaaagcctgcctctacgctggcatcaacatcagcggcatcaacggcgaagtcatgcctggccagtgggagttccaagtggggccgtccgttgggatctctgccggtgacgagatttgggttgcccgctacattctcgagaggatcactgagattgccggaattgttctctccctcgacccaaagccgatccagggtgactggaacggtgccggtgctcacaccaactacagcaccaagtcgatgagggagcccgggggctacgaggtgatcaagaaggcgatcgagaagctggggaagaggcacaaggagcacatcgccgcgtacggcgagggcaacgagcgccgcctcacgggccgacacgagaccgccgacatcaacaccttcaaatggggcgtggcgaaccgcggcgcgtccatccgcgtcggccgcgacaccgagcgggagggcaagggatacttggaggaccgcaggccggcattcaacatggacccctacgtcgtcaccggcatgatcgccgagaccaccatcctgtggaagggaaactgatcacgcatgcattcgagccacgcgatccacggttcttcttcttctgcacaacgctacgcctgcacgcatccgccctgatgtcatgtcagtttgattttgcgatttcggttcccgtcatggggtgtcctaaaattttttacttcggtctccggtgtactgctcggaaagtctgaataacggctgcaatggattttgctctcgtcataggggtacctttagctattcttcccgtttattggatcatgtataatgtaataatactacgtgatttatatgaagaaa

SEQ ID NO: 2188 - protein, 357 aa, Saccharum officinarum
MASLTDLVNLDLSDCTDKIIAEYIWIGGSGIDLRSKARTVKGPITDPSQLPKWNYDGSSTGQAPGEDSEVILYPQAIFKDPFRKGDNILVMCDCYTPQGEPIPTNKRYNAAKVFSHPDVAAEVPWYGIEQEYTLLQKDVSWPLGWPVGGYPGPQGPYYCAAGADKAFGRDVVDAHYKACLYAGINISGINGEVMPGQWEFQVGPSVGISAGDEIWVARYILERITEIAGIVLSLDPKPIQGDWNGAGAHTNYSTKSMREPGGYEVIKKAIEKLGKRHKEHIAAYGEGNERRLTGRHETADINTFKWGVANRGASIRVGRDTEREGKGYLEDRRPAFNMDPYVVTGMIAETTILWKGN

SEQ ID NO: 2189 - DNA, 1596 bp, Saccharum officinarum
  CDS (83)..(1153)
caccacctcctctccctcatcttcctccttgggtccttccaaacccgtgtgcctgcctgtcgcaccgcagccgccgccggccatggcctccctcaccgacctcgtcaacctcagcctctcggacaccaccgagaagatcatcgcggagtacatatggatcggtggatctggcatggatctcaggagcaaagccaggaccctctctggcccggtgaccgatcccagcaagctgcccaagtggaactacgacggctccagcaccggccaggcccccggcgaggacagtgaggtcatcctgtacccgcaggctatcttcaaggacccattcaggaggggcaacaacatccttgtcatgtgcgattgctacaccccagctggcgagcccattcccaccaacaagaggcacaacgctgccaagatcttcagcaaccctgaggtcgctgctgaggagccctggtatggtattgagcaggagtacaccctccttcagaaggacaccaactggccccttgggtggcctattggtggcttccctggccctcagggtccttactactgtggaatcggtgcggacaagtcattcgggcgtgacattgttgatgcccactacaaggcttgcctgtatgcaggcatcaacatcagtggcatcaacggagaggtcatgccagggcagtgggagttccaagttggaccttctgtcggcatttcttcgggcgatcaggtttgggttgctcgctacattcttgagaggatcaccgagatcgccggtgtggtgttgacattcgacccgaagcccatcccgggtgactggaatggcgccggcgcccacaccaactacagcaccaagtccatgaggaacgagggcgggtacgaggtgatcaaggccgccatcgagaagctgaagctgcggcacaaggagcacatcgcggcctacggcgagggcaacgagcgccgcctcaccggcaggcacgagaccgccgacatcaacaccttcagctggggagtggccaaccgtggcgcgtcggtgcgcgtgggccgggagacagagcagaacggcaagggctacttcgaggaccgccggccggcgtccaacatggacccctacgtggtgacctccatgatcgccgacaccaccatcctctggaagccctgaggcgtccaagcttttcctccatccagctcgccgtgtcgtgtcggtttgttccgcggcagtggccattgcattgcagggtccgtccggtccgtccagcgattgcgcaaaaattgttccttccgttccgtttgcttatacaactctattactagtactgcattttagctagatctgggtcaggtcgtggtgtgccaaaacagaacacaaaaaacattgttgctttgacgcttcccacttccattccatgccgtccgtccgcttgggtggtctcctcctgtcttctttttcttcttcttacttcctgtgtaatcctccaataatggccgtaccacacttgtggtacctatcagtacctctctatgcattgtataagtgatcgctttcctacgccctccaatatttgtggctttcctgctgctgatgcgataagggagggaatcgtt

SEQ ID NO: 2190 - protein, 356 aa, Saccharum officinarum
MASLTDLVNLSLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRHNAAKIFSNPEVAAEEPWYGIEQEYTLLQKDTNWPLGWPIGGFPGPQGPYYCGIGADKSFGRDIVDAHYKACLYAGINISGINGEVMPGQWEFQVGPSVGISSGDQVWVARYILERITEIAGVVLTFDPKPIPGDWNGAGAHTNYSTKSMRNEGGYEVIKAAIEKLKLRHKEHIAAYGEGNERRLTGRHETADINTFSWGVANRGASVRVGRETEQNGKGYFEDRRPASNMDPYVVTSMIADTTILWKP

SEQ ID NO: 2191 - DNA, 1418 bp, Nicotiana attenuata
  CDS (43)..(1113)
catatacaaactcagccaatttcacaactcttattttcaattatggctcatctttcagatctcgttaatctcaatctctctgattccactcagaaaattattgctgaatatatatggattggtggatcaggaatggacgtcaggagcaaagccagaactatttctggaccagttgatgatccttcaaagcttcccaaatggaattatgatggttctagcacaggacaagctcctggagaagacagtgaagtgatcctatatcctcaagcaattttcaaggatccattcagaaggggcaacaatatcttggtcatttgtgattgttacaccccagctggtgaacccattccaacaaacaaaaggcacaatgctgccaagattttcagccaccctgatgttgttgttgaggaaccctggtatggtcttgagcaagaatacaccttgctgcaaaaagatatcaactggcctcttggatggcctcttggtggttttcctggaccacagggaccatactattgtggaattggagctggaaaggcttttggacgcgatatcgttgactctcattacaaggcatgtctctatgctgggattaacatcagtggtatcaatggagaagtgatgcccggacagtgggaatttcaagttggaccttcagttggcatttcagcagctgatgaattgtgggcagctcgttacattcttgagaggattactgagattgctggagttgtggtgtcatttgaccccaaacctattccgggtgattggaatggtgcgggtgctcatacaaactacagtaccaagtctatgaggaatgaaggaggctatgaagttattaagaaggcaattgataagcttggactgaggcacaaggagcatattgcagcatatggtgaaggcaacgagcgtcgtctcactggaagacacgaaacagctgacattaacacattcaaatggggagttgcaaaccgtggtgcatctattcgtgtgggaagagacacggagaaggaaggaaagggatacttcgaggataggaggcctgcttcgaacatggatccatacgtcgtgacttccatgattgctgagaccacaatcctgttcaagccctgagtgtgtagtcgtcttttaaggattcgatgagtattaattctcgggtgaaaaatttggagaaagaactgaatttcggaacaaccctttcctcccagtgtcattagggtatagttagatatctagttatgttctgctgtttcctggtttccatttgtattatactcggcaaagctgagttcattgcctgtgatttggcaatggtgtaaaataacagtgttgatcttattattaataacaatatgaaagggtttaacttaaaaaaaaaaaaaaaaaaaaaaaaaaaaaaaaaaaaaaaaaaaaaaaaa

SEQ ID NO: 2192 - protein, 356 aa, Nicotiana attenuata
MAHLSDLVNLNLSDSTQKIIAEYIWIGGSGMDVRSKARTISGPVDDPSKLPKWNYDGSSTGQAPGEDSEVILYPQAIFKDPFRRGNNILVICDCYTPAGEPIPTNKRHNAAKIFSHPDVVVEEPWYGLEQEYTLLQKDINWPLGWPLGGFPGPQGPYYCGIGAGKAFGRDIVDSHYKACLYAGINISGINGEVMPGQWEFQVGPSVGISAADELWAARYILERITEIAGVVVSFDPKPIPGDWNGAGAHTNYSTKSMRNEGGYEVIKKAIDKLGLRHKEHIAAYGEGNERRLTGRHETADINTFKWGVANRGASIRVGRDTEKEGKGYFEDRRPASNMDPYVVTSMIAETTILFKP

SEQ ID NO: 2193 - DNA, 1293 bp, Lotus japonicus
  CDS (1)..(1293)
atggcacagattttggcaccctcgacgcaatggcagacgagaatcaccaaaacctctcccaatgcaagtcccattacatcaaacatgtggagttctttattgtggaaacaaaacaagaaagttgcacgtgcttctaagtttagagtactggcaatcaagtctgatggtagcaccatcaacaggctagagggtctgcttaatttggatgtcactccatacactgataagttcattgctgagtacatctggattggggggactggtgtcgatgttcgcagtaaatcaagaactatatcgaagcctgtttcacatccctctgagctccctaaatggaactatgatggatctagcactgggcaggcaccgggcgatgatagtgaagtaattctatatcctcaagcaattttcagagatcctttccgtggtggtaacaatattttggttatttgcgatgcttacacaccacaaggtgagcctatccctacaaacaagcggcacagagctgctgaaatcttcagtaacccaaaggttcaagctgaaattccatggtatggaatagaacaagagtacaccctacttcaaacggatgtgaagtggcctttgggatggcctgttggcggctatcctggtcctcagggtccctattactgtgctgccggggctgataagtcattcggacgtgatatatctgatgctcattacaaggcttgcttgtatgctggaatcaacatcagtggcaccaatggggaggttatgcctgggcagtgggagtatcaagttggtcctagtgtaggtattgaagctggtgatcatatctgggcttcaaggtaccaccttgagagaatcactgaacaagctggtgttgtcctcactcttgatccaaaaccaattgagggtgactggaacggtgccggagcccacaccaattacagcacaaagagcatgagggaagagggaggctttgaggtaatcaagaaggcaattttgaatctatcccttcgccaccaggaccatattcgtgcttatggagaaggaaatgagagacgattgacgggaaagcatgaaacagccgacattaacacattttcttggggagtggctaaccggggttgctcaatccgtgtgggaagagacacagagaaggaaggaaaaggttacttggaagacaggcgccctgcttcaaacatggatccatatgttgtgacagcattgctggcagagactaccttgttgtgggaaccaactctagaggctgaagctcttgcagctcagaagatacaattgaaggtctaa

SEQ ID NO: 2194 - protein, 430 aa, Lotus japonicus
MAQILAPSTQWQTRITKTSPNASPITSNMWSSLLWKQNKKVARASKFRVLAIKSDGSTINRLEGLLNLDVTPYTDKFIAEYIWIGGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYHLERITEQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 2195 - DNA, 1293 bp, Lotus japonicus
  CDS (1)..(1293)
atggcacagattttggcaccctcgacgcaatggcagacgagaatcaccaaaacctctcccaatgcaagtcccattacatcaaacatgtggagttctttattgtggaaacaaaacaagaaagttgcacgtgcttctaagtttagagtactggcaatcaagtctgatggtagcaccatcaacaggctagagggtctgcttaatttggatgtcactccatacactgataagttcattgctgagtacatctggattagggggactggtgtcgatgttcgcagtaaatcaagaactatatcgaagcctgtttcacatccctctgagctccctaaatggaactatgatggatctagcactgggcaggcaccgggcgatgatagtgaagtaattctatatcctcaagcaattttcagagatcctttccgtggtggtaacaatattttggttatttgcgatgcttacacaccacaaggtgagcctatccctacaaacaagcggcacagagctgctgaaatcttcagtaacccaaaggttcaagctgaaattccatggtatggaatagaacaagagtacaccctacttcaaacggatgtgaagtggcctttgggatggcctgttggcggctatcctggtcctcagggtccctattactgtgctgccggggctgataagtcattcggacgtgatatatctgatgctcattacaaggcttgcttgtatgctggaatcaacatcagtggcaccaatggggaggttatgcctgggcagtgggagtatcaagttggtcctagtgtaggtattgaagctggtgatcatatctgggcttcaaggtacctccttgagagaatcactgaacaagctggtgttgtcctcactcttgatccaaaaccaattgagggtgactggaacggtgccggagcccacaccaattacagcacaaagagcatgagggaagagggaggctttgaggtaatcaagaaggcaattttgaatctatcccttcgccaccaggaccatattcgtgcttatggagaaggaaatgagagacgattgacgggaaagcatgaaacagccgacattaacacattttcttggggagtggctaaccggggttgctcaatccgtgtgggaagagacacagagaaggaaggaaaaggttacttggaagacaggcgccctgcttcaaacatggatccatatgttgtgacagcattgctggcagagactaccttgttgtgggaaccaactctagaggctgaagctcttgcagctcagaagatacaattgaaggtctaa

SEQ ID NO: 2196 - protein, 430 aa, Lotus japonicus
MAQILAPSTQWQTRITKTSPNASPITSNMWSSLLWKQNKKVARASKFRVLAIKSDGSTINRLEGLLNLDVTPYTDKFIAEYIWIRGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYLLERITEQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 2197 - DNA, 1523 bp, Nicotiana attenuata
  CDS (51)..(1349)
caacactatttttccagcatagcattaccaacttagttggttaggtgaagatggctcagatcttggctccatctgcacaatggcagatgagaatgacaaagagctcaacagatgctaatcccttgacttcaaagatgtggagttctgtggtattgaagcagaataaaagacttgctgttaaaagctctgccaaatttagagtctttgctctccaatctgatagtggcactgtgaacagagtggaacagctgctaaacttggacgtaactccatacactgacaagatcattgctgaatatatttggatcggaggatctggaattgacatgcgcagtaaatcaaggactatttcaaagccagtcaagcatgcttctgagctcccaaagtggaactacgatggatcaagtactggacaagcacctggagaagacagtgaagtcattctataccctcaggcaatatttaaagaccctttccgtggtggtaacaacatcttggttatctgtgatgcctacacaccagctggagagccaattccaacgaacaaacgccataaagctgctcagatttttagcgactcaaaagttgtatctgaagttccatggttcggaatagaacaagagtacaccttactccaacaaaatgtgaagtggcctttaggttggcctgttggaggctaccccggacctcagggtccttactactgtggtgctggagcggataagtcatttggccgagatatatcagatgctcactacaaggcttgcctgtatgctggaattaacattagtggtaccaatggagaggttatgccggggcagtgggaatttcaagtaggtcctagtgtgggaattgaagctggagatcacatctggtgtgctagatacatccttgagagaattactgaacaagcaggagttgttctgtcacttgatccaaaaccaattgagggtgactggaatggtgccggatgccacactaactacagtacactaagtatgagagaagagggaggctttgaagtaataaagaaagcaattctgaatctctcccttcgccacaaggagcatataagtgcttatggagaaggaaatgagagaaggttgactggaaagcatgaaactgcaagtattgacaaattttcatggggagttgctaaccgtggtgcctcaatccgtgtggggcgtgacactgagaagcaaggcaaaggttatttggaagaccgtcgcccagcttcaaacatggacccctatgttgtgaccggattacttgccgaaaccactattctgtgggagccaacccttgaggctgaagctcttgctgctcaaaagctcgcattgaatgtttagattatttaagggcagaatgatccataataatcttcttagagttcatgagctgctaagtgaagaaacttgtaccttgtttagattcccttttagggaaaatcttgtaaaggaaccacaattatcagttattcctataaaagaggttccttaagacaaaaaaaaaaaaaaaaaaaa

SEQ ID NO: 2198 - protein, 432 aa, Nicotiana attenuata
MAQILAPSAQWQMRMTKSSTDANPLTSKMWSSVVLKQNKRLAVKSSAKFRVFALQSDSGTVNRVEQLLNLDVTPYTDKIIAEYIWIGGSGIDMRSKSRTISKPVKHASELPKWNYDGSSTGQAPGEDSEVILYPQAIFKDPFRGGNNILVICDAYTPAGEPIPTNKRHKAAQIFSDSKVVSEVPWFGIEQEYTLLQQNVKWPLGWPVGGYPGPQGPYYCGAGADKSFGRDISDAHYKACLYAGINISGTNGEVMPGQWEFQVGPSVGIEAGDHIWCARYILERITEQAGVVLSLDPKPIEGDWNGAGCHTNYSTLSMREEGGFEVIKKAILNLSLRHKEHISAYGEGNERRLTGKHETASIDKFSWGVANRGASIRVGRDTEKQGKGYLEDRRPASNMDPYVVTGLLAETTILWEPTLEAEALAAQKLALNV

SEQ ID NO: 2199 - DNA, 1359 bp, Elaeagnus umbellata
  CDS (36)..(1103)
ctcctttgaaaaatagcccaaacttttttataactatgtctctcctctctgatctcctcaaccttaacatctcagaatccactgatagaatcatcgctgagtacatatggattggtggatcgggcttagatctcagaagcaaagcaactctgccaaaaaaagtgaagaacccatcagaactcccaaaatggaattatgatggttcaagcacgaatcaagcccctggcgatgacagtgaagtcatcttatatccacaagcaatatttagggatcctttcagaagagggaacaatatcctggttatgtgtgacgcatacactccagctggtgaaccaatccccactaacaaacgtcacaacgctgctaagattttcagtcacccggatgtcgatgccgaggagccatggtatgggattgagcaagaatatactcttcttcagaaggaggtcaactggcctctaggatggcctcttgggggcttccctggacctcagggaccttactattgtggtgttggggcagacaaggcttttggacgcgatattgtggattcacactacaaagcctgcctatatgctggtgttaacatcagtggaatcaatggtgaagttatgcctggccagtgggagtttcaagttggcccaactgttggtattgctgctggtgatcaagtatgggttgctagatatattcttgagagaattgctgaaattgctggagtagttgtttcatttgatccaaaaccaatcaagggtcactggaatggtgctggtgctcacaccaactacagcaccaaatccatgagaattgatggaggtattaatgtgattaagaaggccattgaaaaattgggtctccgccacaaggagcacattgctgcttatggtgaaggcaatgagaggaggttgactggtcgccatgagactgcagacattaacaccttctcctggggtgttgctaacagaggagcctctgtccgtgttggccgtgatactgaaaaggacggaaaaggttactttgaggacagaaggccagcatcaaacatggatccatatgttgtgacttccatgattgctgaaaccaccatcctgtggaagccttgagaagagaacaaaaaaccaagttgtttggttgatttgagttatattggttgattggggagaagaatcaaagctatgaggaatttgaataactttatctccctttcttgtgggtgtgtgtgcttgtactttgtctacttgtttacttattattaaatcatggttgttcacacaacatgaaatgtttttaattgctcgtgttttagaagaccttagtaataaaaaagttaatgttcaatcaaaaaaaaaaaaaaaaaaa

SEQ ID NO: 2200 - protein, 355 aa, Elaeagnus umbellata
MSLLSDLLNLNISESTDRIIAEYIWIGGSGLDLRSKATLPKKVKNPSELPKWNYDGSSTNQAPGDDSEVILYPQAIFRDPFRRGNNILVMCDAYTPAGEPIPTNKRHNAAKIFSHPDVDAEEPWYGIEQEYTLLQKEVNWPLGWPLGGFPGPQGPYYCGVGADKAFGRDIVDSHYKACLYAGVNISGINGEVMPGQWEFQVGPTVGIAAGDQVWVARYILERIAEIAGVVVSFDPKPIKGHWNGAGAHTNYSTKSMRIDGGINVIKKAIEKLGLRHKEHIAAYGEGNERRLTGRHETADINTFSWGVANRGASVRVGRDTEKDGKGYFEDRRPASNMDPYVVTSMIAETTILWKP

SEQ ID NO: 2201 - DNA, 1278 bp, Triticum aestivum
  CDS (116)..(1204)
cccgcatttcccagagagctaccatttgccactacaacacctctccctctccctctccctctccatctccggtaggctccgggggaagaagaagaacagcacgccggcatccgccatgtctccgctcgccgaccttctcagcctcgacctgtccggctgcaccggcaagatcatcgccgagtacatatgggtcggcggcacgggcatggacgtcaggagcaaagccaggacgctgcccgggcccgttgatgaccccagcaagctcccaaaatggaatttcgacggctccagcaccggccaggccacgggcgacgacagcgaggtcatcctctgccctcaagccatcttcagggacccattcaggaaggggaacaacatcctggtcatctgtgactgctatgcgcctaacggagagccgattccgagcaacaagcggtacaacgcggcgaggatattcggccatcccgaggtcaaggctgaagaaccatggtatgggattgagcaagagtacacccttcttcagaaggacaccaactggcccattggctggccactagggggttaccctggccctcagggaccttactactgcgccgcgggtgcggagaaatcttacgggcgcgacatcgtcgatgcacactacaaggcctgcctctacgccggcatcaacatcggcggcatcaatgcagaagtcatgccaggacagtgggagttccaagtcggcccttccgtcggcatctcggccggcgacgagctctgggcggctcgctacatcctggagaggatcactgagattgctggcgtcgtcgtctccttcgaccccaagccgatcccgggagaatggaatggtgctggtgcccacacaaactacagcaccaagtcgatgaggagcgagggcgggtacgaggtgatcaagaaggcgatcaagaagctcgaggcgcggcacatggagcacatcgccgcctacggtgagggcaacgagcgccggctcaccggccgccatgagaccgccgacatcaacaccttcgtatggggcgtggcgaaccgcggcgcgtcggtgcgggtgggccgcgacaccgagaaggaaggcaagggctacttcgaggaccggaggccggggtccaacatggatccctacgtcgtcacctccctgatcgccgagaccaccatcctctgcaaggccggcctctccaatggcaagtagatgtcatctttgatgggttctgtcttctgtgtgaatgcccgtggttgtgtgtgtgtgtgtgtgtgtgtgtgtcc

SEQ ID NO: 2202 - protein, 362 aa, Triticum aestivum
MSPLADLLSLDLSGCTGKIIAEYIWVGGTGMDVRSKARTLPGPVDDPSKLPKWNFDGSSTGQATGDDSEVILCPQAIFRDPFRKGNNILVICDCYAPNGEPIPSNKRYNAARIFGHPEVKAEEPWYGIEQEYTLLQKDTNWPIGWPLGGYPGPQGPYYCAAGAEKSYGRDIVDAHYKACLYAGINIGGINAEVMPGQWEFQVGPSVGISAGDELWAARYILERITEIAGVVVSFDPKPIPGEWNGAGAHTNYSTKSMRSEGGYEVIKKAIKKLEARHMEHIAAYGEGNERRLTGRHETADINTFVWGVANRGASVRVGRDTEKEGKGYFEDRRPGSNMDPYVVTSLIAETTILCKAGLSNGK

SEQ ID NO: 2203 - DNA, 1299 bp, Triticum aestivum
  CDS (82)..(1170)
ttccaagaacacctctcccttcccttgctctgccctctccatctccatctccggctccgggaagaagaagaagaggtagccatgtctccgctcgccgaccttctcagcctcgacctgtccggctgcaccggcaagatcatcgccgagtacatatgggtcggcggcacagggatggacgtcaggagcaaagccaggacgctgcccgggcccgtggaggaccccagcaagcttccaaaatggaattttgacggctccagcaccggccaagccacgggtgacgacagcgaagtcatcctctgccctcaagccatcttcaaggacccattcaggagggggaacaacatcctggtcatctgtgactgctatgcgcctaacggagagccgattccgagcaacaagcggtacaacgcggcgaggatattcggccatcctgatgtcaaggctgaagaaccatggtatgggattgagcaagagtacacccttcttcagaaggacaccaactggcccattggctggccactagggggttaccctggtcctcagggaccttactactgcgccgcgggtgcggagaaatcttacgggcgcgacatcgtcgacgcgcactacaaggcctgcctctacgccggcatcaacatcggcggcatcaatgcagaagtcatgccaggacagtgggagttccaagtcggcccttccgtcggcatctcggccggcgacgagctctgggcggctcgctacatcctggagaggatcactgagattgccggtgtcgtcgtctccttcgaccccaaaccgatcccgggagagtggaatggtgctggtgcccacacaaactacagcaccaagtcgatgaggagcgagggtgggtacgaggtgatcaagaaggcgatccagaagctggaggcgcggcacatggagcacatcgccgcctacggggagggcaacgagcgccggctcaccggccgccacgagaccgccgacatcaacaccttcgtatggggcgtggcgaaccgcggcgcgtcggtgcgggtgggccgcgacaccgagaaggaaggcaagggctacttcgaggaccggaggccggcatccaacatggatccctacgtcgtcacctccatgatcgccgagaccaccatcctcagcaaggccggtctctccaatggcaagtagagtggctttgatgggttctgttatctgtgtgagtgcccgtggttgcgcatgtgtgtgtgtgtgtgtgtctgtgtgatctgcattgcagtgacaagactggcagggttgtgatatgatgataagcataac

SEQ ID NO: 2204 - protein, 362 aa, Triticum aestivum
MSPLADLLSLDLSGCTGKIIAEYIWVGGTGMDVRSKARTLPGPVEDPSKLPKWNFDGSSTGQATGDDSEVILCPQAIFKDPFRRGNNILVICDCYAPNGEPIPSNKRYNAARIFGHPDVKAEEPWYGIEQEYTLLQKDTNWPIGWPLGGYPGPQGPYYCAAGAEKSYGRDIVDAHYKACLYAGINIGGINAEVMPGQWEFQVGPSVGISAGDELWAARYILERITEIAGVVVSFDPKPIPGEWNGAGAHTNYSTKSMRSEGGYEVIKKAIQKLEARHMEHIAAYGEGNERRLTGRHETADINTFVWGVANRGASVRVGRDTEKEGKGYFEDRRPASNMDPYVVTSMIAETTILSKAGLSNGK

SEQ ID NO: 2205 - DNA, 1341 bp, Triticum aestivum
  CDS (28)..(1092)
ccctccttgcgagtagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccacaaggtgttccaatccccactaacaagaggcacaatgctgccaagatcttcaacaccccgaatgttgcagctgaggagacatggtatggtatcgagcaggagtacactctcctccagaaggacgtgaactggccccttggctggcccattggtggctaccctggtcctcagggaccctactactgcgcggccggcgcggacaaggcgttcgggcgtgacatcgttgacgcgcactacaaggcgtgcctctacgccgggatcaacatcagcggcatcaacggggaggtcatgcccggccagtgggagttccaagtcgggccgtccgtggggatcgccgcgtccgaccagctgtgggtggcgcgctacatcctcgagaggatcacggaggttgccggggtggtgctgtccctggacccgaagccgatcccgggcgactggaacggcgccggcgcgcacaccaactacagcaccaagtcgatgcgggaggccggcgggtacggggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggctgaccgcggcgcgtccatccgcgtggggcgcgacacggagaaggacggcaagggctacttcgaggaccgcaggccggcctccaacatggacccctacgtcgtcacctccatgatcgccgagaccaccctcctcctctgagccagcagcagatgacacacgcacacgctttcttcctctacctcggagtgagagagggcgacgatgaatttctttctgcaaaacgtctcctgtttccatttcttttgcaaggtctagtctgtttttggggcgtgcctttcgtgtctttcactttactcgttcagataagagtcttccgtgtactctgaaaataatgttcttctttccgcattccgataaatgaaatcatggaaccggttgtgattccgt

SEQ ID NO: 2206 - protein, 354 aa, Triticum aestivum
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPNVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYGVIKTAIEKLGKRHAQHIAAYGEGNERRLTGHHETADINTFKWGVADRGASIRVGRDTEKDGKGYFEDRRPASNMDPYVVTSMIAETTLLL

SEQ ID NO: 2207 - DNA, 1397 bp, Triticum aestivum
  CDS (78)..(1142)
tcgagctgcacacctcatctcatctcatctcagtcttcccccacattgccattccctccttgcgagtagcagcagcaatggccagcctcgccgacctcgtcaacctcgacctcagcgactgcaccgacaagatcatcgtcgagtacctctgggttggaggatccggtatcgacatcaggagcaaagcaaggacggtgaacggccccatcaccgacgcgagccagctgcccaagtggaactacgacggctccagcaccggccaggctcccggagaggacagcgaagtcatcctctacccccaggccattttcaaggacccgttcaggaggggtgacaacctccttgttatgtgcgactgctacacaccccaaggtgtgccaatccccacgaacaagaggcacaacgctgccaagatcttcaacaccccgaaggttgcagctgaggagacatggtatggaattgagcaggagtacactctcctccagaaggacgtgaactggcctcttggctggcccattggtggctaccctggtccgcagggaccatactactgcgccgccggcgcggacaaggcgttcgggcgtgacatcgtggacgcccactacaaggcctgcctctacgccgggatcaacatcagcggcatcaacggggaggtcatgcccggccagtgggagttccaagttgggccgtccgtcgggatcgcggcgtccgaccagctgtgggtggcgcgctacatcctcgagaggatcactgaggttgccggggtggtgctgtccctggacccgaagccgatcccgggcgactggaacggcgcgggcgcgcacaccaactacagcaccaagtcgatgcgggaggccggcgggtacgaggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcgcgtccgtccgcgtgggccgcgacaccgagaaggacggcaagggctacttcgaggaccgcaggccggcctccaacatggacccctacgtcgtcacctccatgatcgccgagaccacgctcctcctctgagccacccacccacggccatgcctaccgccgccagatcatgacacccaggctctcgactctctcgatcgagggtggcgattgattaatttctgcaaaacgtttcgtgtttccatttcttttgcaaggtctagtctgtttttggggcgtgcctttggtgtctttcactttactcgttcagataagagtaagagtcttcagtctactctgaaaataatgttgttttcgcattccgataaatgaaatcatggagccggt

SEQ ID NO: 2208 - protein, 354 aa, Triticum aestivum
MASLADLVNLDLSDCTDKIIVEYLWVGGSGIDIRSKARTVNGPITDASQLPKWNYDGSSTGQAPGEDSEVILYPQAIFKDPFRRGDNLLVMCDCYTPQGVPIPTNKRHNAAKIFNTPKVAAEETWYGIEQEYTLLQKDVNWPLGWPIGGYPGPQGPYYCAAGADKAFGRDIVDAHYKACLYAGINISGINGEVMPGQWEFQVGPSVGIAASDQLWVARYILERITEVAGVVLSLDPKPIPGDWNGAGAHTNYSTKSMREAGGYEVIKTAIEKLGKRHAQHIAAYGEGNERRLTGHHETADINTFKWGVADRGASVRVGRDTEKDGKGYFEDRRPASNMDPYVVTSMIAETTLLL

SEQ ID NO: 2209 - DNA, 1445 bp, Datisca glomerata
  CDS (77)..(1147)
gaattcggcacgagaaacaagagtgagagaaagaggtttactattcattttgaagcttttgttttgtattccgagtatgtctttgctatcagatctcgtcaacctcaacctctcagattctactgagaaggtcatcgcagagtacatatggatcggtggatctggtctggatatcagaagcaaagcaaggaccctcccagggcctgtcagtgatccttcaaagctccccaagtggaattatgatggttctagcacaggtcaagctcctggaaaagacagtgaagtgatcttataccctcaagcaattttcagggacccattcaggagaggcaacaacattcttgtaatgtgtgacgcttacacaccggccggagagccaattccgaccaacaagagatgtgctgcagcaaagatattcagtcatcctaatgttgttgctgaagtgccatggtatggaattgagcaggagtacacgttgttgcagaaagacgtcaagtggccaatcgggtggcctgtcggtggtttccctgggcctcagggaccatactactgtggtgttggtgctgacaaggcatttgcccgtgacgttgtcgatgctcattataaggcttgtttatatgctggcgtcaacattagcggcatcaatggggaagtcatgccggggcagtgggaatttcaagtcggtccttccgttggcatttcggccggagatgaattatgggttgctcgttacattttggagaggatcacagaaattgctggagttgttctttcttttgatcccaaaccaattcagggtgactggaatggtgctggagctcacacaaattacagtactaagtcaatgagagaaaaaggcggatacgaggttattaagaaagcgattgaaaagttagggctgaggcacaaagaacacattgctgcttacggtgaaggaaacgagcgtcgtctcaccggacgacacgagacagcagacatcaacacttccttatggggtgtggctaaccgtggagcgtccattcgtgttgggagagacaccgagaaggaaggcaaagggtactttgaggatcggagaccagcttctaacatggatccgtacgtggttacttcgatgattgcagagaccactcttctgtggaagccataagtggtctgctcagtttatcaaatgtattatcttggagaccgatgatatacaagtgtctcccattgaaattgtggaaatatgtgttttttagtaggctgcatcagaatgaatggttttccttcccattagtttttattatttgtaatttctgttgttgctgtttggccctttcggaggtggcgaagtgagattgataatctcgcgatgaataatgatcatttatgaataatgtttttttttggctgaaagggcttattttcattgttgcaatataattaattttatgatattttccctt

SEQ ID NO: 2210 - protein, 356 aa, Datisca glomerata
MSLLSDLVNLNLSDSTEKVIAEYIWIGGSGLDIRSKARTLPGPVSDPSKLPKWNYDGSSTGQAPGKDSEVILYPQAIFRDPFRRGNNILVMCDAYTPAGEPIPTNKRCAAAKIFSHPNVVAEVPWYGIEQEYTLLQKDVKWPIGWPVGGFPGPQGPYYCGVGADKAFARDVVDAHYKACLYAGVNISGINGEVMPGQWEFQVGPSVGISAGDELWVARYILERITEIAGVVLSFDPKPIQGDWNGAGAHTNYSTKSMREKGGYEVIKKAIEKLGLRHKEHIAAYGEGNERRLTGRHETADINTSLWGVANRGASIRVGRDTEKEGKGYFEDRRPASNMDPYVVTSMIAETTLLWKP

SEQ ID NO: 2211 - DNA, 1065 bp, Glomus mosseae
  CDS (1)..(1065)
  misc_feature (435)..(435): w is a or t
atggctgttgctaacaaatccaacactcaaactctcgctaaatacctttctctcgatcaaggtggtaaaatccaagccgaatacatctggattgacggcgatggtggacttcgtgggaaaaccactactcttgattttaaaccaactgatgtttccgaattaaaagaatggaattttgatggttcttcaactaatcaagctccaggagataattctgatattttacttcgcccttgtgcaatctttaaggatcctttccgtggtggtgataacatcttggtcctcgccgaatgttataataatgatggaacaccaaaccgaacaaattatcgtcattcctgtactaaacttatgtcggctcattctgaagccaaaccttggtttggtattgaacaagaatataccttgttcgatatggacggtcaagtgcttggwtggccaaaaggtggtttcccaggtcctcaaggtccttattattgttccgttggtgctaatgtagcttttggacgcgacgtcgttgaagctcattaccgcgcttgcctttactccggtgtaaatatttcgggtgttaatggtgaagttatgcctggtcaatgggaataccaagttggtccatgtgaaggaattgatatgggagatcatctttgggtatctcgatatctccttcaacgtgtagcagaagatttcggtatagttgtttccttccatcccaaaccaatcaagggagattggaacggtgcaggatgccacacaaattattcaacagaagcaatgagaatagaaggcggaataaaagcaattcatgatgcaattgatagaatgagtaaacgtcacgcagaacacatcgccgtatatggcgaggataatgacaaacgtcttaccggtcgtcacgaaactggtcatatttcagaattctcatttggtgtagcgaatcgtggtgcttcaattagaattccaagacatgttgccgctcaaggttatggttatttcgaagatcgtagaccagcttccaatattgatccttatcgtgttactgaagtcatagttgaatctactctcggttaa

SEQ ID NO: 2212 - protein, 354 aa, Glomus mosseae
MAVANKSNTQTLAKYLSLDQGGKIQAEYIWIDGDGGLRGKTTTLDFKPTDVSELKEWNFDGSSTNQAPGDNSDILLRPCAIFKDPFRGGDNILVLAECYNNDGTPNRTNYRHSCTKLMSAHSEAKPWFGIEQEYTLFDMDGQVLGWPKGGFPGPQGPYYCSVGANVAFGRDVVEAHYRACLYSGVNISGVNGEVMPGQWEYQVGPCEGIDMGDHLWVSRYLLQRVAEDFGIVVSFHPKPIKGDWNGAGCHTNYSTEAMRIEGGIKAIHDAIDRMSKRHAEHIAVYGEDNDKRLTGRHETGHISEFSFGVANRGASIRIPRHVAAQGYGYFEDRRPASNIDPYRVTEVIVESTLG

SEQ ID NO: 2213 - DNA, 1290 bp, Phragmites australis
  CDS (1)..(1290)
atggcgcaggcggtggtgccggctatgcagtgccaggtgggagtgaaggcggcagtccgtgcgaggcctgcggccgcgggggctggcggtagggtgtggggcgtcaggaggagcggccgcggcacgtcggggttcaaggtgatggccatgggcatgtcgacctccggcgtggtgccgcgcctcgagcagctgctcaacatggacaccaagccctacaccgacaatatcatcgctgagtacatctgggttggaggatctggaattgacgtcagaagcaaatcgaggacaatatcgaaaccagttgaggatccctcggagctaccgaaatggaactatgatggatcaagcacagggcaagctccaggagaagacagtgaagtcatcctatatccccaggctatcttcaaggatccatttcgaggtggcaacaacatattggttatctgtgatacatacacgccagctggggaacccattcctactaacaaacgccacagggctgcacaaatattcagcgacccaaaggtcgttagccaagtgccatggtttggcattgagcaggagtacactttgctccagacagatgtgaattggcctcttggctggcctgttggaggctaccctggtccccagggtccatactactgcgcggtaggagcagacaaatcatttggccgtgacatatcagacgctcactacaaaccatgtctttacgctggaatcaacattagtggaacaaacggggaggtcatgcctggtcagtgggagtatcaagttggacctagcgttggaattgaagcaggagaccacatatggatttcaagatacattctcgagagaatcacggagcaagctggtgtggtgcttacccttgatccaaaaccaattcagggtgactggaatggagctggctgccacacaaactacagcacaaagagcatgcgtgaagatggaggatttgaagtgatcaagaaagcaatccttaacctttctcttcgccatgatttgcatattagtgcatatggagaagggaatgaaaggaggttgacagggttacatgagacagcgagcattgacaacttctcatggggtgtggcaaaccgtggctgctctattcgggtggggcgagatactgaggcaaaagggaaaggctacctggaagaccgtcgcccggcatcaaacatggacccatatgttgtgacatcgctactggctgaaaccacaattctttgggagccaaccctcgaagtagaggctcttgccgctaagaagttggcgctgaaggtatga

SEQ ID NO: 2214 - protein, 429 aa, Phragmites australis
MAQAVVPAMQCQVGVKAAVRARPAAAGAGGRVWGVRRSGRGTSGFKVMAMGMSTSGVVPRLEQLLNMDTKPYTDNIIAEYIWVGGSGIDVRSKSRTISKPVEDPSELPKWNYDGSSTGQAPGEDSEVILYPQAIFKDPFRGGNNILVICDTYTPAGEPIPTNKRHRAAQIFSDPKVVSQVPWFGIEQEYTLLQTDVNWPLGWPVGGYPGPQGPYYCAVGADKSFGRDISDAHYKPCLYAGINISGTNGEVMPGQWEYQVGPSVGIEAGDHIWISRYILERITEQAGVVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTSLLAETTILWEPTLEVEALAAKKLALKV

SEQ ID NO: 2215 - DNA, 1290 bp, Phragmites australis
  CDS (1)..(1290)
atggcgcagccggtggtgccggcgatgcagtgtcaggtcggggcgcggggcaaggcggccgtccgggcgaggccggcgggtgcgggaggaagggtgtggggcgtgaagaggagcgggcgcggcacgtccgggttcaaggtgatggccgtgagcacggagagcaccggggtggtgccgcgcctcgagcagctgctcaacatggacaccaagcccttcaccgacaagatcattgccgagtacatctgggttggaggatctggaattgacctcagaagcaaatcaaggacattatcaaaaccagtggaggatccctctgagctaccgaaatggaactacgacggatcaagcacagggcaagctccaggagaagacagtgaagtcatcctatacccccaggctatcttcaaggacccatttcgaggtggcaacaacatattggttatctgtgatacttacacaccagctggggaacccattcctactaacaaacgccacagggctgcacaaatattcagtgacccgaaggtcgtggaccaagtgccatggtttggcattgaacaggagtacactttgctccagacagatgtgaattggcctcttggctggcctgttggaggctaccctggtccccagggtccatactactgcgctgtaggagcagacaaatcatttggccgtgacatatcagatgctcactacaaggcatgtctttacgctggaattaacattagtggaacaaatggggaggtcatgcctggtcagtgggagtatcaggttggacctagcgttggtattgaagcaggagatcacatatggatttcaagatacattctcgagaggatcacggagcaagctggcatagtgcttactcttgatccgaaaccaattcagggtgactggaacggagctggttgccacacaaattacagcacaaagagcatgcgtgaggatggaggttttgaagtgatcaagaaagcaatcctgaacctttctcttcgccatgatctgcatattagtgcatatggagaaggaaatgaaaggaggttgacaggattacatgagacagctagcatagacaacttctcatggggtgtggcaaaccgtggctgctctattcgggtggggcgagatactgaggcaaaaggaaaaggctacctggaagaccgtcgcccggcatcaaacatggacccatatgttgtgacatcgctactggctgaaaccacaattctttgggagccaacccttgaggcggaagctcttgccactaagaagttagcactgaaggtatga

SEQ ID NO: 2216 - protein, 429 aa, Phragmites australis
MAQPVVPAMQCQVGARGKAAVRARPAGAGGRVWGVKRSGRGTSGFKVMAVSTESTGVVPRLEQLLNMDTKPFTDKIIAEYIWVGGSGIDLRSKSRTLSKPVEDPSELPKWNYDGSSTGQAPGEDSEVILYPQAIFKDPFRGGNNILVICDTYTPAGEPIPTNKRHRAAQIFSDPKVVDQVPWFGIEQEYTLLQTDVNWPLGWPVGGYPGPQGPYYCAVGADKSFGRDISDAHYKACLYAGINISGTNGEVMPGQWEYQVGPSVGIEAGDHIWISRYILERITEQAGIVLTLDPKPIQGDWNGAGCHTNYSTKSMREDGGFEVIKKAILNLSLRHDLHISAYGEGNERRLTGLHETASIDNFSWGVANRGCSIRVGRDTEAKGKGYLEDRRPASNMDPYVVTSLLAETTILWEPTLEAEALATKKLALKV

SEQ ID NO: 2217 - DNA, 1409 bp, Camellia sinensis
  CDS (126)..(1196)
agctcattactcctcgccacagactccaacacaaaccacgtatagtacggagagaaagaggagagagggagagtcaaagcatcgtgtggtttgtttggagtgggtgtttttgatcgatcgtcactatgtctcttctttccgatctttgcaacttgaatctatctgagtccaccgagaagatcattgcagagtacatatggatcggtggatctggtatggacctcagaagcaaagccaggaccctgaatgcaccagtctctgatccttcaaagttaccacaatggaactacgatggttccagcactggccaagcccctggcgaggacagtgaagtgattttatatccccaggcaatttataaagacccattcaggagaggcaacaacattcttgtaatgtgtgatgcttacacgccgggtggagagccaatcccaacaaataagaggtttgatgctgccaagatattcagccaccctgatgttgttgctgaggaaccttggtatggtatagagcaggagtacactttgttgcagaaagaagtgaagtggccgattggttggcctgtgggaggttatcctggaccacagggaccatactactgtggtattggtgcggataaagcttttgggcgagacattgtcgatgcccattataaggcatgtctttatgctggtattaacattagtggcatcaatggagaggtgatgccgggtcagtgggaattccaagttgggccttctgttggcatcagttctggagatcagttgtggatggctcgttacattctagaaaggatcactgaaattgctggagtcgttgtttcgttcgaccctaaacctattgagggtgactggaatggagccggtgctcacaccaactacagtaccaagtccatgcgaagtgatgggggctttgaagtcattaagaaggccatcgaaaagcttggattgaagcacaaggaacacattgctgcttatggagaaggcaatgagcgtcggcttacaggaaagcacgaaacagctgacataaacacattcttatggggagtggcaaaccgtggagcctccattagggttggccgggacacagagaaggcaggcaaaggttattttgaggacaggaggcctgcatcaaacatggatccgtacgttgtcacttccatgatcgcaaacaccaccatcctctggaaaccgtaagaacggaagcaagaatttctattgttttttggatgtgcacattttgttttagttgtttccaaaatgtatttgcagttgtgggttttggacatttgcatcttcatttgccgtgaattgacaataagttaattgacattaaaaaaaaaagaagcaggcttttgccttattagtaaattcatcatggtatgtttggctgttaaaaaaaaaaaaaaa

SEQ ID NO: 2218 - protein, 356 aa, Camellia sinensis
MSLLSDLCNLNLSESTEKIIAEYIWIGGSGMDLRSKARTLNAPVSDPSKLPQWNYDGSSTGQAPGEDSEVILYPQAIYKDPFRRGNNILVMCDAYTPGGEPIPTNKRFDAAKIFSHPDVVAEEPWYGIEQEYTLLQKEVKWPIGWPVGGYPGPQGPYYCGIGADKAFGRDIVDAHYKACLYAGINISGINGEVMPGQWEFQVGPSVGISSGDQLWMARYILERITEIAGVVVSFDPKPIEGDWNGAGAHTNYSTKSMRSDGGFEVIKKAIEKLGLKHKEHIAAYGEGNERRLTGKHETADINTFLWGVANRGASIRVGRDTEKAGKGYFEDRRPASNMDPYVVTSMIANTTILWKP

SEQ ID NO: 2219 - DNA, 1401 bp, Securigera parviflora
  CDS (99)..(1169)
gaaaacccccctatcaaaagctagaagctttcactagtgattagctaccatttgccatcctctcactgttctgctttctgcacaacaactagtttaccatgtctttgcttacagatctcgtcaacctcaacctctcggaatccacggaaaagattattgctgagtacatatgggttggtggatctggattggatatcagaagcaaagccaggactcttcctggaccggttagtgaccctgcaaaacttcccaagtggaactatgatggttctagcacagatcaagctcctggggaggatagtgaagtcatcctatatccacaagctattttcagggacccctttagaagaggcagcaacattcttgtgatttgtgatgtttacaccccagctggagagccacttccatcaagctataggtacaatgctgccaaaattttcagccacccagaggtagctgctgaggaaccttggtatggtattgagcaagagtataccttgttgcagaaagatataaattggccactaggttggccagttggtggatttcctggacaacagggcccatactactgtggtattggtgctgataaagcctatggccgtgacattgtagatgcacattacaaagcttgtctttatgctggcattaacattagtggtatcaatggagaggttatgcctggccagtgggaattccaagttggtccttccgttggtatctcagctggtgatgagatatgggctgcaagatacattcttgagagaattacagagattgctggagcagttgtttcatttgatcccaagcctattccaggagactggaatggtgctggtgctcacacaaactacagcaccaagtccatgagagaagatggaggctttgagatcatcaaaaaggccattgaaaagcttggattgaagcacaaggagcacattgcagcttatggaaaaggcaatgagagacgtctcactggcaaacatgaaacagcagacatcaacaccttctcttggggtgtggcaaaccgtggagcctcagttagagttggaagagagacagaaaaagaagggaaaggctactttgaggacaggaggcctgcttctaacatggatccatacattgtcacctccatgattgcagagactaccatcctctggaagccatgaagatgaaaatattcacagccatcgattaatttctctctagaaatttataccactacataatatatcttgtgttgttgttgttgttcctggctgttagtaattagtaatttgctatgtggtcttttgatcattagcatatggtccatgggccctgtgttctgtttcacaataatttcatcattaataacaaggactacctctgcttcttgatttcaaaaaaaaaaaaaaaaaa

SEQ ID NO: 2220 - protein, 356 aa, Securigera parviflora
MSLLTDLVNLNLSESTEKIIAEYIWVGGSGLDIRSKARTLPGPVSDPAKLPKWNYDGSSTDQAPGEDSEVILYPQAIFRDPFRRGSNILVICDVYTPAGEPLPSSYRYNAAKIFSHPEVAAEEPWYGIEQEYTLLQKDINWPLGWPVGGFPGQQGPYYCGIGADKAYGRDIVDAHYKACLYAGINISGINGEVMPGQWEFQVGPSVGISAGDEIWAARYILERITEIAGAVVSFDPKPIPGDWNGAGAHTNYSTKSMREDGGFEIIKKAIEKLGLKHKEHIAAYGKGNERRLTGKHETADINTFSWGVANRGASVRVGRETEKEGKGYFEDRRPASNMDPYIVTSMIAETTILWKP

SEQ ID NO: 2221 - DNA, 1508 bp, Securigera parviflora
  CDS (105)..(1175)
gaaaaaaagagagaagcaaaagagagagaaagaggtcattgctggttgctgtgagcgacgacgacgacgactgtgaagtcttgctgctgctgctgcttttgaagatgtcgctgctctcagatctcatcaacctcaacctctctgaaaccaccgacaagatcatcgccgagtacatatggatcggtggatcaggcctggacttgaggagcaaagcaaggaccctgccaggaccagtcagcgacccttcagaactgcccaagtggaattatgatggttccagcacaggtcgagctcctggggaagacagtgaagtgattttatacccacaggccattttcaaagatccattcagaaggggaagcaatatcttggttatctgtgatgcatacactcctgctggagaacccattcccaccaacaagagacatgctgctgccaaggtcttcagccatcctgatgttgtagctgaagtaccatggtatggtattgagcaggaatataccttgttgcagaaagaggttaactggcctcttggttggcctcttggtggtttcccaggaccacagggaccatactactgtggtactggagctgataaggctcttggccgtgatattgtggacgcacactacaaagcatgcctatatgctggtgtgagcatcagtggaattaatggagaagtgatgcctggtcagtgggaattccaagttggaccttcagtaggtatctctgctggtgatgaggtgtgggttgctcgttacgttttggagaggatcactgagattgctggtgtggtgctttcctttgaccctaagccaattaagggtgattggaatggtgctggtgcgcacacaaattacagcacaaagaccatgagagaggatggtggctatgaaatcatcaagaaggcaattgagaagttgggcttgagacacaaggagcacattgctgcttatggagaaggcaacgagcgtcgtttgacaggaagacacgagacagctgacataaacactttcttatggggagttgcaaaccgtggtgcttctattagagttggaagggacacagagaaagcagggaagggttactttgaggacagaaggcctgcatctaacatggacccatatgtggttacttccatgattgcagacacaaccattctctggaaaccatgagccacagttacaggaacatttgcttgcatgtcttcgaaagtcattgttatttctcctttggatggatcaagggagcagtttctttttcctgattaggatttggccattgctttttatttcgtctgattttattgtgttcttgttatggctggcatatggtctgaggcctgtgtgtttgcacaaactaccaaggctcattgcttgctacttctctccctcattttctttttaagtttcacaataataatgtaatggttatcagtgaaaaagatgattgtcgagtatattaataatatatatgaagttgatatgttgatgaaaaaaaaaaaaaaa

SEQ ID NO: 2222 - protein, 356 aa, Securigera parviflora
MSLLSDLINLNLSETTDKIIAEYIWIGGSGLDLRSKARTLPGPVSDPSELPKWNYDGSSTGRAPGEDSEVILYPQAIFKDPFRRGSNILVICDAYTPAGEPIPTNKRHAAAKVFSHPDVVAEVPWYGIEQEYTLLQKEVNWPLGWPLGGFPGPQGPYYCGTGADKALGRDIVDAHYKACLYAGVSISGINGEVMPGQWEFQVGPSVGISAGDEVWVARYVLERITEIAGVVLSFDPKPIKGDWNGAGAHTNYSTKTMREDGGYEIIKKAIEKLGLRHKEHIAAYGEGNERRLTGRHETADINTFLWGVANRGASIRVGRDTEKAGKGYFEDRRPASNMDPYVVTSMIADTTILWKP

SEQ ID NO: 2223 - DNA, 1552 bp, Medicago truncatula
  CDS (41)..(1327)
agtttgcagctttttgccatttttcaactctgtattgaacatggcacagattttggctccttctacacaatgtcaggcaagaatcacaaaaatctctcccgttgcaactccaatctcatcaaagatgtggagttctttggttatgaaacaaaacaagaaagtcgcacgttctgctaaattcagagtaatggcagtcaactctggcaccatcaacagggttgaggatttacttaatttggacattactccattcaccgacagcataattgccgagtacatctggattggtggaacaggaatcgatgtgcgcagcaaatcaagaaccatatcaaagcctgttgagcatccctctgagcttcctaagtggaactacgatggttctagcactggacaagcccctggtgaagatagtgaagtgatcctatatcctcaagcaattttcaaggatcctttccgtggtggtaacaacattttggtcatttgcgatgcttatacaccacaaggtgagcctattcctacaaataagagacataaagctgctgaaatcttcagtaacccaaaggttgaggctgaaattccgtggtatggaatcgaacaagagtacaccttacttcaaacagatgtgaaatggccattaggttggcctgtaggtggctatcctggtcctcagggtccttattactgtgctgccggggcagataagtcatttggacgtgatatatctgatgctcattacaaggcttgtttatatgctggaattaacatcagtggtaccaatggagaggttatgcctgggcagtgggagtatcaagttggtcctagcgtaggtattgaagctggtgatcatatctgggcttcaaggtacatccttgagagaattactgaacaagctggtgttgtgctcacccttgatccaaaaccaattgagggtgattggaatggtgcaggatgtcacaccaattacagtacaaagagcatgagggaagatggaggatttgaggtaataaagaaggctattttgaacctttcccttcgccacaagatccacattgaagcatatggagaaggaaatgagagaaggttgacaggaaagcatgagactgccagcatcaacacattttcttggggagtggctaaccgtggatgctcaatccgtgtgggaagagacaccgaaaagaatggcaaaggttacttggaagacaggcgtccggcttcgaacatggatccatatgtggtaacagccttattggcagagagtacattattgtgggaaccaactctagaggctgaagctcttgcagctcagaagattgcattgaaagtctaaatctattgattaatggagtcagcactgctgcagtctgtgaggagcttgaaatctctttcactttccatttagatttattatattatgaagatcttgtttggacaaatgaggctgccatgcctagttattggttatgagatgaatgcacattgtatatcagatattacgttggctgtgtttgcatatggtatggacagagttgcattgaaaaaaaaaaaaaaaaaa

SEQ ID NO: 2224 - protein, 428 aa, Medicago truncatula
MAQILAPSTQCQARITKISPVATPISSKMWSSLVMKQNKKVARSAKFRVMAVNSGTINRVEDLLNLDITPFTDSIIAEYIWIGGTGIDVRSKSRTISKPVEHPSELPKWNYDGSSTGQAPGEDSEVILYPQAIFKDPFRGGNNILVICDAYTPQGEPIPTNKRHKAAEIFSNPKVEAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKIHIEAYGEGNERRLTGKHETASINTFSWGVANRGCSIRVGRDTEKNGKGYLEDRRPASNMDPYVVTALLAESTLLWEPTLEAEALAAQKIALKV

SEQ ID NO: 2225 - DNA, 1436 bp, Lotus japonicus
  CDS (1)..(1293)
  misc_feature (1375)..(1375): n is a, g, c or t
  misc_feature (1425)..(1425): n is a, g, c or t
atggcacagattttggcaccctcgacgcaatggcagacgagaatcaccaaaacctctcccaatgcaagtcccattacatcaaacatgtggagttctttattgtggaaacaaaacaagaaagttgcacgtgcttctaagtttagagtactggcaatcaagtctgatggtagcaccatcaacaggctagagggtctgcttaatttggatgtcactccatacactgataagttcattgctgagtacatctggattggggggactggtgtcgatgttcgcagtaaatcaagaactatatcgaagcctgtttcacatccctctgagctccctaaatggaactatgatggatctagcactgggcaggcaccgggcgatgatagtgaagtaattctatatcctcaagcaattttcagagatcctttccgtggtggtaacaatattttggttatttgcgatgcttacacaccacaaggtgagcctatccctacaaacaagcggcacagagctgctgaaatcttcagtaacccaaaggttcaagctgaaattccatggtatggaatagaacaagagtacaccctacttcaaacggatgtgaagtggcctttgggatggcctgttggcggctatcctggtcctcagggtccctattactgtgctgccggggctgataagtcattcggacgtgatatatctgatgctcattacaaggcttgcttgtatgctggaatcaacatcagtggcaccaatggggaggttatgcctgggcagtgggagtatcaagttggtcctagtgtaggtattgaagctggtgatcatatctgggcttcaaggtacctccttgagagaatcactgaacaagctggtgttgtcctcactcttgatccaaaaccaattgagggtgactggaacggtgccggagcccacaccaattacagcacaaagagcatgagggaagagggaggctttgaggtaatcaagaaggcaattttgaatctatcccttcgccaccaggaccatattcgtgcttatggagaaggaaatgagagacgattgacgggaaagcatgaaacagccgacattaacacattttcttggggagtggctaaccggggttgctcaatccgtgtgggaagagacacagagaaggaaggaaaaggttacttggaagacaggcgccctgcttcaaacatggatccatatgttgtgacagcattgctggcagagactaccttgttgtgggaaccaactctagaggctgaagctcttgcagctcagaagatacaattgaaggtctaaatctattgattgatggcattcttgatggagagcacgtacactttccttttagattatctacattctgaagatcttgtttggncaaaagaggctcctatgcccagttacttgattgtcgaatgaaatgtgcantgtatatcata

(The sequence listing continues in the following parts.)

The invention claimed is:

1. A method for producing a transgenic plant with increased yield compared to a corresponding non-transformed wild type plant, comprising:

(a) transforming a plant cell, a plant cell nucleus, or a plant tissue with a nucleic acid selected from the group consisting of:

(i) a nucleic acid comprising the nucleotide sequence of SEQ ID NO: 147;

(ii) a nucleic acid encoding a polypeptide comprising the amino acid sequence of SEQ ID NO: 148; and
(iii) a nucleic acid encoding a polypeptide having at least 95% sequence identity with the amino acid sequence of SEQ ID NO: 148;
and
(b) regenerating a transgenic plant from said transformed plant cell, plant cell nucleus, or plant tissue with increased yield compared to a corresponding non-transformed wild type plant.

2. The method of claim 1, further comprising selecting a transgenic plant having increased yield compared to a corresponding non-transformed wild type plant on the basis of said transgenic plant showing increased yield as compared to the non-transformed wild type plant.

3. The method of claim 1, further comprising obtaining a seed or progeny from said transgenic plant, wherein said seed or progeny comprises said nucleic acid and has increased yield compared to a corresponding non-transformed wild type plant.

4. The method of claim 1, wherein the transgenic plant exhibits increased yield compared to a corresponding non-transformed wild type plant under standard growth conditions.

5. The method of claim 1, wherein the transgenic plant exhibits increased yield compared to a corresponding non-transformed wild type plant under stress conditions.

6. The method of claim 1, wherein the nucleic acid comprises:
(a) the nucleotide sequence of SEQ ID NO: 147; or
(b) a nucleic acid encoding a polypeptide comprising the amino acid sequence of SEQ ID NO: 148.

7. The method of claim 1, wherein the plant cell, plant cell nucleus, or plant tissue is obtained from a monocotyledonous plant or a dicotyledonous plant.

8. A transgenic plant obtained by the method of 1, or a seed or progeny of said transgenic plant, wherein said plant, seed or progeny comprises said nucleic acid.

9. A nucleic acid construct comprising:
(a) a nucleic acid selected from the group consisting of:
(i) a nucleic acid comprising the nucleotide sequence of SEQ ID NO: 147;
(ii) a nucleic acid encoding a polypeptide comprising the amino acid sequence of SEQ ID NO: 148; and
(iii) a nucleic acid encoding a polypeptide having at least 95% sequence identity with the amino acid sequence of SEQ ID NO: 148;
and
(b) one or more heterologous regulatory sequences operably linked to the nucleic acid of (a),
wherein said one or more regulatory sequences comprise a plant promoter.

10. The nucleic acid construct of claim 9, wherein the nucleic acid comprises:
(a) the nucleotide sequence of SEQ ID NO: 147; or
(b) a nucleic acid encoding a polypeptide comprising the amino acid sequence of SEQ ID NO: 148.

11. A vector comprising the nucleic acid construct of claim 9.

12. A host cell transformed stably or transiently with the nucleic acid construct of claim 9 or a vector comprising said nucleic acid construct, wherein said host cell is a plant cell or a microorganism.

13. A transgenic plant, plant cell, plant tissue or plant part comprising the nucleic acid construct of claim 9.

14. The transgenic plant, plant cell, plant tissue or plant part of claim 13, wherein said transgenic plant, plant cell, plant tissue or plant part is obtained by transforming a plant, plant cell, plant tissue or plant part with said nucleic acid construct.

15. The transgenic plant of claim 13, wherein said transgenic plant exhibits an improved yield-related trait compared to a corresponding non-transformed wild type plant.

16. The transgenic plant of claim 13, wherein said transgenic plant exhibits an improved nutrient use efficiency and/or abiotic stress tolerance compared to a corresponding non-transformed wild type plant.

17. The transgenic plant of claim 13, wherein said transgenic plant exhibits an increased tolerance to low temperature compared to a corresponding non-transformed wild type plant.

18. The transgenic plant of claim 13, wherein said transgenic plant exhibits an increased harvestable yield compared to a corresponding non-transformed wild type plant.

19. The transgenic plant of claim 13, wherein said transgenic plant exhibits an increased yield compared to a corresponding non-transformed wild type plant, wherein said increased yield is calculated on a per plant basis or in relation to a specific arable area.

20. The transgenic plant, plant cell, plant tissue or plant part of claim 13, wherein said transgenic plant is a monocotyledonous plant or a dicotyledonous plant, and wherein said plant cell, plant tissue or plant part is obtained from a monocotyledonous plant or a dicotyledonous plant.

21. The transgenic plant, plant cell, plant tissue or plant part of claim 13, wherein the plant is selected from the group consisting of corn (maize), wheat, rye, oat, triticale, rice, barley, soybean, peanut, cotton, oil seed rape, including canola and winter oil seed rape, *manihot*, pepper, sunflower, flax, borage, safflower, linseed, primrose, rapeseed, turnip rape, tagetes, solanaceous plants comprising potato, tobacco, eggplant, tomato; *Vicia* species, pea, alfalfa, coffee, cacao, tea, *Salix* species, oil palm, coconut, perennial grass, forage crops and *Arabidopsis thaliana*.

22. The transgenic plant, plant cell, plant tissue or plant part of claim 13, wherein the plant is selected from the group consisting of corn, soy, oil seed rape, canola, winter oil seed rape, cotton, wheat and rice.

23. A method for enhancing a yield-related trait in a plant compared to a corresponding control plant, comprising:
(a) transforming the nucleic acid construct of claim 9 into a plant, plant cell or plant part;
(b) selecting a transgenic plant having an enhanced yield-related trait compared to a corresponding non-transformed control plant.

24. The method of claim 23, wherein the plant, plant cell or plant part is obtained from a monocotyledonous plant or a dicotyledonous plant.

25. The method of claim 23, wherein the enhanced yield-related trait comprises increased yield, enhanced tolerance to abiotic environmental stress and/or increased nutrient use efficiency.

26. The method of claim 25, wherein the enhanced tolerance to abiotic environmental stress comprises an increased drought tolerance, an increased low temperature tolerance, an increased heat tolerance and/or an increased salt stress tolerance compared to a corresponding non-transformed control plant.

* * * * *